United States Patent 7,560,542 (NUCLEIC ACID MOLECULE SEQ ID NO. 68811 AND OTHER MOLECULES ASSOCIATED WITH PLANTS) - sequence listing, part 4

SEQ ID NO: 18802 - DNA, 378 bp, Zea mays
  Clone ID: LIB189-007-Q1-E1-A8
aattcccgggctgacccaaacgtcagaaaaaaaaaaaaaaaaaaaaaaaaaaaaaaaaaaaaaagaaagacgaacaaataagataaaaacttaagtaaacataaaaagtaaaaaaataaatcttcaaaaaaaaaacaaaaaattcaattcggggggcgtcccataaagattctacattaatgtgaccgtcatggagttatcaaacttattcaacttgcacaccaaattccatttcactaggtggtctttttaaacattctgaacggaaaaatcctggttctaaccaattttaacccctttgtagcaaatcccactttcccaatatcggtttatatgacaaaggcgttgtcgtttgtcctttcaaaatatttgctaaac

SEQ ID NO: 18803 - DNA, 359 bp, Zea mays
  unsure at all n locations
  Clone ID: LIB189-007-Q1-E1-B1
ggtcgacgcacgcgtccacccacacgtccgcccacgcgtccgcccacgcgtccggtgccctgcaggagtcgctcgccaccaagctcgcggccgggatgaccgcaatgagcagggcaaccgacaacgcaatcgagctcggcaggaacccctccatcgcctacaaccgacagcgccaggccaagatcaccggggagatcctcgagatcgtcgccggtgccgacgccctcgctggctgagcctgagtcnccttggtggtgcggtgctcctgctatatataattctttttcctcattttctccactctgcctgtaattcctgataatagcacaaacgcaacggagttctgtgttccttgcgac

SEQ ID NO: 18804 - DNA, 422 bp, Zea mays
  Clone ID: LIB189-007-Q1-E1-B11
ccgggccgacccacgcgtcagcccacgcgtccgcccacgacgggctcctggtctgggactccatcaagcagtgggcgtccgagtacgtcaacgtctactacaagtccgacgaggccgtggccgccgaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggagggcgggccgggcgaggagatggagaagttcctcaagcagccggagacgacgctgctggacatg

SEQ ID NO: 18805 - DNA, 425 bp, Zea mays
  Clone ID: LIB189-007-Q1-E1-B2
ccacgcgtccacggacgcgtgggcggacgcgtcgggtacatatctttgaggcagttcatgacaacgacaatcctatgcggaaaccgcacctacgcaagcgaccctaagaagcaactgggcatccaaagaacattatacccctcccattgggcttcctgcccttttttgtagtgcaacaaatggcgtcattattccacaatgctcacttgcacatagtgccattattcgacagttcctccctccagttacgtcaatgggcttcgaacatgcagctgtgcaagcctagaggctacaacaagcgcttgcggagagcgtcttagaacaaccaattgcccaattacaacaacaatccttgggacatctaaccatacataccatcgcaacgcagcagcaacaagcactgagccaactaaccgtggtgaacc

SEQ ID NO: 18806 - DNA, 432 bp, Zea mays
  Clone ID: LIB189-007-Q1-E1-B7
ccgggccgacccacagcgtcagcccacgcgtccgcggacgcgtgggcggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaggtgacgaggaggagctccagaaggagaacatcaagaacgccgcctcctccaccggcaacatcacgttgagcgtcaccaagagcaacccggagaccggcgaggtcatcggcgtcttcgagagcgtgcagccgtccgacaccgacctcggggccaaggcgcccaaggatg

SEQ ID NO: 18807 - DNA, 416 bp, Zea mays
  Clone ID: LIB189-007-Q1-E1-C1
gggccgagccacgcgtccacccacacgtccgggccgtgctgcagggcctgctgaaggtggtggcgggcatcgagatctccttcacgctgacgtccaagtcgggcggcgacgacgtggacgacgagttcgcggacctgtacatcgtcaagtggacgtcgctgatgatcccgcccatcgtgatcatgatggtgaacctgatcggcatcgcggtcgggttcagccgcaccatctacagcgagatcccgcagtggagcaagctgctgggcggcgtcttcttcagcttctgggtgctggcgcacctgtacccgttcgccaagggcctgatggggcggaggggccgcacgccgaccatcgtcttcgtctgggcgggcctcctctccatcaccatctcgctgctgtgggtggccatcaacccg

SEQ ID NO: 18808 - DNA, 258 bp, Zea mays
  Clone ID: LIB189-007-Q1-E1-C10
tattagcttaattgcatgcatgcagcatgagatatactagcagtgatggatcgtcacacgctgcagaccctgtcaccgattcttaaactgcagacgatagaacttacatccatgcactagtggtagagatcctcatacctgacgatgtatgctctgatgtacttctacaaactcgcgtgtttagcgctacgggccatcctgttgtcaacgtttcagcgatgttggacatttttggtatgttaccacgctatactgtca

SEQ ID NO: 18809 - DNA, 76 bp, Zea mays
  Clone ID: LIB189-007-Q1-E1-C11
aaataggtctaaagtcttactacgcgtgcatgcgaggtcgtacctcttctaaagtgtcacgtaatttcatttcaag

SEQ ID NO: 18810 - DNA, 463 bp, Zea mays
  Clone ID: LIB189-007-Q1-E1-C12
ggtaacggtcaggaattcccgggccgacccacgcgtcagtgctcgcggccgacgtccacctcggcaccaagaactgcgatttccagatggagcggtatgtctttaagcgtcgcaccgacggcatctacatcatcaacctgggcaagacatgggataagctccagctcgcggcgagggttattgttgccattgagaacccacaagacatcatcgtccagtcggcccgcccctacggccagcgtgctgtcctcaagttcgcgcagtacactggcgcccatgccatcgctgggaggcacacccctggtaccttcaccaatcagctccagacctctttcagcgagcctcgcctgctcatccttactgacccaaggactgaccatcagccaatcaaggagtctgctctggggaacatcccgaccattgccttctgcgacactgactctcccatgcggtatgtcgatat

SEQ ID NO: 18811 - DNA, 413 bp, Zea mays
  unsure at all n locations
  Clone ID: LIB189-007-Q1-E1-C2
gggccgacccacgcgtccacacagatcacgatgggagaatcaactaccaggagtttgttgccatgatgaagaataatagccccgagattgttcaaatcggaggcgcatgttttaaggctcatctcctacatttaattggaaaaaagaaagacttctaagatatatttttccgcggtcagaggggagagcaactgatactcgaaagtgggattcagcctgngcatatgtgcaatgatattacagactttggacaagtcatcagtcatgggtgattgcctttgtgttgcttccatgcctgggcatatgtgcaatgatattacagactttggacaagtcatcagtcatgggtgattgcctttgtgttgcttccatttttcgacatctcatcctacatttaattggaaaaaagaaag

SEQ ID NO: 18812 - DNA, 370 bp, Zea mays
  Clone ID: LIB189-007-Q1-E1-C3
gcgtccacagcgatcaaggactgggaacagcagcactggcggccaaggaacctgaagcgctccctttctgcgccatcgcttatagtttcacggggattttcggcacgctgatctgctcggttccggcagtcaggcaaagcctgatattcatagctggttaagagatgatctgaatttgacggtttcattctttagataaaagaagcagcttgcttcctccctccgtgttcagaaggtcaggaagcaacgccccacatgtcaggtcaggattcaatatgtgtaggggcttgaaaaaaaaaggcgaataattctgtaatcaggatgtaaccgacatactacagttttttttttcttgtgacaaaatactact

SEQ ID NO: 18813 - DNA, 454 bp, Zea mays
  Clone ID: LIB189-007-Q1-E1-C5
aattcccgggccgacccacgcgtcaggccagccaaagccttcttacaagggttttccaaatgtttaacaagatagagcctcctattcttcttaagattcttaggtgcattaatcatttgtcgggtgatcctaattgtcttgagacacttcaacgcacagatgcaatcaaacatctgataccgattctggagcttcgtgatggacctctggtttatcaaatacatagtgaggtccttaatgctttgttcaacctttgcaaaattaataaaagaagacaggaacaagcagccgaaaatggaatcatccctcacttgatgaaatttgtcatgtcagactcacctttgcggcagtatgccctgcctttgctgtgtgatatggctcatgctttctgcaactctagagagcagttgagggtcatggaggactagatgtgtacttaaatctgctggaggat

SEQ ID NO: 18814 - DNA, 434 bp, Zea mays
  unsure at all n locations
  Clone ID: LIB189-007-Q1-E1-C6
ccgggccgacccacgcgtcagcccacgcgtccggcatccccctgcagtgctggccacataatggcgaataagtccgctgccgctgctattctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgcgggcaccaacgagaccccgaacccctgcaaccccggcgcctccgtcaccgtcaagatcgtcgacctctgcccgtcgcccggctgccaggccacgctcgacctctcncagcaggccttcgccaccatcggcaacctcggcgccggcaa

SEQ ID NO: 18815 - DNA, 434 bp, Zea mays
  Clone ID: LIB189-007-Q1-E1-C7
gtcaggagttcccgggccgacccacgcgtcaggacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgagccagtgcgtcgagttcctgaggcaccagtgcagcccggcggcgacgccctacggctcgccacagtgccaggcgctgcagcagcagtgctgccaccagattaggcaggtggagcccctgcaccggttacaggcgacatacggtgtg

SEQ ID NO: 18816 - DNA, 442 bp, Zea mays
  Clone ID: LIB189-007-Q1-E1-C8
aggtaatggtcaggaattcccgggccgacccacgcgtcagcccacgcgtccgcccacgcgtccgcccacgcgtccgcccacgcgtccgagaacctccgcgtccgcgtgtacaggccgacgacgccgccgggggcgaagaagaagctcccggtgctcgtccacttccacggcggcggcttctgcctggggtcgtgcacgtgggccaacgtccacgagttctgcctccgcctggccgcggaggccggcgccgtcgtgctctctgcgggctaccgcctggcccccgagcaccgcctccccgcggccttcgacgacggggccgggttcatgcgctggctccgggaccagtcagcgatcggcggcgccggcgcctcggacgcctggctcgcggaggccgctgatttcggccgcgtgctcgtcaccggcgactcggcgggcgccacga

SEQ ID NO: 18817 - DNA, 385 bp, Zea mays
  Clone ID: LIB189-007-Q1-E1-C9
ttttagcttaattgcatgcatgcatcattagatatagtaacagtgatggatcgttacacgctgcagaagcatgcgcttagtcgttatttgcagacgataataagtagatcgatggagtagtgatcgagcaacacacacgtgacgacgtttgctcttatttacttacacgcacgcacgtgtacggcgctaggggccgtatatatatcgagttctgcatgcatatctcgatcgatgggatgattagtcgtttcagtcgcagtagtaggagtagccgtgcccgtgcccgtgcccgtgcggcaccctgtgctcctgctgcctgctctcgtagtgggcctccttctgctcgcggtgctcgtggtacgcgtagccgccggcgcccagcgcc

SEQ ID NO: 18818 - DNA, 435 bp, Zea mays
  unsure at all n locations
  Clone ID: LIB189-007-Q1-E1-D1
ggtctagaattaacgggccgagccacgcgtccacgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcaaggcatcgtgccgggggataanggtggacaagggccttgtcncgctcgccggctccaacaacg

SEQ ID NO: 18819 - DNA, 419 bp, Zea mays
  Clone ID: LIB189-007-Q1-E1-D2
gcgtcaaggcaaagggagtggcagtggcagtggcaatgacacatatgtcagactgcttgctgcaaacatgacaccgcgacaagcacagctaaagaaatatagagagaaaaagaaagaccggaactttgggaagaaggtgcggtaccagagcataaagaggctagccgaccagcggccacgggttcatggacagttcgtcaagcaagctgtgcaaaatcaggacggagctacagagagatgaccgacatcccccctcccctgtggctgtgctgctcactggcttcaactccctactgactccgactccacctctgctggcatgcatggttgccgctttggactcaaaacacttgacagttagacatgcggttgataattcttccgtctctcgtggtgtggactgatatggtcgacaacac

SEQ ID NO: 18820 - DNA, 433 bp, Zea mays
  Clone ID: LIB189-007-Q1-E1-D6
gaattcccgggccgacccacaacgtcagctgagaagaacctggatgttgtgttcctgaagctcgactgcaaccaggacaacaagccgcttgcgaaggagctgggcataaaggttgtgccaacgttcaagatcctcaagggtgggaaggtcgtgaaggaggtgaccggcgccaagatcgacgagctagcgcaagccatcgacacagtcaagtcagactgacaaagaaagcaggtgatgcaactagctagtgtagacgatgaatgaatgagtccccggccggccttttgtgggacagcaaggctgctagatacgtacgtacgtactcatcaacaattaatgatggatgatggcaatggcaaatatacagtcaatgattcatatatgcatgcatggactgctatgctagctagcagccctttgtaaatatagtgtt

SEQ ID NO: 18821 - DNA, 431 bp, Zea mays
  Clone ID: LIB189-007-Q1-E1-D7
ggtaatggtcaggaattcccgggccgacccacgcgtcagcccacgcgtccggcaatttgttatctgccatgcataactagactggatggtcatggctcaaactaacttactttttgcctacggctgaaacatttagacaggcagcttaccatataaatgtcacctcctaggtggctaccctgactaccttttcgcgggggggggggggtgactttttttttactgcaagatctaataaactactgtggcgtttaaatttgtatatttccagatgacattcatcctgcgcatgatgaacaataaatcaaggttgtcggtaagtgaaaatagagatcaagattcaacgaacacaacacagatcctgatgtttagtggaagtttgctgcctgtaatgtttctgtcaggcttattgggatgtggagctggaattt

SEQ ID NO: 18822 - DNA, 332 bp, Zea mays
  Clone ID: LIB189-007-Q1-E1-D8
aattcccggtccgacccacgcgtcagcaaacattgaaaccttaagtttgtcttccagtccatatcagctcaccagccaatcgtgctggtcaacatatctgccgtgttgcaatgcatgaatggtccgagcgcagcgaaggctgacgattgaccggaaggtacattacctaaaagcgatgtcacgggtagagatcgtttgattattatcatctgtatatccccatgcatggggtttcgttttgtgcgcgtaattctggcttgccagcgtatggttcactgtgggaacatatgtactaggatgacagtacgtgaaaattcagatcacgattcaac

SEQ ID NO: 18823 - DNA, 435 bp, Zea mays
  Clone ID: LIB189-007-Q1-E1-E3
gggccgagccacgcgtccacccaaacgtccggtcgcactggccgtcttcgccgtcctcgtagctctgccactgggcaaagcgcacgaggaggaggaggaaggggttgaactcgaagccagcaggaggcggtggccgtgctgcgaccagtgcggcatttgcaccaggtcgcagccgccgatatgcgagtgcagggacacgtcgacgaccggctgccacccggcttgcaaggcgtgcgccctgtccatctccgacggcctcttcgtgtgcaaggacaagatcgtcaacttctgcaagcgccgctgcacccgtcgtactgatgatgatgatgcgtgacttataatcacttaattaggcaaataaccttgccaataaataatttccgttcggagctccatttgcatctttctcaagatgcagacgacagggtttaaata

SEQ ID NO: 18824 - DNA, 354 bp, Zea mays
  Clone ID: LIB189-007-Q1-E1-E4
ttttgccggccaaaagaataaatgggaactaatgattgcaccaagtaagcctcacccaaaacaaacgtaccgagttggcataaattacactatctcattgaattgattgaacgcttccctaaccttccttcccctattcggtggggagaaggacgtaaatcaataatcatgttgttctgttgtgttcaaaaactttgtgacctttttgtgccgccatggcatccgggcattgggacgagtacttaggaagaggagaatgtgtgaataatatttttgttgaacgggtccgaaaggtgtgtcaagagattgtcgatggggccggcatgagttacggatgcttgcaccatgaagcca

SEQ ID NO: 18825 - DNA, 382 bp, Zea mays
  Clone ID: LIB189-007-Q1-E1-E5
gaattcccgggccgacccacgcgtcagggcggcgacatgcagaggctcctcgaggcccgcacgctgcggctcaagaagcttggcatcccctgcaagcataggaagttgattttgagttttgctcacaagtaccgtctcggtctctggaagcctcaagcagaacccaggaaagttgaataaaattggtttgttcttgaaagctagtctactgttggactgaggcttgtttgggacattttgaatatttccttttgtaatttaggagccacaaatctttgttctctgtctctggccatacttatttgcatccattgtgcaattttttctagaaaatttccaacttcgcgtggaataacaaaccgcaacaggtgcagccccctgt

SEQ ID NO: 18826 - DNA, 471 bp, Zea mays
  unsure at all n locations
  Clone ID: LIB189-007-Q1-E1-E6
aggtataggtcaggaagtcccgggccgacccacgcgtcaaagtgaaacaactggaagttgagatggggcaatctatggagatgggaaccattcacgcttcagattttctgagacgtttctgctcaactcttgggatgaacaatcaagctgttagggcagcccaggatgcagttaagcactcggaggagcttgatataaggaggagcccaatctcaattgcagccgctgtcatttatatgataacccaactctcagaggacaagaagccacttaaagatatatccttggctactggtgtggcagaaggcaccatcagaaattcttacaaggatctgtatccttatgcctcaaggctcatcccgaatacctacgccaaggaagaagacctgaagaatctctgcacaccttaggaagcttaccttttccccctttctgttantacataaatcggaattagatttgtcaaagagg

SEQ ID NO: 18827 - DNA, 438 bp, Zea mays
  Clone ID: LIB189-007-Q1-E1-E8
aattcccgggccgacccacgcgtcaggaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatc

SEQ ID NO: 18828 - DNA, 111 bp, Zea mays
  Clone ID: LIB189-007-Q1-E1-F1
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 18829 - DNA, 430 bp, Zea mays
  Clone ID: LIB189-007-Q1-E1-F11
ggtctagggattcccgggccgacccacgcgtccacccacgcgtccggagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtatcatcgccaggtccgggaccaaggagttcatggaagcccttgctgctggcgctgatgtgtctatgattgggcagttcggtgt

SEQ ID NO: 18830 - DNA, 429 bp, Zea mays
  Clone ID: LIB189-007-Q1-E1-F12
ccgggccgacccacgcgtcagcggacgcgtgggaaaagctcaatgagaggatagcaaagcttgctggtggtgttgctgtcattcaggtgggagcacaaacagaaactgaactaaaagagaagaagttaagagttgaggatgccctaaatgcaaccaaggctgctgttgaggaaggtattgttgttggtggaggatgcacccttttgcggcttgcagctaaagtcgatgccatcaaggatacactggagaacgatgagcagaaggttggagctgaaatagtaaggagggccctgagctacccacttaaattgattgctaaaaatgccggtgtcaatggcagcgtcgtcactgagaaggtcctttctaacgataacttcaagtatggttacaatgctgctactggacagtacgaggacttgatggctgctg

SEQ ID NO: 18831 - DNA, 371 bp, Zea mays
  Clone ID: LIB189-007-Q1-E1-F3
gggccgacccacgcgtccaccttgttgctcttggctccgcgatggcggtgggttgcttcaaccacgtgctctcgccgcttgttccttcgccgccgggtaggcgcgtccgagcggcgctgcggtgccggtggcatcgtcacccgctgaccgcggtctccctccggcggctcccgtgcggcgcggcagctggtcgtggcacgcggcggctcgcggcggcggcagagtcgcaggccgtgcaggagcagccggcgcgggccgaagaggccggcggggcgggtgccgctgaggcgtcctccaagctggttctggtcgttggcggaaccggcggcgtcgggcagttggttgtagcatcattgctgagcaggaacatc

SEQ ID NO: 18832 - DNA, 448 bp, Zea mays
  unsure at all n locations
  Clone ID: LIB189-007-Q1-E1-F4
gggccgagccacgcgtcaagcttgaagaagaccacaaggttgatcaatggggcttggtggaaggaggtcataactttgataccgcaaatcttaaagtgcaaatgtcctcggctgttgtatttcttggactttcacggggactgtgaaccatcctgtttcttacctatatgttggttagttgtttatttccaagcttgtatgaatctgagaccaagagtttgtagagaataattgccgcggaaggtcgatagcaaaccaagtatctgtactgtattcagcaatcagcagttctgatgttcgattttggattgagtccagaaaatgctgttgaggtttgaactanggaggccagcattcctctggctttgtactgttgtgagagtaagaacataactaggaactagtattgcagtggcagtcactgagtcgatatatctacttctgcacc

SEQ ID NO: 18833 - DNA, 416 bp, Zea mays
  Clone ID: LIB189-007-Q1-E1-F5
aggtaacggtcaggaattcccgggccgacccacgcgtcagcaaagatttgtgagagtgatccggcgctgagaagagatggctaagatcgccgcagccgccgcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcgtcggcggcccgttccggtggggcaccgggctccggatgcggtgctgccagcagctccaggacgtgagccgcgagtgccgctgcgccgccatccggagcatggtcaggggctacgaggaggccatgccgcctctggagaaaggctggtggc

SEQ ID NO: 18834 - DNA, 460 bp, Zea mays
  Clone ID: LIB189-007-Q1-E1-F6
gccaggtaatggtcaggaattcccgggccgacccacgcgtcagatttttagttgctgagagtgaagaggcacttgttaaaaggctaatccaccgtaaaacagaaacatcagatatgcttcttgtcagagtcgcaacagccagggaggaggtgaaacacatgaagaatttcgactatgtggttgtaaacgctcaagggaaacttgaggaggctgttaaacaagtggaatctatcattgatgctgagaagtctaaaattcacaagcggcatgtcaatatctaagccaaggatcatgtgatttatgcctattgtcttcatctctataaaggaaaattatctgtccaagtctactgaagcgtgatgaaatgactcaggtttcagtagccagaaagttcaatggattgctgagttacaagaatatggcatgttctgtttaagaaatttccctcaccacaaccggg

SEQ ID NO: 18835 - DNA, 415 bp, Zea mays
  Clone ID: LIB189-007-Q1-E1-F7
gtcaggaattcccgggccgacccacgcgtccagctcgtaaagagaaggaaaaatatccccaaaccctagctcgcgatctcgatggcgaaccctcgcgtcatcttcgacatgaccgtcggcggcgccccggcgggccggatcgtgatggagctgtacgccaacgaggtgcccaagaccgcggagaagttccgcgcgctgtgcacgggcgagaatggcgtgggcaagtccgggaagccgctccactacaagggctccaccttccaccgcgtcatccccgagttcatgtgccaaggcggagacttcacccgcggcaacggcaccggcggcgagtccatctacagcgagaagttccccgacgagacatgcgtgcgcaagcacaccgtccccggtgtgctctccatggccaacgccgggc

SEQ ID NO: 18836 - DNA, 457 bp, Zea mays
  Clone ID: LIB189-007-Q1-E1-F8
aggtaacggtcaggaattcccgggccgacccacgcgtcagcccacgcgtccgagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgatgccaagctcaaagtcaagtttctactcccgcccttcctccccatcgtccccgt

SEQ ID NO: 18837 - DNA, 365 bp, Zea mays
  Clone ID: LIB189-007-Q1-E1-F9
ggttacggtcaggaattcccgggccgacccacgcgtcagtgaaaggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 18838 - DNA, 437 bp, Zea mays
  Clone ID: LIB189-007-Q1-E1-G11
ggtaacggtcaggaattcccgggccgacccacgcgtcaggggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacct

SEQ ID NO: 18839 - DNA, 404 bp, Zea mays
  unsure at all n locations
  Clone ID: LIB189-007-Q1-E1-G2
ggccggtctagaataccgggccgacccacgcgtccacgtggatcggctgttgccaatggtggcggtggtgatggatggcataaccaaaaaacatgggctgagctgaaaaggcttctggaagggtacaaaggttgcacagacaataaaattggggatgtaccgaggattgtagtggatacaactgatccgacagttgatgcacaggtggtagctgaaaaggttgtggttttcattagatcccatcttgcttgtagccaaccatcttgtgggagacangattcacctgtttgccattagaaaccaaaatgtacactagcttaagcattangtgaagtttcattgcaaaaggttgatctgttgtactgcaatgctcaaagttttttttttgtttatgggtgtaacct

SEQ ID NO: 18840 - DNA, 440 bp, Zea mays
  unsure at all n locations
  Clone ID: LIB189-007-Q1-E1-G7
aggtaacggtcaggaattcccgggccgacccacgcgtccacctcgccccgccgcacccgaatgaaatccagaaatcatttcttcgttctaaattgaaagtctagaaataggtgtttatagattcatcgcgacacgatcttcaccagaaaaggttacaagagaaatgcagagatttattctatggagaaagcatcagggcattctgctttgcgtcacaaagtttcaaacccagcaaaacccccagtcgatatatcagataggatgattggtgataccaaaggaagcaaactcaaacacacaaagtttcagaagcacagctactgcttgctcnctcaggcgaccttgacctcgatggtcttgggcttcttgggctccggcggnggcagcttctcgacggtcaccgtgagcacgccgtcnctgcacacggtgtcgcatcgggc

SEQ ID NO: 18841 - DNA, 385 bp, Zea mays
  Clone ID: LIB189-007-Q1-E1-G9
ggttccggtcaggaattcccgggccgacccacgcgtccacccacgcgtccgcccacgcgtccgcccacgcgtccgcccacgcgtccgcttgatgagtatggaactaatgtaacaaaattagcacaggagggaaaattacatcctgttgttggaaggcagccacacagtgagcgtgtggtacacattttaggcagacgaaccaagaacagaccctgcttgattggcgagcctgacgttggaaaaactgcaattgctgaaggacttgctcagcgcatttctacaggcgatgtacctgatacagtacaagggaaaaaggtcataacccttgacatgggacttcttgttgctggcacaaagtaccctggagaattcgaagaacgcttaa

SEQ ID NO: 18842 - DNA, 366 bp, Zea mays
  Clone ID: LIB189-007-Q1-E1-H1
gggccgacccacgcgtccacccaagcgtccgggatgtgcatacagctgtgcatccaagttggagtcgacaccccaatggacccgcagcaagatctcctgctagatctcttgtactccatgctccagtcgcagcgacatgttcactgacatggcatgactcatgcgcccaatgattcgctgaaggttactcgcgacatgctttgccgcaagtttgggcctagcagatggtgatgcaacctcagactcaacatcatcttcatcagatcatactactgatactgatggaactactactggtgatctacctgcacatctgccttctccagagccgtgctctgatcatttagatgctcctttggcagattc

SEQ ID NO: 18843 - DNA, 444 bp, Zea mays
  Clone ID: LIB189-007-Q1-E1-H10
ccgggccgacccacgcgtcagcggacaaggagaaactcggccggaatgtgccgcaggtttcgtcggcgttgttcttcagctacaacacatcattggggccgccgtatcgggtgattgtggataccaacttcatcaatttctcgatacagaataagctggatttggagaagggaatgatggattgcctttatgcaaaatgtaccccatgtatcacggactgtgttatggctgagcttgaaaagctggggcagaagtatcgtgtggccttgagaattgccaaggaccctaggttccaaagattagcatgcacacacaagggaacctatgctgatgactgcattgtggagagggtcactcaggtaaaagctctctcttcttgaacactctttgtttgtttggagcatgagtactgggagtattctattaagtgctaactctatagcg

SEQ ID NO: 18844 - DNA, 431 bp, Zea mays
  Clone ID: LIB189-007-Q1-E1-H11
cccgggtcgacccaagcgtccggcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggaactc

SEQ ID NO: 18845 - DNA, 308 bp, Zea mays
  Clone ID: LIB189-007-Q1-E1-H4
gggccgacccacgcgtcaacaagtggtttccactgaaaatccaattcccccaatcccaaaccaagggcccttttgccaacccaaccgttctccttcgggacttgcaggaaggtttaacctgcttcggcgggcggctgggcctgaccatcgactcgggctggcaactgggaggcccccgccgagcgcgtggggcggttggtccgcgagagccccgtggtgatcttcgcctgacgcgggtgctgcatgtgccacgtgatgcggcagctgctggcggccgttggcgcgcaagcgacggtgatcgagctgga

SEQ ID NO: 18846 - DNA, 468 bp, Zea mays
  Clone ID: LIB189-007-Q1-E1-H5
gccgccaggtataggtcaggaattcccgggccgacccacgcgtccacccacgcgtccggctttatctactccagagcgcagaagaacccgatcgacaccatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccg

SEQ ID NO: 18847 - DNA, 404 bp, Zea mays
  Clone ID: LIB189-007-Q1-E1-H6
ttcccgggccgacccacgcgtcagcggacgcgtgggctcgtttcctttcgaaagcccgcgcacgcacgtcggtcgtcccgagcatgacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccatcgccgtcgcgatctccgaggaggagcgccacacgcagcagatgcagtccatcagtgcgtcgttggcgtctctgacgcgtgacagcgggccgaaagt

SEQ ID NO: 18848 - DNA, 347 bp, Zea mays
  Clone ID: LIB189-007-Q1-E1-H8
gacccaagcgtccgcaggtggtttccaaagccaactgtgtactagcagtctagcaaccagctacctcgggcggcagcatgcagccatcatgtctgacgacaagcaccaccacttcttcaaccaccacatgaaggacgacgagcagcccgccggcgagtacgggtactccgataccgaggtggtcatcgccaccggctagggcgagtacgagacgtacaagaaggacgagaaggagcacacgcacaatcagcacctcagcaaggccggcgccatcgccgccggcgccttcgcactctacgataagcacgaggctatcaaggaccccgagcacgcgcacaggcacaaga

SEQ ID NO: 18849 - DNA, 451 bp, Zea mays
  Clone ID: LIB189-007-Q1-E1-H9
gtcaggagttcccgggccgacccacgcgtccacccacgcgtccgggctgatgatcatttcagacaggagccagatggtgatgggagttctgctgtccagctatatgcaaaggaaacgagcacgatgatgttggaagttctgaaaaaaggcccaaggactactgcagaactggaggcacctgtagctgacacacctcttgtgtctgctgatactgtactagatatatctggtggcaagcgtgcttttattgagggcaatgaagcaaaggaactgctgagtccacttaccatcacaggaaattcatataaaacaatttgctttagcaacaggagctttggtattggtgctgctaatgttgctgggccaattcgtgagtcacttaacaatcagctcacagacgttgatatctcagattttgtggcacgaaggtctgaagatgacgcccttgatg

SEQ ID NO: 18850 - DNA, 441 bp, Zea mays
  unsure at all n locations
  Clone ID: LIB189-008-Q1-E1-A1
taccggtctagnattcacgggccgacccacgcgtccaaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactccg

SEQ ID NO: 18851 - DNA, 403 bp, Zea mays
  Clone ID: LIB189-008-Q1-E1-A10
ggtaccggtctagaattcacgggccgacccacgcgtccacccacgcgtccgcccacgcgtccggttctgcgtcagcacattcctgaatctgaagccaaggataagttcatatctaaatggaataatgtggctcataacagaaatattacttctggcttgaactcgtatggtttttatgcttatgactcggtttgggctgttgctcgtgctgtcgataaatttctcagtaatgggcaacagatcaacttctcaacagaccccaggttagaagattcaaatggcagcacgttgcacctatcaagtctcaagatatttgacggtggtgagcagatgctgcatcaacttctcctcacaaactttacgggtgtaacaggtccagtccagtttgattcagagcacaatt

SEQ ID NO: 18852 - DNA, 443 bp, Zea mays
  Clone ID: LIB189-008-Q1-E1-A12
ggtgccggtctagaatttacgggccgacgcacgcgtccaccatgacgctgaggagccactgatcaagcacgaggccgactgtgagggcacccaatctgctgctaagaagcctcgacgcaatataaacgtacacagcgcttaccttcatgtgcttggggactccatccagagcatcggggtgatgatcggcggggctatcatctggtacaagcccgagtggaaaatcatcgatctgatctgcaccctcatcttctcggtggtcgtgctgttcaccacgatcaggatgctgcgcaacatcctcgaggtcctgatggaaagcacgccccgtgagatcgacgccaccaggctggagagggggctctgcgagatggaaggcgtggttgccgtccacgagctgcatatctgggccatcacagtggggaaggtgctactggcttgccatg

SEQ ID NO: 18853 - DNA, 414 bp, Zea mays
  Clone ID: LIB189-008-Q1-E1-A2
ggtctagaatatccgggccggcccacgcgtccacccacgcgtccgggacaaaacgagcaagcagtcacatcaataggccaaaggtgacaaggcaatgcacaagagcagcgctgtcgattggtagaggcccgggaacagcgaagcacgagaaagaagggcagcacagaagccagctcatgaaaaatagaggttcagaaacagcaatccatgaggaggtagcagagcaacacagctcagtagaaacgagccgtgaggaagcaggattattccaagaacagacctcagatacaagtcacaaagaagaagaagaagaagaaggagaaggagaagaagaagaagaagaagaagaagaagaagaagaagaagaatgtactagtgaagtaggagcgggtaaacacagctcagtaggaacga

SEQ ID NO: 18854 - DNA, 248 bp, Zea mays
  Clone ID: LIB189-008-Q1-E1-A6
ggtacaggtccagaattcccggtctgacccacgcgtccgctcccgctgctggccgcgggccccgccgtcgtccgtggccgccgacagcgcgcccagctcctccagcttggacagtaggcccagccgctccatcgccgacagcgacagccccgcgcgctccgccgccgacagcaggcccgcgcgctccgccttggtcaccagccgcagcatcaccaggggcgtcagcaacgtaaagggagctatggaga

SEQ ID NO: 18855 - DNA, 327 bp, Zea mays
  Clone ID: LIB189-008-Q1-E1-A7
ccgggccgacccacgcgtcagaaaaaaaaaaaaaaaaaaaaaaaaaaaaaaaggggaaaaaacaaaaaagataaaaaattaaatatacataaaaaaaaaaataaaagggctcctatacaagtagatggggggctgatctcagggttcctgttttaacaaagcttttctgtgatgtcactgaccttcaattcattaacctccttttaatacattgccctttgtttaaaaccggcgttatcgaaaaaaccccgacttttatcactttcccctttttgcacaaattctccctttcaaaaggtgcgctctgtttcactgcgccaaaagttt

SEQ ID NO: 18856 - DNA, 414 bp, Zea mays
  Clone ID: LIB189-008-Q1-E1-A9
acccacgcgtcaacccacgcatccgcccacgcgtccgaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgattaaccaagtagctctgggaaacctt

SEQ ID NO: 18857 - DNA, 456 bp, Zea mays
  Clone ID: LIB189-008-Q1-E1-B10
cggtctacaattcacgggtcgacgcacgcgtccaattctagatatgaagctgcagctcttcgtgctctccgcaagttatggagcatgagaagttcactgaatctagtaagcaccacacttgatgtttttactggcaagtggattcagtattcatccggaattggtgctggtgttgattcattttatgagtatctgattaaagcatatattcttttcggaagtgatgagtactgggatatgtttcattcagcttatcttgcggtgcagaagtacttccgacatggtccatggtatcatgaggctgatatgaggactggagaagcaacgcactggcagctaactagccttcaggctttctggccaggtcttcagacacttcttggagacgttactgctgcaaatctatcacaccgtgagttttacaatatatggcaaagatttggtgtgctacctgaa

SEQ ID NO: 18858 - DNA, 449 bp, Zea mays
  unsure at all n locations
  Clone ID: LIB189-008-Q1-E1-B12
aattcacgggccgacgcacgcgtccaggaggagcctcttgcttcggcttcggcttgactcagctgcagcccgccgccgttaggctccggttgccgcctgctcgcgccgcggacacttcgtcctcccagtcgccggcgcgcctgacggcggtgctggagcaagtggaccagttgctaagccaggggaacgacatggccgcgctctccctcgtgcgcagtacgcangggggtgacggcgggctccgggcctttggcgccgccaggcaggtacctcaacgactttataaattggatgagcttaaactgaatgggattgatacttctgctttcctatcacccgtagatctgacactangatcaattgagagaaatctccanatcgctgcagttctgggagggctttctgtatcagctgcattggaactttctcaactccaaatcctgtttctc

SEQ ID NO: 18859 - DNA, 442 bp, Zea mays
  unsure at all n locations
  Clone ID: LIB189-008-Q1-E1-B5
attcccgggccgacccacgcgtcagcccacgcgtccgcccacgcgtccgcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtccttttttttccccagtcatgtaaaacttccaaactgctccatggttcaaaactctgttcntcaatacatcatcaat

SEQ ID NO: 18860 - DNA, 451 bp, Zea mays
  Clone ID: LIB189-008-Q1-E1-B7
aattcccgggccgacccacgcgtcagcccacgcgtccgcacaggttttctatagttgtccgcattttggcagtaaacttgcagacatgccatggcgtatgggtttagtgtttcgtcctgctccttcgattggggagttaagaagtgggtctccaagactagttgaactgaacgattttgtgcgtcaacgacacaacaaaggatttcttgatgttcttagttttagtgaggtagtaacattcgtactgccaagttccactgccacaatgctaagttatagtatatgctaattggttcctgacagacccaggtcacaccgattgttgaaggatatggcggttgggcacttcgtatggagatagtgccaattgaatctgcatacccaggctttggggagcttgtcgtaagtatttttcacaactcattgtaccattgggtagtgcacatggaat

SEQ ID NO: 18861 - DNA, 437 bp, Zea mays
  Clone ID: LIB189-008-Q1-E1-B8
ggtacaggtcaggaattcccgggccgacccacgcgtcagcttccacaaggcactctgatccagacagtgctggctcttccttttctattcttctgggcaattcaccgcatcttgatggccagtatgctgtatttgggagggtcactaaaggtgacgatacattgactaaactagagaggcttccaacccggagagaaggcatttttgtaatgccgatcgagcgtatcaacatcctatcaacttactattatgatattgatctagagagctgtgaagcagaaaaatctattctccggaggagactttctgaatcagcatcagaagttgagcgatggagaagaaaatgctttgcttaatggtggaataaggactgcatattccgtttcatgatgctggatggtttcctgaggttgaatatggacgacggtgtggacatg

SEQ ID NO: 18862 - DNA, 467 bp, Zea mays
  unsure at all n locations
  Clone ID: LIB189-008-Q1-E1-C1
ggtctagaatacccgggccgagccacgcgtccgactgcggatagagcagcagaggcagcgacacgatcgcgagcgcacgcacgtaagcacgttgtcggaagctcaagttagaagaagcaccagtgactgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagttgctggcctaccgcgangtgatcaacggccgctacgccatgctaggcgccgtgggcgccatcgccccgg

SEQ ID NO: 18863 - DNA, 437 bp, Zea mays
  unsure at all n locations
  Clone ID: LIB189-008-Q1-E1-C10
attcacgggtcgacgcacgcgtccataaatctgatggtgctctttctgcagaaatggtttatatgtttgcagaatggtacaaaccaggatgcttgcttgagtaccctctgggtggaactggagcaataatagatgcccttgtgagcggtattgaaaaatttggtggcagacttgctcttcgttctcatgttgaaaagatcttaatagagaatggtcgagcagttggtgtcaagctacaaagtggacaagttatccgtgcaaagaaagcggttgttagcaatgcatctatgtgggacactttggatctgttacacccgatgctgtcncaaaatcatatgaagatagagtgaaagcaactccacaatgtgaatcgtttatgcatctccaccttggttttgatgcanagaatgctanagaagaccttgggatccatcaca

SEQ ID NO: 18864 - DNA, 448 bp, Zea mays
  Clone ID: LIB189-008-Q1-E1-C11
gcggtctagaattcacgggccgacgcacgcgtccacccacgcgtccgcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaagcagctgtggttcgcgtccaagcagtccctctcctacctcgatggcacgctgcccggggactatggcttcgacccgctgggcctctccgacccggaaggcaccgggggcttcatcgagcccaagttgctggcctatggccaagtgattaacgggcgctacgccatgctgggcccggttgggcgccatcgc

SEQ ID NO: 18865 - DNA, 435 bp, Zea mays
  Clone ID: LIB189-008-Q1-E1-C2
ggtctagaatacccgggccgacccacgcgtccacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattaatatctatccaacttgtggtggtggttgaacaataataagcgaggccgagctggctgccatacataggtattgtgtggtgtg

SEQ ID NO: 18866 - DNA, 451 bp, Zea mays
  Clone ID: LIB189-008-Q1-E1-C3
gggccgagccacgcgtccacccacgcgtccgcccacgcgtccgcggacgcgtgggggccgctcgacccaccatcaccgtctggtccgccgagggagagtcctctggctcgctccccctgccccaggtcttcaccgctcccatccgattggatgttgttcagcaggtccacaagtcgatggccaagaacaagagacagccatacgccgtcgccgagaacgctggtcaccaaacctctgccgagtcttggggtactggacgagctgttgcccgtatcccccgtgtgtcgggtggtggtacacagcgatctggacaggctgccttcggtaacatgtgccgaggtggtcgaatgttcgccccaaccaagacttggagacgatggcacgtaaaggtcaaccagaaccacgaagagatacgccgtcgcctccgccattgccgcttcgggccctccat

SEQ ID NO: 18867 - DNA, 232 bp, Zea mays
  Clone ID: LIB189-008-Q1-E1-C4
cgcgtccactaaaaatccacaaaactcccagatcgttggggaggtcgacccagatcagcgtctggttcaccagggagagtcgtctggctcactccccctgccccaggtcttgacggctcccatcagattggatgttgttcagcaggtccactagtccgaggctaaccatgagagacagccatacgccttcggcgaaaaccctggtcaccaaacctctgcaggatcatggggt

SEQ ID NO: 18868 - DNA, 316 bp, Zea mays
  Clone ID: LIB189-008-Q1-E1-C5
aattcccgggccgacccacgcgtcaggccacgcatccggtcaagcatagggaagggtcttgtgtagtacgtctttgggttcctcctcctcgtcttgatgctcctggctaatgtctgtgcggatgtttccctgattctaacgtatatgcaccagtgtgttgaggattggaagtcatggtggaaatcaggcttcgcagcaggataggtggcaatctacactatcatgtaccccagcaacgatcttgtattcgacctcaagagcttgactgggcaactgtatgctagcctctacatcggtaacgcaatcgtcatggtga

SEQ ID NO: 18869 - DNA, 438 bp, Zea mays
  Clone ID: LIB189-008-Q1-E1-C6
ggtacaggtcaggaattcccgggccgacccacgcgtcagggtgcaccatgggcatcggcgccgcgatcatgctcaccaccctcggctccatgtgctactgcatcgtcgcgcacaggctggaggagaagaacaccaggaagatcaggagggcctccgcgagccagtcccgcggctcgtggtcccgatcggtcgactcggacgaggagatacttaacagcgagtacaagacgaagatgtacgcgctgtagcctgtaggatggatagcaagtgtaacatgacggattcttttgtacataccagtgctttgtttcgccagaggctgctccatggcattcggctcgggatgcagaggctgcggcaccacatcagtcttcaaccaaaggactgaaggcccttcctgtgaaaccaagttcaggtcacttgaccggtgtgcctgtt

SEQ ID NO: 18870 - DNA, 427 bp, Zea mays
  Clone ID: LIB189-008-Q1-E1-C8
aagtcccgggccgacccacgcgtcagggagagagacgaagagagcggaagcgaaagagcagcggcgcaaaggaaagggagccatgctcgcgtcgccggcgctcgccggcgcccactccttcgcggcgtccgtgtatggaagcctcctcgtcccctcgcctcccgtccccgcgccggcacgtcgcgcggcgctgtccgtcgtcgccaaggtcaaggtggccacgccccaggacgaccgcatcgcccgccacgtccgcctccgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaggaatttgaatactcggctgggccaacg

SEQ ID NO: 18871 - DNA, 414 bp, Zea mays
  Clone ID: LIB189-008-Q1-E1-C9
ggccgacgcacgcgtccggtggccaccaccacgaagatgcaggagcatgcgggcagcgacaagtcgtgtgtttggcacgctgctgactttgccgatggcgaacttaaggaggagatgtttgccatcaggtttggttcggtagaaaactgcaagaagttcaaggagttggttgaggagatagctgagtcgcttacaaagaacgagggcaaggaaaggtaagatggtggttccacggctggattgctggcgaaactcactgtgaaccaaggcaaatctgaaggaaattgcaagtccgagtccactgaatccggcaaagtgactgaaaccaaagccgacacagccccaactgagtagttggtgtggttgcacttgcacgcaaattcccctggtgctgaactagtttgtctgtccgcg

SEQ ID NO: 18872 - DNA, 267 bp, Zea mays
  Clone ID: LIB189-008-Q1-E1-D12
gacgcacgcgtccacccacgacgtccgcccacgcgtccgcccacgcgtccgcggacgcgtgggaaaaaaaattaaaaaaaataaaagaaaaaagttataaatataaaatgaattaaaggttaacccgcaaaaaggattaaagcttagttatacttgcaggcgaagtcaaaaatcataaaggggggtcccccaaaaggttcaaactttactttccctttaaagccgacgttaatgctcttcactcgggtcccctaatttcatttcctg

SEQ ID NO: 18873 - DNA, 435 bp, Zea mays
  Clone ID: LIB189-008-Q1-E1-D3
gggccggcccacgcgtccggacaatagcaatgaagcagaaagtaataacttagattgtgttgataaagtgactctacttgaaaataaggtgcagcttgagccagtaaaagacaatgttcctggtatctgcccactgttgcctcattcatcttctgatcctgagtttgaggggcctgctgatgctagattcgatgttaagactgcagtgaaggtgtactcgccggaggaatatgaacaacttaaatctgagaaggcaaatttggagggagaactagcaaagtgcaacaaaataatagaagaaacaatggctaggttaagtgatatggagaaaaaactggaagacctgacatctaagttggctgacagtgagaaatcaaatagctttaatgagacacagttgaagtgtatggctgaatcctacaagtcacttgaatc

SEQ ID NO: 18874 - DNA, 425 bp, Zea mays
  Clone ID: LIB189-008-Q1-E1-D4
gggccgagccacgcgtccacccaagcgtccgcccacgcgtccgcccacgcgtccgtcattactaggataatatcatgaatgattttggcgagtcacaaatatatattgagaacctatacttaccccatttgtgtacaacttcaatttgaactcaattattcatatgttgtattatgttttatcacaactaatgtttagttatatgcaacattactcttataaaaatagtctgtgtctatacaattataattatttatatttgacactaattgtgtaagataaatcactgaagggaacaaaaggccagagccacgtattcaagctgctaagtttgcatgagagggtggtattcacgttttgtaagttcttattccctgttttttctctgcaatttcttttttgtaagcctgcaactggtctttaaa

SEQ ID NO: 18875 - DNA, 454 bp, Zea mays
  Clone ID: LIB189-008-Q1-E1-D5
gaattcccgggccgacccacgcgtcagacgtggcaaggatgacattgtcaatgctggtatagctggttgttgtactggcctcgctttgggctttccaggggcgccacaggcattgctccaaagctgtgccaccttcgcagcattctcatgcatcatggaggggctcaataagcagcaggctgcaatggctcgcacgcttggagggactgccgcgatggccgtgcatgagaaatgtggtgttctgcccccgttcacgcttccacctattcttgatgcatctgatgctttagcttcatgctgcttagcgttagtaaagcctaagcactagactacacaatagagggcgtgagcgatggcgaagaagggtaacttcaatcttcggctctttattgtgttgaccccaggttatatgaattatgtttttggacaagatgtgtaacgtgcctaaattcca

SEQ ID NO: 18876 - DNA, 426 bp, Zea mays
  Clone ID: LIB189-008-Q1-E1-D6
cccgggccgacccacacgtcagctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggccgtggcggctacggcggtcggcgcgagggtggtggtggcggctacggcggcggcggcggcggctggagggactgatgtgtgggcccatcctggcttcggccgagtta

SEQ ID NO: 18877 - DNA, 468 bp, Zea mays
  Clone ID: LIB189-008-Q1-E1-D7
aggtataggtcaggaattcccgggccgacccacgcgtcaggttacaattcaacaatgattggcgttggcatgtgcatggagggaatagagcacaatccagttgtttatgaacttatgtctgaaatggcatttcataataagaaggttgaggttgagtgagatcgggattaattgaagttttctgccttgagttaaatgttgacctgtgcatcagagaaggattgtccaaaacaccaaacatttgtaatttgtgtagtttcttggtagacatgctttctgcgaccttgtttacatgaggattggctaaaaacatactcctgtaggagatatggtcaagcaaatgctgacatagagaaagcttggagatatttgtatcatacaatatacaattgcactgatgggattgcggaccataataaagactatatagttgaatttccagacataagtcccagctcagttacttat

SEQ ID NO: 18878 - DNA, 401 bp, Zea mays
  Clone ID: LIB189-008-Q1-E1-D8
ttcccgggccgacccacgcgtcagggcctccccgggcaggcgctcttcgccgggcagcccacatggatcgcctctggcctctcctccgcgccgtgcgagcgcgcgcgtcaggcctacaacttcggcctccgcaccatggtatgcttccccgtcggcaccggggtgctcgagctcggctccaccgacgtcgtgttcaagaccgccgagagcatggctaagatccgctcgctctttgggggcggagcagggggtggctcgtggccgcccgtgcagcctcaggcgccgtcgtcgcagcagcccgccgccggagccgaccacgcggagacggacccgtccatgctatggctcgccgacgcgccggtcatggacatcaaggattccttgtcgcacccgtcggccga

SEQ ID NO: 18879 - DNA, 458 bp, Zea mays
  Clone ID: LIB189-008-Q1-E1-D9
gtgcggtctagaattcacgggccgacgcacgcgtccaccacggcggtggcgccttctccggcaaggaccccaccaaggtggaccgcagcggcgcctacgtggccaggcaggccgccaagagcatcgtggccagcggcctcgcccgccgctgcctcgtgcaggtgtcgtacgccatcggcgtgccggagcccctgtccgtgttcgtcaactcgtacggcaccggcacgatccccgacaaggagatcctcaagatcgttaaggaaaacttcgacttcagggccgggattattagcatcaaactcgacctgaaaaaaggccgcaacaagttcaacaagaacgccgcctaagggcacttcggccgttacgaagccgacttcacctgggaggtggtgaagcccctcaagttcgacaaggcatcggctttaagttgggagtgtcactgtggacatgaggactac

SEQ ID NO: 18880 - DNA, 443 bp, Zea mays
  unsure at all n locations
  Clone ID: LIB189-008-Q1-E1-E1
ggtctagaatacacgggccgagccacgcgtccagccagagaacagggaggtagagaggaggaggaggtagaaggcgaaagaaggggaaccaaatcttggacgggaacacatagatttctttggtggaggaaggaggagggcaacaagaggaggttacaggtagcccaatagatctactgctgttgagggagttgatgcaaagctgagttgctgcgcgttggctttctttagagatggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataatttgtcacactactggtggcaagaatggtcaaccanaacagacagtg

SEQ ID NO: 18881 - DNA, 206 bp, Zea mays
  Clone ID: LIB189-008-Q1-E1-E10
gacgcacgcgtccatttttatttttttttttttttttttttttttttatattgtgttattttcatatgaatacttttgggatcttatttttatttggaatttttttaataacattccaatttcgagaggaggttctaaaggttccaaacttacgttagcgtacatgcgaatttatagttcttcaatagtgtcaccaaaattcaatt

SEQ ID NO: 18882 - DNA, 446 bp, Zea mays
  Clone ID: LIB189-008-Q1-E1-E11
cggtctagaattcacgggccgacccacgcgtccacccacgcgtccgccccccacatcatgcagtgcaggtcctgctggtgaggacatgtttcattggcaagcaacaattatgggaccacctgacagtccctatgctggtggtgttttcttagtgaacattcatttcccgccagattaccccttcaaacctccaaaggtttctttcaagacaaaggtcttccatcctaatatcaacagcaatggaagtatatgccttgacattctcaaagagcagtggagccctgccttgacaatttccaaaggcctgctctccatctgctccctgctgaccgaccccaacccggacgaacctcttgtcccggagattgcccacatgtacaagacgggacggccgaagtacgagtcgacggcccgcagctggacgcagaagtacgcgatgggctgac

SEQ ID NO: 18883 - DNA, 387 bp, Zea mays
  Clone ID: LIB189-008-Q1-E1-E2
gggtcggcccacgcgtccgcccacgcgtccgcccacgcgtccgtccgcggcgccgcagacatgcgcccgcttatccgaaccgctcgctgctggctcctccgcgcgcgtgttcgcgccatggccacgcttcctatggcgtcccccgccgccgccatcccctcctccgccacccgccccgtcgcctccccttcttcgcgttctcaccgccccctcaaccgcttcttctccgtcgcgccggcgccggtcggggcgaaagggctccgagcggcggcctccgccgttgaagttggcggcgtaaagatcgcgcgcgaggatgttgtgaaagaagatgacccatcaaacaacgtgccagacactatctttgcgaagattggcctgcagctgcac

SEQ ID NO: 18884 - DNA, 325 bp, Zea mays
  unsure at all n locations
  Clone ID: LIB189-008-Q1-E1-E3
cacgcgtcaaacgcaacagagtttgacacagccagttggttaatccattggcagtggctaacccattggtcgctaccttcctgcagcagcaacaacaattgctgccatacaaccagttctctttgatgaaccctgccttgcagcaacccatcgttggaggtgccatcttttagattacatatgagatgtactcgacaatggtgccctcataccgacatgtgtttcctagaaataatcaatatattgatttagatttatctcgatatatttctgaactatgttcatcatatatataattganaacatcanatcataattttaaaaa

SEQ ID NO: 18885 - DNA, 461 bp, Zea mays
  unsure at all n locations
  Clone ID: LIB189-008-Q1-E1-E7
aggtataggtcaggaattcccgggccgacccacgcgtcaggattgacagaggttctttgctcttgcgacgacaatggagaaattctcttctggacagttggtcagactacatctactcatgttttgcgggtgaagcagggtggaactggaagagtcaggtttgaacctcgaagtgggcagctcctcgctgtggcagctggaagcatggtgaacatttttgatgttgaaaagcaatccagcttaccctgccctccaaagggtcacaatagtgaggtaaactttgtgtcctgngatgaaaatggtgaatatctggcatctgtaagtcaggacactgtgaaagtgtggtcggtatcgtctggtgtgtgcattcatgagttacgatccaatggaaaccaatatcagtcatgcacattccatcctagatacccgaaagtgttgattgttggtggttatcagactct

SEQ ID NO: 18886 - DNA, 450 bp, Zea mays
  Clone ID: LIB189-008-Q1-E1-E9
cggtcaggaattcaccgggccgacccacgcgtccagcacaggctgtcacaaagcttgaatttgaattcgagaggcggagagttacaaaggaagacataagggagcttatatatatagggaaattcttgagtatcatccaaagatgctgagggagtttcttgagggaactgagtcaagtggtttcatgtacccaagtgcagtagatcattttaaaaagcagtttgcataccttgaagaacattatgccaagggatctacaggaactccacctgagaggcaacataattcattgccgccggcgtccgttgtccaatccgacaaccgattacaaaccaaagccaacatcaccgaagatctttccaagtgtatgctcagagaaaatacacagaagacacatccatattctgcttctgttgcaagtaaattttcaccacatgttcctcaaagtga

SEQ ID NO: 18887 - DNA, 435 bp, Zea mays
  Clone ID: LIB189-008-Q1-E1-F10
aattcacgggccgacgcacgcgtccaggaaccttatgtgttcttctggcagacatcgcctctattggtggacatctctaaattagcttaaggcgatacatgttatgtccactagagaaacaacatcctgagacactcacctttatttggaaatgtctcgcgattatcgctgatgtggacatgtgttacatgcttctctactcttaaaagtcttttgctccgaatctcgagacgagattattttaaggggggagggctgtaacaccccaggtgtttatattctgctcgacaacgagtatggaattaagcacgttatatcagtgaatgaaacagatactaaaatttaatcattttcgctatcgcgatttttatatcgtatctgttccatctgtcgtgagtgtgacatcatttttattcgtccgggctcttcctgaat

SEQ ID NO: 18888 - DNA, 406 bp, Zea mays
  Clone ID: LIB189-008-Q1-E1-F12
ggccgacgcacgcgtccatacgtcaacaagaggatgaaggaagaattccccgaattcgtggagaaacgggagaaggaggggctggtatatacaagggttctgggggagggcgatgacccgtcttcgccaatcggccgtggatggcagtcgacatttctcactaaagataaagccgttgctgaggaaagggccgccaagctcgggatgaagctggaatggaccggcgacggcgtgaggacggtcatggggcccatcccggcggtgaagtgggacgagagccgggggcggaaggtctggttcaacagcatggtggccgcctacacggggtggaaggacgcccggaacgacccggtgaaggcggtgaccttcggcgacggctcgcccctgcccgccgacgtcgtcgccg

SEQ ID NO: 18889 - DNA, 324 bp, Zea mays
  Clone ID: LIB189-008-Q1-E1-F2
gggccgacccacgcgtcaacgcgactggtgaccggattgaggtgaacccaatcggtcatgcactgggggtgccagtctatcaaatacagaagtttggggtgccccccaagcggggtactgcggcatcccatatggatatggtggcatgccccacatttgattttggacatatggtggtggcgggtatgcataatgatacggcatataatggatatggtggtggaggtgtccatgatgttggtggtggtggtgtgaccagtgatctttgatgtcataatgtgatatactctacttccagctgcacctgtgattttttttcaggac

SEQ ID NO: 18890 - DNA, 448 bp, Zea mays
  Clone ID: LIB189-008-Q1-E1-F3
ggtctagaattaccgggccgacccacgcgtccaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctagtttttgttgtttttgatgtggaaacagtctttctctacccttgggcaatgagtttcgacgtattgggtgtatccgtttttatcgaagctttcatttttgtgc

SEQ ID NO: 18891 - DNA, 450 bp, Zea mays
  Clone ID: LIB189-008-Q1-E1-F6
cccgggccgacccacgcgtcagcggacgcgtgggcggacgcgtggggtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggggtctacatgtacttcgaagataatgctggagtgattgtgaatcccaagggtgagatgaaaggttccgctatcactggacctatcggcaaggagtgtgctgatctttggcctaggattgctagcgcag

SEQ ID NO: 18892 - DNA, 429 bp, Zea mays
  Clone ID: LIB189-008-Q1-E1-F8
ttcccgggccgacccacgcgtcagcgccgagtgctccggcgggaaaaagttcttcgccggcgacgcgcccgggtacctggacgtcgcgctgggaggcttcatcggctggctgcgcgcctgggacaaggtggggggcgtcaagctgctggacgccggccgggtcccgcgcctggccacgtgggcggagcgcttcgccgcgctcgacgtagccaaggaggtcatcccggaccccgaccacatcgccgagtttgccaaggtgctgcaggcacgctccgcggcagctgccaccagcaactgagctcgcaagtgaatgctgctgctctgccttcctgataaaatcatatcatggtacccggtttgttcgtttaatctggcgcggaaaaaacatggtttgttgtcgtaccaaactaagagtatgcatgcatgctt

SEQ ID NO: 18893 - DNA, 456 bp, Zea mays
  unsure at all n locations
  Clone ID: LIB189-008-Q1-E1-F9
cggtctaaaattcacgggccgacgcacgcgtccacccacgcgtccgcccacgcgtccgcccacgcgtccggtgtgctgctgaccctcgtcatggccgctacctcacggcatctgctatgttccgtgggaagatgagcaccaaggaagtggatgaacagatgctgaacgtgcagaacaagaactcttcctacttcgtggagtggatccccaacaacgtgaagtcgagtgtgtgtgacattccaccaattggcctgaagatgtcctccacattcgttggcaactcaacctccatccaagagatgttcccccgccgtcagccaacagttcacgggcatgttcaggaagaaggctttcttgcactggtacacaagccaaggtatggatgaaatggagttcaccgaggcananagtaacatgaacgacctggtggccgagtatcagcagtaccaggatgcc

SEQ ID NO: 18894 - DNA, 408 bp, Zea mays
  Clone ID: LIB189-008-Q1-E1-G1
gggccgagccacgcgtccacagaatatagctatttgaagaaaaatttccgggatttattcatccgtgaaggttaccagcttgattacgtatttgattggactgtgtcaaggcaagctgtggacaataacagattgcgactgagcgggaagacaggtggcttggtgggaccatctgtggatagggctgaacgagctgcagcaagacaagatgttccagatagattcactggtcaagctggtgcttttgctagaagaaccggctctggttctggtcaatacggagaacacacaaagcacaggactctgttggattcacttatggcatccaagatggctgttgattcagataaaagaaagcattcatcatctcggaatggaagcacatcaaggaaggctcttctgtcaagc

SEQ ID NO: 18895 - DNA, 452 bp, Zea mays
  unsure at all n locations
  Clone ID: LIB189-008-Q1-E1-G11
acggtctagaattcacgggccgacgcacgcgtccaagaccaacaagcaacatagaaagtggaatccagtagcaacaatagagcaacaatggcgaacaagataatttcccctccttaaggcccttggctctttccgcaagtgttggcaaagcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattgggaaaaaccatcaaggcaaaagcagctggaacaactcgtgctacctgtgattcaacaagtagctctggcaanactttctccctactctcagcancaacaatttcttca

SEQ ID NO: 18896 - DNA, 418 bp, Zea mays
  unsure at all n locations
  Clone ID: LIB189-008-Q1-E1-G12
attcacgggccgacgcacgcgtccacccacgcgtccgcggacgcgtgggactaagttgggccaataataccaggcccaaaggcctaggaggaaaaagataagggtgcccgtttctctcctcgacgacgacattctcaactctgaaacggcgatgtcacggctactcccgcccgtgctctctcctttaccggcgttctcgctgccgccgccgcttcttcctcgcatccacatccgcacgtcggcggtgagaggcggtgcggcggagaacgcgatggcgtccgggacgacggcgagggagcggcgcctggtcaaggtgcgggaggagcgccgccgccgcgagtacgaccgggagcacacctaccccggatgggccaaagtactggagaacgcctgcagggatgatgangagctccgcgcc

SEQ ID NO: 18897 - DNA, 410 bp, Zea mays
  Clone ID: LIB189-008-Q1-E1-G3
gggccgacccacgcgtccacagaagactacccttcatgagaaacagcagcgggctgccattgtcgtcttcaatagtaggtctgccgcagctttcgcatctaagactctccatgctcaagtgtatgataaatggacagttatggaagctcctgaacaacgccagataatatggtccaaccttccaaggaaactatatgataggcaaatcagacaatgtgtggtttatggcattgtctttctcatagttgtgttctatatagttcctctcactgctatcgctgctgttacaaccctggaaaacctggaggcgaagctgcccttcctgaagccagtggtggagcaaccagcaatcaagacggtcttggagggctaccttccccagattgcactcaatgtgttcctcgcattgc

SEQ ID NO: 18898 - DNA, 423 bp, Zea mays
  Clone ID: LIB189-008-Q1-E1-G4
acgcgtccgaagaatgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattgttcacgtgggcccacttccaattattagtagatgaaaaattgataggaggtgaaaagtaggtatagaaaatgatattttatggttgtagtggggtataggggaaggatttagggggaaacgctgtacagagtggagatataggggggaagagaacgctgacgttgcaccttaattggaatttaggaaaagacatttgggcgtaaccgctgaagacagtctaaaggctcatctgtgtgta

SEQ ID NO: 18899 - DNA, 416 bp, Zea mays
  Clone ID: LIB189-008-Q1-E1-G5
aggtacaggtcaggaagtcccgggccgacccacgcgtcagggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggggaaccagtgccccgacat

SEQ ID NO: 18900 - DNA, 390 bp, Zea mays
  Clone ID: LIB189-008-Q1-E1-G6
gacccacacgtcaggttacaccgctggcgacttgaaactgcaaatgatgtggtatttttatttgcatcaaagctcaagatttcagagtaggaaagagtggtgtttcagaaacaacagaatacgttgctgttaaaagtgacgctggaacggtttgctgcacttactgtttgtgtgtaaaaatagtgaagttagtggaatgaatgatcctggccagtttctcttaatgaatgattctggccggtttatgttaagaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaagggggggccgcccaaaaggttccaagcttacttacgcgt

SEQ ID NO: 18901 - DNA, 425 bp, Zea mays
  Clone ID: LIB189-008-Q1-E1-G7
ggtacaggtcaggaattcccgggccgacccacgcgtcaggagtcttgatgatctcattcttgacataccatctgcaaagtctgaatttcagttgttggtatcaaaagccatttctgagggatggttagattcttcctatgtgaactcaggtgtcaacggaagcgttgaagacgatgaacatgagaagctggctaggtacaagagggaggctgtatccataatacacgaatactttttctctgatgatacaacagaggtcatccgtagtgtcaaagagcttggttatccggaatacaatccgatcttcgtcaagaagctcataacaattgctatggaccgcaagaacagggagaaagaaatggcatcggttcttctcccttcattaagcatggagctgttctcgtctgaagacatcgccaaaggga

SEQ ID NO: 18902 - DNA, 352 bp, Zea mays
  Clone ID: LIB189-008-Q1-E1-G9
ggtaccggtctagaattcacgggccgacccacgcgtccactattcttgatgcatctgatgctttagcttcatgctgcttagcgttagtaaagcctaagcactagactacacaatagagggcgtgagcgatggcgaagaagggtaacttcaatcttcggctctttattgtgttgaccccaggttatatgaattatgtttttggacaagatgtgtaacgtgcctaaattccagggttttttttggcttcatcggaccaggtttcccttgatgggttaacgttgcagcatgcccttgcggattccgctgggtctagcatatttgtatgggataaaagatcataaatatttgcctg

SEQ ID NO: 18903 - DNA, 450 bp, Zea mays
  Clone ID: LIB189-008-Q1-E1-H1
cgggccgacccacgcgtccacccacagcgtccgcagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaagtgcttgtctgaggctgcctcctcgttggcaaccgggattgcctgctgctggt

SEQ ID NO: 18904 - DNA, 134 bp, Zea mays
  Clone ID: LIB189-008-Q1-E1-H3
ttttattgttcatatgttttcttatatggtgtttttgatatatattattttctacttgcctctatattatattttttacaaagaatcaaaatttaacgggaaaatgtttgtcaatacttcactagaaaatttta

SEQ ID NO: 18905 - DNA, 405 bp, Zea mays
  Clone ID: LIB189-008-Q1-E1-H5
cccgggccgacccacgcgtcagagagcagcaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgcc

SEQ ID NO: 18906 - DNA, 421 bp, Zea mays
  Clone ID: LIB189-008-Q1-E1-H7
acccacacgtcaggcagtttgttgcgcggtctgccccagccctgacccccggagatccggggctgttctcggttctttacgcggaggcggaggttggtttctgatctggggatcggttcgtgcggggatgaatacgaggccggtggtgctcgtcttcctcctgctcgtgctcgtcatcacgtcgcagttcgagtggaagcagcagatcggggaggccgcggacgccgacccggccgctgcccgccgccggcagcagctgcacgccagggaggatgccgtcaaggaaaagatcatattatcacaggagaaaaatatccaacagcttaaccagcttatcgagagccttcagcgccagctactgcactgccgtggtagcaataacactgttcatgctgctgccgccgtttgcaacagaagcgag

SEQ ID NO: 18907 - DNA, 293 bp, Zea mays
  Clone ID: LIB189-008-Q1-E1-H9
cggtctagaattcacgggtcgacgcacgcgtccacggtccacagctgcatcgagtggctggacgcgcagcggaccacgtcagtgctgtacgtgagcttctggagcctgtcggccatggactcctaccgagctccgggaggtggaatggggtctggctgagtgcggccaccccttcctatgggtcgtccggcgaaacatggtacgaggctgcgacgtctacaccgcacggcacctcccggatggtttccaggaccccgtcaagggcataggcgtggtggtccgctgggccccgc

SEQ ID NO: 18908 - DNA, 423 bp, Zea mays
  Clone ID: LIB189-009-Q1-E1-A1
taccggtctagaattcacgggccgacccacgcgtccaatgacaacggagcttgtcttaaaagacaccttgtctgcaacggaatgaatgactgcacggatggtaccgatgaaaaaatgtgtgaaaactgggagtgcaattttgatgaattgaaatgcccgtcttccaaccaatgtattccgatcgtctggaaatgcgatggaaccaaacaatgcaccaatggaacagacgaagaaaactgttcagaaacatgcccgaaccctgatgatttcttctgcccaggagggccttgcataatcagcacaaaacgctgtgacggtgtaaacgactgctcgaacggaaaagacgaagccgattgtaaagatacgtaagactgcgacgattccctttaggtcgttaccgctttgttttttaaaaacattttt

SEQ ID NO: 18909 - DNA, 354 bp, Zea mays
  Clone ID: LIB189-009-Q1-E1-A12
acgcgtccaccacacctccggctgggcaagggaaatatcaaacatgccaaaaataccgtacgggctgggaagcctaatttcaacctttccagtggctcaaatcctggtgttaatccgaccattgaacacaatggcctaaaactggttaaaaaaagggaaaattctggtaggaaatggtcaacaaggggcaagaatccttgggtccaaaaattggatggaccaacaatggtaaaaaaaccccagtttaaccaggaccatataaccattggatttaattggaaccaaaaccggcaaaatttgggccccaaatccaaaaaatgaaccattcaaccctaaaggttaatgggagcaaat

SEQ ID NO: 18910 - DNA, 431 bp, Zea mays
  unsure at all n locations
  Clone ID: LIB189-009-Q1-E1-A2
acgcgtccgcccacgcgtccgaacacgtctggccccaggattatgaaccctaacgccccagagtttgttccaggtcaatctcggagtcctaatgggcatccagcatctccaaatggtcctttagcatctccaggtggtattccatcttcaccacaggaccttctatcctctccagatagtaccttggagtcaccagtaactgcatccccacaagtttctgaatgtagccagattagtcctgaaggagatgttgagggtgtgggtgtaaagcagaacatggatgacacgaaccacccagaaagtaaagatggtgaagtggagcctgagcaaaccaaagctcctgaaggtacagaagaaggcgcagcggtaaaagatgctgctgaagagttgattgcagccgagcagcccaaatcctgngctgactacagcga

SEQ ID NO: 18911 - DNA, 452 bp, Zea mays
  Clone ID: LIB189-009-Q1-E1-A4
cgggtcgagccacgcgtccgcccacgcgtccgcccacgcgtccgcccacgcgtccggactccagctcggagcagatagagcacctagctagttagtcgcaactcgcaacgcaagagtgtgtgactagtgagaaccgactaccgagtgaacgatcatggcggcgtctctgcaaggcctatacaatgggggcagcggcttgggcgggagggtcgtccacgccaggagcggcggtcgccggtcagctgcggcggtgaagcggctgctgtcgaggttgaggcgctcttggagaagacgcacggcgcggccgaggcgaaccgcggtgaggttcgggtatgacctgcatagctactaacagaacttcgacgacggcactgccttccgcgcccaccaccgcttgtagctcattgactcattgtaccggaaccctcacttgtagaaaaataactgaaagc

SEQ ID NO: 18912 - DNA, 463 bp, Zea mays
  Clone ID: LIB189-009-Q1-E1-A7
tcccgggtcgacccacacgtccacccacgcgtccggagaccagcaagcaacatagaaagtggaatccagtagcatcactagagcaacaatggcgaccatgatattttccctccttatgctccttgctctttctgcatgtgttgctaacgcgacaattttccgtcaatgctcataagctcctatagcttcccttcttcccgcataccttccatcaatgatagcttcagtatgtgaaatcccagctcttcagtcctataggctccaacatgcaatcgctagaagcaacatatctttatcacccttgtttcaacaatcgctagccctatctttggtgcagtcattggtagaaaccatcatggcacagcagctgcagcaactcgtgctacctgtgatcaaccaagtagctctggcaaaccgttctccctactctcagcaacaagaatttcatccaatcaaccaactg

SEQ ID NO: 18913 - DNA, 459 bp, Zea mays
  Clone ID: LIB189-009-Q1-E1-A8
attcccgggtcgacccacgcatccacattcattcattgaaagtatcagaaggctggttgatgatcatgtagagaagataaaagcattcccaatggaaacaactataccattccgagagcggctgaagatacttggccgggtggctaatctggaggatcttcctttgagtgcaccggagaggaagctaatgcatgcctataatgagaagcctgtcctttctagaccacagcatgagttttacctgagtgataactacttcgagatcgacattgacatgcacagatttagctacatctcaaggaaaggttttgaaacatttttggacaggctaaaagcatgcgttttagatgttgggctgacaattcagggaaataaagctgaagagctgcccgagcagatcttatgctgtgttaggttaaatgggatagattacaccaaatatcagcctcttttgactca

SEQ ID NO: 18914 - DNA, 412 bp, Zea mays
  Clone ID: LIB189-009-Q1-E1-A9
tacggtctagaattcccgggccgacccacgcgtccacccacgcgtccgcccacgcgtccgcccacgcgtccgcccacgcgtccgagcggagcggaggaggagagactgatccacacgcaaagggcatcgacagagaccgagcccaataataaatcttgctggatacatacaggaaacagcgcgagggaacgagaagttagtttccatggagaagaagcagaagaagcacgcacacgcgaggtcaaggagcttcaccggcggcgggctggcctccttcctcaggtccaccgtctcctccttctcctccgccttcccgcccagcggcaggaggtcctccttcaaccaccgcaacgccttctcgggccccatcgtcgtctccatcgtcccgccggaggctcgcggcggcggcggc

SEQ ID NO: 18915 - DNA, 379 bp, Zea mays
  Clone ID: LIB189-009-Q1-E1-B10
attaccgggccgacccacgcgtccacactacaccacaccacacacacccgacgacgatcacacacacgtagaagatcgagttcgttcgatcgtgaccgtgacgcaggaagctataagctagccaagacaggaataataatggcggcgtccacggtggcgagcctctctgtcccggtgacgacgacgaccttcgcggcggcgggcggcgccgacgtgctgatcgtcgtcccgaggagggcgggcgccgggcgcgtcgtctggttccccgcggcggcgcgccgcggcggcggcagcgggcggttggtcgccgtgcggtccagcgggccggccacgccgccggagatctccgacaaggtgtctgatagcatcaagcaggcgg

SEQ ID NO: 18916 - DNA, 246 bp, Zea mays
  Clone ID: LIB189-009-Q1-E1-B11
acgcgtccatgatcggacgaccacgaactcgctactgaccgtcggggattctcgggctcttggctcacgcagttctgctccacacgcgcaacccaatgggatatgcatgcacctggcagtttactcactgctgtctactctgtagccaagaacttccgacacaggcgcccagctgtatctgtcgaccgttcacctggtcgatgagcggaagatctaccattcccaatctcaagatgcatgcagtct

SEQ ID NO: 18917 - DNA, 410 bp, Zea mays
  Clone ID: LIB189-009-Q1-E1-B12
ggtctaaaattcacgggccgacccacgcgtccaacgtaactttcatcaactcacacatcaaacattatgcctcgcaacggagatggttcgggcaacaagggccccaattgagggtcacaacctacttcagggggcttcaggcgataaaacgctgcaacacaccaagcatgtagcacctatgcccgagcaggaagcacgagatgcccttcccggcatgggcgccggcggtgccgcagcacccatcgccgacgacgcggaacaattcggcgtcaacgagcccaagaaagaccccactgaagaagaggacgaagaacccatcccagaccatctgaagaccgacacctcgtccaagatctccaagaagcgggaccaaccggaccactcagctacctcccccgagcgctctcacc

SEQ ID NO: 18918 - DNA, 412 bp, Zea mays
  Clone ID: LIB189-009-Q1-E1-B4
cgggtcgagccacgcgtccgaccaagcgtccgcccacgcgtcggcacacgcgtcggccacgcgtcagccacgcgtccgatgaggatgcactggagccaccaaggaagcggcggcaaggggttcgggtcgattcccggcggactacgtctcgctcggcgtcagggaacccgtctacgaagtgatagaagtgagatcaaatgggaggatgtccaccatgaaaataaccatgcggcagctactgaaatctagtggtctccgcctacgagatactagaagtgttgacccatcactatggttaatgaattcaatgccttccctgctggtacgtgagcaagctattttactcaatcgtggttcgttgcgagcaattgctatgtatgcgcgtgttcttatattcagctataacagccca

SEQ ID NO: 18919 - DNA, 473 bp, Zea mays
  Clone ID: LIB189-009-Q1-E1-B8
attcccggtccgacccacgcgtccactcatctaaccccattgaaaaatgaaattggattttcgggagaattttggaataaaagataaataaagaattgaatttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttcttcaaaatgggggggggaaaaattttttttaaaaagggggggttccccccccttttggggaaaaattttacccccggggtcccccaggggaaaaagggggaaaaaaaaatttcccaaaccccccggggggccccccaaaaaggggaaaacccccaaaaaaaaaatttttttaaaaaattttaaaacttttttttccccccaaaaaaggggggccaaaatttt

SEQ ID NO: 18920 - DNA, 415 bp, Zea mays
  Clone ID: LIB189-009-Q1-E1-B9
gggccgacgcacgcgtccatctctacctctacctaccggagcagggagcacgccacacgagccctttccgccgccgccaaaatggtgaacgttcctaagaccaagaagacctactgcaagaacaacgagtgcaagaagcacactctccacaaggttactcagtacaagaagggtaaggatatcctgtctgcccagggaaagcgccgttatgaccgcaagcattcaggatattgtggccagaccaagcctgtcttccacaagaatgccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcgcccat

SEQ ID NO: 18921 - DNA, 410 bp, Zea mays
  unsure at all n locations
  Clone ID: LIB189-009-Q1-E1-C1
gggccgacccacgcgtccacaaccatctccaacgcagcaagcagacacagggacaggcaggcagcgagtgcaaccgcgagagcgatcagcgatgggctccttcttctcgaccttagtgacgccccctccgcccgccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaggacatggaaggtanaggcgatgccaacgttcgtgctggtcaaggatggga

SEQ ID NO: 18922 - DNA, 422 bp, Zea mays
  Clone ID: LIB189-009-Q1-E1-C10
gggccgagccacgcgtccaaaaatatccccaaaccctagctcccgatctcgatggcgaaccctcgcgtctccttcaacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgt

SEQ ID NO: 18923 - DNA, 407 bp, Zea mays
  Clone ID: LIB189-009-Q1-E1-C11
ggtctaaaattaccgggccgacccacgcgtccaatcgacggtgccctcgtcgtcaacgtcggcgactttcttgagatcctgagtaatggaaaattcaccagcgttgagcacagggccgtggtacacccaaccagagagagaatgtcggcggcgctgttcctgtaccctcgccagaacatgagggttggtccattgccggagttcgtgaatggcggtaaagagcggtatggatcaacggattatgaggaatttatgaagcattactttgcaacgaagcttgacggaaggaagcacctagacagattgaagttggagcagtaggcagtagctatctctaccgtatctatctcgctggagggaccaataaataatttttctatgcgatatataataaatggcgaccacaa

SEQ ID NO: 18924 - DNA, 432 bp, Zea mays
  unsure at all n locations
  Clone ID: LIB189-009-Q1-E1-C12
cggtctagaattaccgggctcgagcacgcgtccaagactgttcggtactggtacagtcaaaggaaacgggggtcaaagagtaaatccacagataggcttcaccttcagaccccaaccatcactccgccaaaacccccgtttaacttcaagccgagcacctccattcttgattcacagatcgatgtgctcaaggccagcccaaaaccactccctatagaaccccatttcagctccagctcaaaggacgatgactcctccagccttgagaccatcgtgaagtgcaaggaagctgaggcganactgttccagaaactgggcgatgatgccangaaggaggtagacagctaccggcatatcgtccgcacaaagacccagaaactagaggaggagtacgccacgaaggtggcaaagctgtgcttccaggagacggag

SEQ ID NO: 18925 - DNA, 440 bp, Zea mays
  Clone ID: LIB189-009-Q1-E1-C3
acgcgtccgatcgacgacaaccccaccaacgtgcagctcccggggatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgct

SEQ ID NO: 18926 - DNA, 451 bp, Zea mays
  Clone ID: LIB189-009-Q1-E1-C6
aatgcccgggccgacccacgcgtccaccccgatgctcgccgtgggtgccgtttgctgccccaacgccgttccgcgccccctccactccggccatgagctcctcccagtgaatccctctagtcccctgctcatctcccatggtggccgcagggagctctggatccatggccgtcggcctctgggcgtgagcagcccttggctctctcccctgcgacagacttcctccacggtgtctctttccccaaccatggtggccggctccctgctcctccattcggtgcccctggttcagggccggtcgacctccggcgacctcctccccatggcacagcaggccgacgcccctgcctctactccatcttccccattggacagcacgagctcatcctcgccgatacgccagcaaccctgcatcagcgccactcgatgtcctctatacgtgaacaacagc

SEQ ID NO: 18927 - DNA, 453 bp, Zea mays
  Clone ID: LIB189-009-Q1-E1-C7
ggtacaggtctcgaattcccgggccgacccacgcgtcaaatgtaagcagggtcctcttgctgcaccaactctgcagttgctgacgaaagaagatttgagcaaaatgtacttcagtgacttcaagatgattgacatcaatggatatgcatgctttctgacgagaactggctacaccggcgaagatggttttgagatctctgttccgtcagagaatgcagtcgatcttgcagaggccatcctagagaaatcggaaggcaaggtgcggctgaccggcttgggcgcccgtgacagtctccgactggaggcaggcctgtgcctgtacggcaacgacatggagcagcacatcacgccggtggaagccggcctctcatgggcgatcggcaagaggaggagggcagagggcggtttcctgggcgcagacgtgatcctgaagcagctccaggaaggcccaaa

SEQ ID NO: 18928 - DNA, 446 bp, Zea mays
  Clone ID: LIB189-009-Q1-E1-C8
ccgggccgacccacgcgtccagcacccatctctattcttgagaatcatgagctggcgagcattgtgctggattacaaaagggagtgtggccgggatagtgtgctgcaatcacacacctctgtgcacacggattgcaacagtgagtctggagaaacaaccttgcactgtgagcatgtgctgagccttgaatcaggtccgaccatggtgaaggcccggaccatgtggaggcctaagagaaccaaggcccaagaaacagttgttccatcttcaatttgaattgtgtgagacgttcgggatggtgattttggcaacaaactactactatttggcaaaaagatcagaatggttactagcgtcctctattggaagcaagtcacacagggcgagacctaaactaatttaattatgaagtgtgaacaatagaggagatataaatagtgtgaaca

SEQ ID NO: 18929 - DNA, 387 bp, Zea mays
  Clone ID: LIB189-009-Q1-E1-C9
gggctcgagcacgcgtccagccccagcaccccatttccctctccctctccctcacacgcgcccacacctccgctgccaccgccgttcacgccgtgctgcatctgcagccgcgccatcgcccatcacctggtgccccgccgctctgagctcgcatcgtcgtccgccgaggagcctgcgtggagccgttgccgagatcgcgatttgtttccgcgctccgaggaatcgacgatcaagcgtcggcgaccaaatgatcaagctctctgagttttatgaggttgaagatcctgagcatctgtttggtgaagacgagcaagctgcagaggatcctgaggttcaacaagtagagatagctgagcaggagctcattgaaggagaagaacaggtggt

SEQ ID NO: 18930 - DNA, 463 bp, Zea mays
  Clone ID: LIB189-009-Q1-E1-D10
cggtctagaattcacgggccgacccacgcgtccacccacgcgtccgcggacgcgtgggggctctggtcagattggcgtttcccgtgttcttcttcctcgcagcggcggagttcgcggcggggacgcggtcgccgtcggctttcgtacaaaacgccatctactccaaccgcatcaccatcttctccaagacttactgcccctactccatgcgtgctaagcacatatttcgagaccttaaggaagatccatatgttgttgaactagatacccgagtggatgggcgtgacattcaaagtgttctcctggacctagttgggcgtcgtactgtgccacaggtgtttgtcaatggacagcatattggtggctcagacgatacagtaaatgcgctttcaaatggacagctccagaaacttctcgggaagagtcagtcacaatgatgggtcgctggacaagcttgcactgt

SEQ ID NO: 18931 - DNA, 401 bp, Zea mays
  unsure at all n locations
  Clone ID: LIB189-009-Q1-E1-D11
ggtccagaattaccgggccgacccacgcgtccagttactggttcacaattactgaagtattatgcacttagtgtgaaccatctggttcggtaacgttggttggtttcagtgctggttaacatttgcttggtaacattctctagtaaccaaactttgctatttggacagtggaagtttgcatacatttcactcggtcgtcctgactattttgaagattcagatactgtagccctaaaattccagagaaacatgtatggagcttgggagcagtatcttggactggaacatccggacacggctcctaagaaggcacacacggctaatcagaaccggcattcattcgagagacctgtaaaaatttataactaggcatgttaganattgagcgatgagctgccgct

SEQ ID NO: 18932 - DNA, 402 bp, Zea mays
  Clone ID: LIB189-009-Q1-E1-D4
acgcgtccgaccaagcgtccgcccacgcgtccgcaccctgggtgctgaggatgaactgaaggatgctgttggcctggttcgccaatttagtgttgccttcgaggtgatcactggtttcaggctgtacaagagcggagtttacactagcgaccattgtggaactacaccgatggatgtgaaccacgctgttctggctgttggctacggtgtcgaagatggtgtcccctactggctcatcaagaactcatggggcgctgactggggtgatgatggttacttcaagatggaaatgggcaagaacatgtgcggtgttgctacgtgtgcatcctaccctattgtcgcatgaaggccttacgaaatgttacatggtctgtttggcatcaataatgcatgtttaacctg

SEQ ID NO: 18933 - DNA, 464 bp, Zea mays
  unsure at all n locations
  Clone ID: LIB189-009-Q1-E1-D6
attcccgggccgacccacgcgtccacgagaagatcctcgtcgaccacgaagaacggaggcgccttgctcaagcttccggcggcgagtttgtggcgactgacctcgtcgacgtgctgctgcagctcagcgaggagagcacgaagctggagtcggagtcggaggccaggctccctcgcgacggcgtcaaggccctcatccaggacatcatcgccggtggcacggagagctcggcggtgacgatcgagtgggccatggcggagcttctgcgacacccggaggccatggccaaggccaccgatgagctcgaccgcgtcgtaggcagtgggcgctgggtcgcggagcgcgacctgccggagctccactacatcgacgccgtcgtgaaggagaccctgcggtgcaccctgtcggcccgctcctcgtcncgcactacgcccgcgagcgcacggtggtggccggctacgacg

SEQ ID NO: 18934 - DNA, 452 bp, Zea mays
  Clone ID: LIB189-009-Q1-E1-D7
aattcccgggccgacccacgcgtccagcgttcgattcgcttgtgctgcagctagggtttagaggttttctgggcgcggagcgggaggcggcggcggctatggctgcggcggaggaggagatcgcggtgaaggagccgctggatctgatacgcctcagcctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatcccctttctttttgtccgaggtgatggtgtcatattggtttctccaccccttcgtacggcatgaagtttgaagttagatcatgctggttgttaattatgataactggtgtatttggccact

SEQ ID NO: 18935 - DNA, 465 bp, Zea mays
  Clone ID: LIB189-009-Q1-E1-D8
attcccgggccgacccacgcgtccacccacgcgtccgaaagtgcaaggagatgccacagtggatgctgtctttgctaagatcgacgagctgctgggttctatcctggagaagaaaaatgaaatggtgtccagcacatgagcaaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatctgctgctgtacatgttttgttgctgtcttgtgaacatacatgtcttgttgtttctcaactggaggaatggtgttaacctgctgtatcatttccttgaatggcttacgtgagagggaggaggacctgagcagcagctcttgcaatc

SEQ ID NO: 18936 - DNA, 440 bp, Zea mays
  unsure at all n locations
  Clone ID: LIB189-009-Q1-E1-E1
ggtcaagnatatccgggtcggcccacgcgtccatctaatcgttggcttctgtacacggaacaagcaccttctgcatggctgaattttgcattgtgtggcttggtggggatcgtcacagcatatgcttttgtttggatttcgaagtattacacggattataaacacgagccagtccggcttttagctctttcgagttccacaggacatggaactaatattattgctggagtaagcttgggaatggaatcaacagcactaccagttctagtgataagtgttgccattatatcagcatattggctggggcagacctctggcttggtggacgagtctggcaacccaactggtggtctttttgggacagctgtagcaacaatggggatgcttagcactgcagggtatgttctcaccatggacatgtttggtcctatagctgacaa

SEQ ID NO: 18937 - DNA, 436 bp, Zea mays
  unsure at all n locations
  Clone ID: LIB189-009-Q1-E1-E12
cacgcgtccacccacacgtccgcccacgcgtccgcagcagtttggcggcggctgatggcgccaagcgcagccgccgggccgccgtccctggcccggccatcgagcagcagccacctgcggcgcgccggcagcgccctccagcccgtctccgtcccgcgcgccttggtgcaggggcggaggcgcctcacgggcgccgtccgagccgcgccggacgcgccgccggtggtcatggcggccgtcagcgccgtcaccgagctcctcagagccctctcnccgaacaaggcgctcaggggcgctgctacccagcagcagcaggtcgaggagccggagccggatccggacccgacctgcggcagcgtcgaggacgtggtcgccgtgctccgagacgatttacggcgcgcctacttcgtcaccggggatttcactccgggaatat

SEQ ID NO: 18938 - DNA, 393 bp, Zea mays
  unsure at all n locations
  Clone ID: LIB189-009-Q1-E1-E4
acgcgtccacccacgcgtccgcagatcgagaggtacagcacgaaaaagagaggcaagagagataggggaccggagggcggcgggccggggcccaagaccgaggggctcttgcgcaggaagctgatgaggctcctgtcgctcgtccccttcggctgccgtgctggacccatcgacgacgcgccgccgcccgtggaccacgccgccgccgcaaggaggcgccggaggaggagggccaacagggccgcccagctgctgggggctgctgcgggtgcgccgcagcagtggcgcccctcgctcggcgacatctgcgaggagtacagcagcagcaccgacgccgtcaaggtcangaaggcggcgtcctgggaactcgcccgggcgctgccccgcgcgcac

SEQ ID NO: 18939 - DNA, 348 bp, Zea mays
  Clone ID: LIB189-009-Q1-E1-E6
aattcccgggccgacccacgcgtccacccacgcgtccgcccacgcgtccgcccacgcgtccgcccacgcgtccgggaccaatgacaaggagaagggtggcgatgtccccaacctgcagctcaccttcagccagcaagcaaggagaagcaccggcttcaagcaaaaggagattaattatctagctgactgtgatggattgtatgtcatttgcatgtgtttgctacttatgcgatggacgtgtaagccatatattgtattttattgttagaatcaggcacccctgaattatattgttgcaaaaaaaaacagttaacaacataaaaactgtatgcttgaaatttgtaacat

SEQ ID NO: 18940 - DNA, 403 bp, Zea mays
  Clone ID: LIB189-009-Q1-E1-E9
ggtctagaattaccgggccgacccacgcgtccagttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtcgaagcccttcgctggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgcc

SEQ ID NO: 18941 - DNA, 442 bp, Zea mays
  unsure at all n locations
  Clone ID: LIB189-009-Q1-E1-F10
ggtctagaattaccgggccgacgcacgcgtccaagctagaagcctacaactagctgttccttagctagagccataaaggaattgaggttacaactcaacccctgtttgaacggcactgcaggttgctgtanaggcaattgtcgaggtcggagatgcaaaggaggtgatatgtgaagtggctgagaagaaaaatgtcgatctgctggttcttggaagccacagtcgtgggccaatacagaggtatacatgcatcttggacccatcaagagttaatcctaagcacttggtcactcgttttctcaccactatccttcatcgtcgctgcaggttgttccttgggagcgtcagtaactactgtgtacatcattctaagtgtccagttcttgtggtgaagaacaaagctgatgaaggattcaactcccagctgctagtcctaatcatg

SEQ ID NO: 18942 - DNA, 461 bp, Zea mays
  Clone ID: LIB189-009-Q1-E1-F2
gggccgacccacgcgtccactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgaca

SEQ ID NO: 18943 - DNA, 404 bp, Zea mays
  Clone ID: LIB189-009-Q1-E1-F4
acgcgtccagcagcagaggcagcgacacgatcgcgagcgcacgcacgtaagcacgttgtcggaagctcaagttagaagaaccaccattgactgatcaatggcggcccaggctctcctctccggccggaacctgctgggccgccccgtgcagtcggccgtctctaggtcgtcggcgaggaaggcgcccttcgtcgtcagggccagctccagccctccagccaagcaaggttccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgc

SEQ ID NO: 18944 - DNA, 482 bp, Zea mays
  Clone ID: LIB189-009-Q1-E1-F8
ggtacaggtctcggaattcccgggccgacccacgcgtcaaggcgggccggcgcagctgccccgggaagagcctcgccatggccaccgtggccttctggctcgcgacgctgctgcacgagttcgagctgctcccctcgcccgtcgacctgtcggaggtgctcaagctgtcgtgcgagatggccgtcccgctggcgctggccgtgacggcgaggccccggcaagcggttcagaagtcggttggggtatcagtctcactgtgagcaatagcatggcgggctggcgctactgtacatggaaagtgcttctgcttgcaggttgctactactcggtcgacatgggtatatgcttttcatgttactgtctttgatgtgtatcgatcaggtgccgaatgtgatactttggcttgtactgttagctcttttcctgggtgctcttttctttccttttcttagtactcgctgttagactcgtcaaatgtatat

SEQ ID NO: 18945 - DNA, 438 bp, Zea mays
  Clone ID: LIB189-009-Q1-E1-G10
gggccgacgcacgcgtccacccacacgtccggaacaatccagcgagctcgaaaaaagggtacgaatacgaaccccaatccagggccggaggagggcgagcgaactcaaaagcaagccgttccagtccaatccgcctcagtccaaatctaatcgccgggtttaggcagaaggggcgggacgcggcgaggtttaagcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccg

SEQ ID NO: 18946 - DNA, 414 bp, Zea mays
  Clone ID: LIB189-009-Q1-E1-G11
acgcgtccatgctcatccactcgtgggactgggcgtgccaagcgaccaggaggctcggctgcctcaagaagggcggaggcggcgccgacactaatggcggcgtggcagagcagagcgtggaagagcagagaaaggatatggaatcggcataacatttctttcgcctttttgtcctctctgcctttcaaatttcttccttttttttagggaatttaggtacttcggtcaatctcaatggccattgtttcattttacagtttttaacagtgctacgtcaggtccataagatagttttatcctgcggtttcatagcccatactgaacctttgacagggcgtaaattaatagaggaactagggtagatgattacatgacagtcaactgaactactgcaagaagaaagatatatctccc

SEQ ID NO: 18947 - DNA, 442 bp, Zea mays
  Clone ID: LIB189-009-Q1-E1-G12
aattcacgggccgaggcacgcgtccggttgtatcgtgtgggttgagttgtgtgttgtgttgtgctgtaccttcttctatctattaatggaaagatacgcagatctcctaaaaaaaaaaaaaaaaaaaaaaaaaagaaaaaaacaaaaaaaagataaaaaaaaaaaaaaaaaaaaaaaaaaaaaaaaaagacaaacgaaaaaataaaaaaaaagacaaaaaaaaaaaggggggctgcccaaaaggatcaaagctaaatacccggtcaattcaaattaaaaccgcttcaaaagagaccccaaagtcgaaataaggggccgccctttaaaaaacacttgacaggaaaaaccctgagatatcccaactaaaccgcgttgaaaaaaatcccccttttaaaagctgaggaaacacaaaaaaggcccgaaccaatcgccattccaaaaa

SEQ ID NO: 18948 - DNA, 405 bp, Zea mays
  unsure at all n locations
  Clone ID: LIB189-009-Q1-E1-G2
gggccgagccacgcgtccacgccgcctcctctcccagtgggtcctccgcatctcccatctcncgtctcncctcttcctcctcccctgcgatctccaccgcatcacctccctcgaaccctagacccacccacgcgcccattgccttcggtcgccatgtccgccgctcagcttctccgtcactcgcgcaagctgcggagtttgcaaaatcctgtaggttgtgagaattttagttttgttcggcatttctccagcggttctgggtcctttatcgccagggaaaatggtattggnaaaagaaccagaggtaccagattttcccagcataaccagcctgcaaaacagctcgagacattctcagcaggagtaaatggaagctgcacatggagaatagcatccaacagcctt

SEQ ID NO: 18949 - DNA, 448 bp, Zea mays
  Clone ID: LIB189-009-Q1-E1-G3
gggtcgagccacgcgtccgatgcaattgtatctttaattgagtcactgaggaatgataccgtttcggaggaagctgctggtgctctggctctgctgatgaagcagcctagcatcgtgcaccttgttggtagctctgaaacagtgatcactagccttgttgggttaatgaggcgtgggactccaaagggcaaggagaacgcagtgtcagctttgtatgagatatgccggagaggtggatcgacattggcacagcgcgtggcaaggatacccgggttgaacacggtaatgcagaacatcacgctcactggaacgaagcgtgccaagaagaaggcaagcctgatcgtcaagatgtgccaaaagaaagcaaatgccatcggcgctggcgctaggaagtaccttggcagtggtggatcattcgttggtagggaacagcagattgaggcgcgct

SEQ ID NO: 18950 - DNA, 433 bp, Zea mays
  Clone ID: LIB189-009-Q1-E1-G4
cacgcgtccacccacgcgtccggaagattggggtcaaaacggtatccggcttgcacaagaattcagttcttgaaaattttggagtcaaaatccgtgcaattcaagattattctctacaattcaaagatattgtgcactgccgtgcggaaattagggattttgatgcttttgatttgcgattgaggcttcctgctgtggttagcaaattgcacaaacttatcaactgtaatggtggtgtaacatatatacattgtactgctggacttggaagagctcctgctgttgcattggcttatatgttctggattcttgggtacagtctcaatgaaggacatcggctgctacagagtaaaagggcttgctttccgaagttggaagccattaagttggcaactgctgacattctgacaggattatccaaaaacacaatcac

SEQ ID NO: 18951 - DNA, 354 bp, Zea mays
  Clone ID: LIB189-009-Q1-E1-G8
ttcccgggccgacccacgcgtccacggacgcgtgggcaacgtcgtgttcgacgaagacgaggtgccgagcggcgtcgacgcctccaagatctcgcaggaggagtacctcaacgcgccaggcgagacctactccgtcaccctcaccgtgccgggcacctacggcttctactgcgagccgcaccaaggagcaggaatggtcggcaagatcacagtcaactaaagctagctatccattccatgcatctcgatctgtatgtactccgcccgtcgatggatgatgcatccatctctacttgttttcctcacatgtacaacaattaatgcaacaaattaagtacgtaaaaaaaacaccaa

SEQ ID NO: 18952 - DNA, 445 bp, Zea mays
  Clone ID: LIB189-009-Q1-E1-H6
ccgggccgacccacgcgtccacccacgcgtccgcccacgcgtccggtcttgccctgaggtggaagcgaagggattctggcaagctgatggctgcagatcgatctcggtatccattggtgccgagagcatctcgccaagagccagagcagggctgggttcagcaacaccagcggcgtacaacatgccttgagcagcagacgtatgggctgttgccctctgcaagaagctctccagcgacaccagggccagctccatcttctcaaacggctcggcgctcagaaggcggatcggagacatgactggcgtctccgcgcccaccgtctgcaggaacggcacctgctgttcttcgaccttgggttcgtcgacgaagaagtccatcttcggaaccctcctcttcttgctgaagtggtccgcccccgtcgccgacccccccgaaacgaccccg

SEQ ID NO: 18953 - DNA, 446 bp, Zea mays
  Clone ID: LIB189-009-Q1-E1-H9
gggccgacccacgcgtccaattggaacaaaccatcagggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctctgcttatttccagcagcaaatactactaccatttggccagctagctacaacaagccccgcttccttcttgacacaacaacaattgcttccgttctaccagcagtttgtggctaaccccgcaacccttttacaactgcaacagttgctgccctttgtccaacttgctttgacaaaccca

SEQ ID NO: 18954 - DNA, 460 bp, Zea mays
  Clone ID: LIB189-010-Q1-E1-A1
gtaccggtctagaattcccgggccgacccacgcgtccacccacgcgtccgcccacgcgtccgctcactttattttatttatataatacagtccatttagctaattttgtttgatgtgcagtgacacgaccttgacagtcaagatgctcttttaggttattttctcctgaagccacttcttttgcgatctcctaatgttatggtcccattacatctccattcattgcacgagatggtcccaattaccttacatggatctgttggacacaaggaagccatccagatatgctattaaaaatcctgctagtcattatggctttaaattgtaccatgtatgttctattttcagctaggcagagcatgttctacttacagcaggccagcagacaccaggcattaacgtgatgtatgagtcacatatcaagatggcaatttttttggcagctttcacagtgaatcag

SEQ ID NO: 18955 - DNA, 419 bp, Zea mays
  Clone ID: LIB189-010-Q1-E1-A11
ccgggccgacccacgcgtcaggcactctatgacactaacggacgccaagtaccacaagagttggtagaaaagcttgggaaggtgtttgagaagatactggaagagactggcaaattgagggaagaaatcaatgaagatatgtctatcgcaaaagccatcgcaattgttatggctagaaatccgcacttgaggcaagaagggattgctcatgaggttcttcagtggtatttgtgccgtatggagggttggtttgccaccgacgctgattcaatttcactacagggttgggatcaggaggtgctgcttccaggtggccatggcctcatggttcgtgggtatcgtccggttataaatactctcgcaaaaagcttagatatacgcctcaaccataaggttgtggaaattgtttcgcataggaa

SEQ ID NO: 18956 - DNA, 409 bp, Zea mays
  Clone ID: LIB189-010-Q1-E1-A6
ccgggccgacccacgagtcagggcaaagcttcgagcaacaacagcttgctcgactcagcgcccatctatctctcttctcccccgcctgtctagccagcggcggccaccaccaccgttcagttattatagcaagcatgacgaagcacggcgtggtgatcggcccggaggacgtcacggaggcgcggcatttctcgttcccgccgccgaggatcgcggcgggcggcgagtcgtgcaggaagctggcggcgcatgtggacctcggccccgccgtcgtggggtcctgtctcgactccatgaaggcctcgtcgcccaggcataggctcatggtgcccgtgcccggcaccgccgacgcggagcatcacgactggatggagctgcacccgtcggcattggaccgcttcgacgcgct

SEQ ID NO: 18957 - DNA, 459 bp, Zea mays
  Clone ID: LIB189-010-Q1-E1-A8
ggtactagtcaggaattcccgggccgacccacgcgtcagggaagatgacgcaatggctactgccggggaagctgctcctgctgtttttgactttaaccaaggtggcaaccctcctgctgctggtggtctgaacttcaactgatacagtctttgatcgaaagggtgttaattccctcagtgatgggcttggcattggcttgtcgtgacaaatgtagtctggtcgactccacgtgggatataatggtttgtggtgagtccaataaactcaagatttcgaagggagatgggctgagcattatattcccaagtgaaccatggctatcaatatcgcagggtctgtaacaaggattatataatcgtcgaacattagagcgtgggttcttgagaacgctactctaggttgtgcgtcgtttaattatatctggctactgtaaggcattcctgattggtttggttttt

SEQ ID NO: 18958 - DNA, 330 bp, Zea mays
  Clone ID: LIB189-010-Q1-E1-B10
ggtccggaattcccgggccgacccacgcgtcaacgccgacacgccgccgcgccgcgccgcgccgccattctcccatccgcccccgtgcccccgccgcccttccctaacctcgccgcggcagacgtcgcgccgtgcgtagctagcagttccccggcgcacgcgcgtcggataagaattggttttggctcgtcggctcaccccagccatgggtccttcgacgcccattcccgcggcagtaggctcaagcttaggaactcgcaaccgaggatgaattggacgcttcgtgatggcgggcgcgaaggcagatgtatacgcacaaacgggaaatgt

SEQ ID NO: 18959 - DNA, 432 bp, Zea mays
  Clone ID: LIB189-010-Q1-E1-B11
attcccgggccgacccaagcgtcagagcttcatacttggtctcttgttaaactattgacaatgtatcttgttttttgttgaaaagtttagtacttgagtgtcaatcatacgtattcgcttgctaaactattgacaatgtatcttgttctttgttgaaaagtttagtacttgagtgtcaatcatatttcagagtcattgtgatatactgagcttggaggttttggccattgatctgcagaagttcaatacaattggaagaataagttaaaaaaaacgtggtccaaagtaaccttcagcagtaatgtttgtgtgctaaatgctcttccggagaattgtggtgatgcaaaccttgtaccaatgaatatactgtcaatctgctatcttttccgtggcctctaactcttagagtgtgtttggtttgagttgaggaat

SEQ ID NO: 18960 - DNA, 294 bp, Zea mays
  Clone ID: LIB189-010-Q1-E1-B4
gggccgacccacgcgtccacgcgcacttaagtgtaggagttggttgaaaccctagttgcatgaactcaggattcctttttgagatggatactagtatgctaggtcgagtagctgctatgctaaatcaggatctcggtagaagtcgagtgatttttctagcactcgcgcgaggtcaggaattggttgtatccattttgataacagaatgatgatggtctgtggacacggatccatgtggatgtgttgtctatgagacgaaattggaataaggattaacgtgcagatacctgtgtc

SEQ ID NO: 18961 - DNA, 453 bp, Zea mays
  Clone ID: LIB189-010-Q1-E1-B5
aattcccgggccgacccacgcgtcagtgcttatggattatggctagtatctgttatctgcgaggtctggtttgccttgtcttggcttctagatcagttcccaaaatggtatccaatcaaccgtgagacatatcttgacaggcttgcattgaggtatgatagagagggagagccatcacagctggctcccattgatgtcttcgtcagtacagtggatccattgaaggaacctccactgatcacagccaacactgttttgtccattctttctgtggattaccctgttgacaaagtgtcatgctatgtttctgatgatggttcagctatgctgacttttgagtctctctcagaaaccgcagaatttgctagaaagtgggttcccttttgtaagaagcacaatattgaaccaagagctccagaattttactttgctcaaaaaatagattacctgaag

SEQ ID NO: 18962 - DNA, 448 bp, Zea mays
  Clone ID: LIB189-010-Q1-E1-B7
aattcccgggccgacccacgcgtcagaagcagatcgactacgcagctagctcgaggttgaaggcatggctgcatccaaattctacgtcgccagctgcgccctcctcctaatcggcgtggtgctgctggggcagcagggtatagttggcgccgtcgcctgcccccagttctgcctcgacgtggactacgtgacttgcccgtcctccggctccgagaaactcccggcgagctgcaactgctgcatgacgcccaaaggctgcacgctccatctctccgatggcacgcagcagacctgcagctagctctgaaccaaagtgtgcgtgattcgatctggacaaagaccaacctgctggttttcgcaaataaagctttcgcgcctgtatatggccatccgaataaatgtgtgatcgtctatatagaaacgtgaaaaactatctatatatatatat

SEQ ID NO: 18963 - DNA, 262 bp, Zea mays
  Clone ID: LIB189-010-Q1-E1-B8
gtacaggtccagaattcccgggccgacccacgcgtccacggacgcgtgggatgaccagtgactttaggcttggcgggacggtgggagcaggtgcgcagtgcgcttctgtcccggaactgtgggatcttgctcctgccgtgccgtgcttcaccgcttctggttcgtcatggtatacatgtatatggaatgtcttctggttgccgacgaacatacacaaatacacaataaaatcacaaagaaaataaaaaagacataataaaac

SEQ ID NO: 18964 - DNA, 414 bp, Zea mays
  Clone ID: LIB189-010-Q1-E1-B9
attcccgggccgacccaagcgtcagcccacgcgtccgcccacgcgtccgttttttttttttttttttttttttttttacaatacaatcgtacatatagtacgttttattcgacaagcagcctctgcatgcaataatagtacaacccccgatttaattaattggactaatgcatgctgaggatggatcagatggagatgctgctggggatgcccctcccggtgactcccggcttggagaagggcttgagcagctcgtacggcacgatcccggcgccgcagcggttcttgaggtccaggttgttgttgcactcgtcgatgaacccctcgatctccttcatcctgccgccgaacttctcgaacgccgccttcaccatgggctccgccagccacgacggctccgcgaactcccccaag

SEQ ID NO: 18965 - DNA, 381 bp, Zea mays
  Clone ID: LIB189-010-Q1-E1-C1
gggccgacccacgcgtccacccaagcgtccgcccacgcgtccgggtgaccaccgagaagcgggcgctggccacgcggctgtcctcctccggcgacacgttcccggggtcggagcaccggccggcggaccggaagcggtggatggcggagctgggcgccgacaagctgcgcgtgcaccaggtggtgtggcccggcacgcacgactcggccaccaacaagatcggcgtgccgctggtgacccgccccttcgcgcagtgccagtccatgtccgtgtacgagcagctggccatgggcacgcgcgtcgtcgacgtgcgcgtgcaggaggagcgccgggtctgccacggcatcctggcgacgtaccccgtggacgtggtgctggacg

SEQ ID NO: 18966 - DNA, 444 bp, Zea mays
  Clone ID: LIB189-010-Q1-E1-C12
attcccgggccgacccacgcgtccactcactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcacggaggtggggtactcgcagggccaccgccacgcccccacctaccgcgacgtctgcggcaacggcacgggccacgccgatgtggtccgcgtgcactacgaccccaacgcctgcccctacgacgtcctcctcgacgtcttctgggccaagcacaaccccaccactctcagcagac

SEQ ID NO: 18967 - DNA, 366 bp, Zea mays
  Clone ID: LIB189-010-Q1-E1-C2
cgggccgacccacgcgtccacaaccggtttttcaggaacacattaagcagggcagatgttccggtgagctctcctgatgatgttctacaggccccaagtaattctgcgtcaccgggcaaaaagggcttgaaaggagtcagcaagggcagttcacccaacaactcgtgtgacgttctgtgcaatcagttcggttacattaaaatctcagattccaacaatgcgctgcagaatctggtcgtggacaggcccgcttaagctgtacctgcacatggtcatagaacctccagcagcttactcatcttactttctaccatacttttttaaaaaactttcacattataaagaatacagtctatggtataaaat

SEQ ID NO: 18968 - DNA, 430 bp, Zea mays
  Clone ID: LIB189-010-Q1-E1-C4
ccgggccgacccacgcgtccatagcagcactcaagatggttggtgggaccctggcagagcagacttatttgttccttggtgctggggaagctggaactggtattgcagaacttattgctcttgagatttcgaaacagacgaatgctccaattgaagagtgccgcaagaaggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcac

SEQ ID NO: 18969 - DNA, 445 bp, Zea mays
  Clone ID: LIB189-010-Q1-E1-C8
cgggccgacccacaagtccgctcggcccgaaggaacaggcagtacccctgcggctctaacatcgacacgcgctttctgtagggctatcttgaaaatcatgcacggcagcaactggcttatatcaagcattctcgcctcgccatgatacttacttgcctctagtcttttgttgcatcgagtagacatggtaaacggatttattctaaggtatctgaaccacgtaagcgtcttcactacactatcatctccaacactcacgcaagtacccctcacgatgctgattgctatgctacattcaatgaccttaatgcggccgtgtttgatgcaacaaggctcacgttcatcctattgatcactgatgttttcgtgtgtggttcagaatcatgataagttggattaatcagatgtgcagatcgatctgttgttaattcagatctcgttaatt

SEQ ID NO: 18970 - DNA, 391 bp, Zea mays
  Clone ID: LIB189-010-Q1-E1-C9
acccaagcgtccacccacgcgtccgcggacgcatggggagagacgacacagcagcttttttggtttccccttccctttcccctgcgcagtgatcactgggttctccgcgagcgaagcagaacactgcacgtcctacgtgaccgcgcggtgatctctgggggttccggacgttgtggtttcaataggtaggctaggggatgggaacaaccctggcgagttcaatccgatactgcaggagacagtcatggaagtatcgttcccggtactggtagagatgctagatttagtgcccttattgctgccgcatttggtgcagcagggcacgcgtgaattccattgaccactgttctttttgttagcggttcacaatcatgcgacgatgaattagtca

SEQ ID NO: 18971 - DNA, 447 bp, Zea mays
  Clone ID: LIB189-010-Q1-E1-D1
gggccgacccacgcgtccagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcaaccggttcgagtcctccgaagtcaagtccaccccgttgcagccctacagcgaggtgttcggc

SEQ ID NO: 18972 - DNA, 464 bp, Zea mays
  Clone ID: LIB189-010-Q1-E1-D12
ggtaacggtcaggaattcccgggccgacccacgcgtcaggcgtcgtcaccaacctatacaagcccaaggagccgtacgtcggcaggtgcctcctcaacaccaagatcaccggcgacgatgcgccgggggagacgtggcacatggtcttcagcaccgaaggcaagatcccgtacagagagggccagtccatcggcgtcatcgccgatggcgtcgacaagaacggcaagccgcacaaggtcaggctctactccatcgccagcagcgcgatcggcgacttcggcgactccaagacagtctcgctgtgtgtcaagaggctcatctacaccaacgatgccggagagatcgtcaaaggagtctgctccaacttcttatgtgatcttcagccaggtgataacgtccagataacaggaccagtcggcaaagaaatgctgatgcccaaagaccccaacgctaccattataatg

SEQ ID NO: 18973 - DNA, 445 bp, Zea mays
  Clone ID: LIB189-010-Q1-E1-D3
cgggccgacccacgcgtccacccacgcgtccgcccacgcgtccgcccacgcgtccgcaatgatggatttactcagggccaacctagtctacaggcaacccggcagacacaaaagtaccctatcttacagtcgaagtcgcatattaagccatctgatcaattgcaggcaagtttttcgcgtgaaaattctccatcattgttcagaccttccatcgaacttggagaagtctctttacccagtgactccacccccataagctcagatctgacaagtgctagtaatttgttggctagtctcgtaaagagtgggttcaaaccaaataaccacagtgatgcacaggctcttggtccaagtggaccacttccagtggcttctttatcacttcaaaatgctgctggtgaaaataccactttgcaggcacatacaccaaacacttctcgtccaa

SEQ ID NO: 18974 - DNA, 387 bp, Zea mays
  Clone ID: LIB189-010-Q1-E1-D6
aattcccgggccgacccacgcgtcagattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacct

SEQ ID NO: 18975 - DNA, 460 bp, Zea mays
  Clone ID: LIB189-010-Q1-E1-D8
ggtacaggtcaggaattcccgggccgacccacgacgtcagacctttcttccctggttaccgcccgcagttctacatgaggacaaccgatgtgacagggaatgtgactgtgattatgaatgacaaagatgaggaggcgaagatgtgcatgcctggtgaccgtatcaagatggttgttcagctcatccagcctgttgcttgtgagcagggtatgaggtttgctatccgtgagggtggtaagactgttggtgctggtgtcatcaacaaaatcattgagtaaactggatatatcacatccaccacgagaattttccttgtttactcaaagcgaaatgctctgtagttgttattatgtgttgagttttaggggttgttcatgtgaaattgtagtatgacactctttcgccaagtgaatttgcataatttatgacattcacgacaaagatacacttatctggttgc

SEQ ID NO: 18976 - DNA, 431 bp, Zea mays
  unsure at all n locations
  Clone ID: LIB189-010-Q1-E1-E10
aattncccggccgacccacacgtccgcccacgcgtccgtgtcaatatgctcgtatggagagagtgcaagttttgctaccttgtacagattccaccaatccagtgcttttgatgattcaaaaaaaaaaaaaaaaaaaaaaaaaaaaaaaaaaaaaaaaaaaaaaaaaaaaaaaaaaaaaaaaaaaaaaaaagaaaaaaaaaaaaaaaaataaaaacaaagaaaaaacacaaaaacaaatagtaaagaaaaaaaaaaagggggggcacctaaaaaggttaagcctaaattacccttaaaaggaaaataaaaacttttaaaaaggggccacaaaattaaattcaagggccctttttttaaaacttcctgaaggaaaaaacccggggtttacccaatttaacccccttaaaaaaaaacccctttttccaaaaggg

SEQ ID NO: 18977 - DNA, 438 bp, Zea mays
  Clone ID: LIB189-010-Q1-E1-E11
aattcccgggccgacccacgcgtccacccacgcgtccgcattaccataggctcattcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaaagaaagagtaaataataaaacaggatattctgtttcataattctgaaatagagttcttttttttagtattactcctcattaggatgtatatattaatcatcctattttaatatatatta

SEQ ID NO: 18978 - DNA, 381 bp, Zea mays
  Clone ID: LIB189-010-Q1-E1-E3
ccacgcgtccaggaaaccgatcgacaccatgacggtgttgctcgttgccctcgctctcttggctctcgctgcgagcgccacctccacgcatataaccggtggctgcagctgccagccaccgccgccggttcatctaccgctgccggtgcatctgccacctccggttcacctgccacctccggtgcatctcccaccgccggtctatctgccgccgccggtctacctgccaccgccggtccatgtgccgccgccggttcatctgccgccgctaccatgccactaccctactcatccgccccggcctcagcctcatccccagccacacccattcccgtgccaacagccgcatccaagcccatgcctgctgcagggaacctgcgg

SEQ ID NO: 18979 - DNA, 414 bp, Zea mays
  unsure at all n locations
  Clone ID: LIB189-010-Q1-E1-E5
cccgggccgacccacgacgtcagggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaagattttgttgacagcaacagggtagatgttggtagctgctctgcatcaaactgatacaacctaacaccaaaccatgccaacctcagccaaatggcacagacaagacgaggtanaaccccaacacctggg

SEQ ID NO: 18980 - DNA, 449 bp, Zea mays
  Clone ID: LIB189-010-Q1-E1-E7
aattcccgggccgacccacgcgtccacggacgcgtgggcggacgcgtgggcggacgcgtgggtgcaagttatcatttctttgcacggaatgctcttattttaaccatgtatccaaattcagtatttcattgcgacaagggtttagcccatttttcaaccgccaacttttgtggtagtttgaagttcagccttgaactatgaaatcgagtaccaaacgctctccaactttcaaaactagacaaatttggccatcttcctggttccgaaggtggttttctttatttctaaaaataataaaaatctgctttaatctctataaattcacaggtaattgatttcaaatcagaaaaatatgaagtagtatcattttttctgaaaaagttatctttgaggttgaaaatgtactttaccctaattaagcatgacgctctcactgttgcattgccaat

SEQ ID NO: 18981 - DNA, 359 bp, Zea mays
  Clone ID: LIB189-010-Q1-E1-E8
aattcccgggctgacccacgacgtcagctcttgcgattcgctcgctcgatcctagcttctcttccaagatgcgcagcgcccatggccatggccacgcaagcctccgccgccacgcgccacctgctggccgccgcctgggcgccggcggcaattccgcggcagctgagctcgcagctcgcgctgccgtcgtcgtcctcccgcgggccggccccgctccgcgcgtccacctttgaggcggtggcggctcttaaggggttcgtggtcccgcaggtggactccatcacgctgtccccgatcttcggctgcagcacgggcgggctgctctcccaggtgcatgtgttggagttctacgtcatcac

SEQ ID NO: 18982 - DNA, 423 bp, Zea mays
  Clone ID: LIB189-010-Q1-E1-E9
ttcccgggccgacccacagcgtccgctccaacctggcgggcagccgcaacccgagcctggactacgggttcaagggcaccgagatcgccatggcgtcctactgctccgagctccagtacctggccaaccccatcaccaaccacgtccagagcgcggagcagcacaaccaggacgtgaactccctcggcctcgtctccgccaggaagaccgccgaggcggtggacatcctcaagctcatgtcgtccacgtacatggtcgcgctgtgccaggccgtggacctgcgccacctcgaggagaacctcaagagcgccgtcaagagctgcgtgatggcggtggccaggaaggtgctgaccaccagcctcggcggcgacctccacagcgcgcgcttcagcgagaaggtcctgctcaccgccatcgaccgcg

SEQ ID NO: 18983 - DNA, 427 bp, Zea mays
  Clone ID: LIB189-010-Q1-E1-F1
gggccgacccacgcgtccaaaaaatatccccaaaccctagctcccgatctcgatggcgaaccctcgcgtcttcttcaaaatgaccgtcgggggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtttgctctccatggccaacgccgggcccaacaccaacggctcccagttcttcatctgcaccgtcgcg

SEQ ID NO: 18984 - DNA, 448 bp, Zea mays
  Clone ID: LIB189-010-Q1-E1-F11
ggtcaggaattcccgggccgacccacgcgtcagaacgcggcgttccgcaaggccgccgccggcccgctgcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgccgcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaattatatacagattattcgcccaaagagac

SEQ ID NO: 18985 - DNA, 438 bp, Zea mays
  Clone ID: LIB189-010-Q1-E1-F4
gggccgacccacgcgtccactctatctttacctatggcggtgagacgtttcgtggaacaggacaacaccaagaaaccaatcttattagacgacctgacggaactcacatcacaaaactttgatttgtttagatcaaatgtcgactcggtgatcgatagaggtgcttgaaatggtgcgggccttgcaaagtgatggctccgaaattccaggagatgtctgagaagaacctggatgttgtgttcctgaagctcgactgcaaccaggacaacaagccgcttgcgaaggagctgggcataaaggttgtgccaacgttcaagatcctcaagggtgggaaggtcgtgaaggaggtgaccggcgccaagatcgacgagctagcgcaagccatcgacacagtcaagtcagactgacaaagaaagcaagtgatgcaactagctagtg

SEQ ID NO: 18986 - DNA, 96 bp, Zea mays
  Clone ID: LIB189-010-Q1-E1-F5
aattcccgggccgacccacgcgtccacggacgcgtgggcgtgtataaatgtaattcctctgctttgcacatggatggattgggatgtaacctgttc

SEQ ID NO: 18987 - DNA, 458 bp, Zea mays
  Clone ID: LIB189-010-Q1-E1-F6
aagtcccgggtcgacccacacgtcaaagaatatattgaggcctgtgcttccaatgctgactttgataagtgtctatcagtggatggtgatagccaaggcttagagcgactccttggagctctttctgcacatatgtggcctggaatgattctgaaatctggaaacagaataactgtcccatccttggttgaaaaacaagaatccacagatgatgaatccaactatgattttgagtacgaggtcttgtctcatggatccgatgaccagtgggaatttattggagagacaagtacatccagaagatttgagagaccaaatgagcctgatggtgcacaggatcacacacatcaagttgtgaatgccggtactgactcttcagcatccaactctcccccgactaacacacccacagaaactgctgaagagaatactgtaactcagagcaacaaaaccgacaa

SEQ ID NO: 18988 - DNA, 163 bp, Zea mays
  Clone ID: LIB189-010-Q1-E1-F7
aattcccgggccgacccacgacgtcaaaaaaaaatagaagactgtaacatcaaatgctgactttgaaaaaaaaaaaagggggggcgccccaaagggttcaagcttaagtaccccttcaagccacgtcaaaacccctccaaaatggcacctaaattcaattcaa

SEQ ID NO: 18989 - DNA, 439 bp, Zea mays
  Clone ID: LIB189-010-Q1-E1-F8
aattcccgggccgacccacgcgtcagccggggcttggatcttgggaaggggaggtgtggtgggccgccgccggcgatctggcggggaggatatggccggcgggaaggagccgatcgaggtcaggttccggctcttcgacggcacggacatcgggcccaccaagtacgatccctccaccacggtctcctcgctcaaggagttcatcctcgctcggtggccgcaagataaggatataactccaaaaactgttaatgacttgaagcttatcaatgctggaaggatattggagaataatcggacacttgcagagtcccgtgttccagtaggagaggtcccaggaggtgtaattacaatgcatgtggtagtgcgacctccacaagctgacaaaaacagtgagaagcagcttgcgaattccgtcaagcagaacagatgcgggtgc

SEQ ID NO: 18990 - DNA, 386 bp, Zea mays
  Clone ID: LIB189-010-Q1-E1-F9
attcccgggccgacccacgcgtccacccacgcgtccggtacaaatcatgaattgtccacaatagaataaccaattgtgaccatagcaaaaatcttctgtttctgaataaaaatagcaaaatcggtgtcgtgttcgtaaaagcaagggcaagggtagaaagagaaatatgaaaatatactggtgggtgggtctgtttgagactaaatcgtagacaatggtctatttcagacttaattaaaagtttaatggcacttttgcaaccttaagaagtttagtggcatatatcaaaacatagaaaattataatggcacagacacaattaacctaatcataaaacagcatgtcatctctcaaatcaccaggagaaagggataaagggaacctgc

SEQ ID NO: 18991 - DNA, 456 bp, Zea mays
  Clone ID: LIB189-010-Q1-E1-G11
ggtaaaggtcaggaattcccgggccgacccacgcgtcagggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatcctagttcatctgttgtgtcctagttctatgtgaaaccagagttttgtagctatggctctcaatcgttccattaccatgtgttatgcacacttctgaatttgatatcatccaagtgaccttttgaactagtttgcgttctgcacttcattacacttggacaccgtcagtctttgtgaccagtaattttgtttgtcgtaatgggttggttttgcaactcgaccaaatagctgttttgag

SEQ ID NO: 18992 - DNA, 426 bp, Zea mays
  Clone ID: LIB189-010-Q1-E1-G12
tcccgggccgacccacgcgtcaggggaggatgacaatcatgtttacatgactggtcctgcagaggccgtcttttatggatctgttgttcactatgtactggggagtggggaccaagatagaagggttggctgccactcaaagcttgtgagattggttacaatatccatgaaactgaatgttctggtgccagtacactcgtttagatattttaaattatggttgcttgatttgggtagcagtagaggcttccttttgaagcattctagtgttgtccaccttttgtactcctttactctgtcaggtttgaactacattgttagcatgtctttccaaccattttctgtttcttttctttgcaagttaacgtcaatgcagcttcagtattgttttctaaaaaaaaggttggttttgcaactcgaccaaat

SEQ ID NO: 18993 - DNA, 240 bp, Zea mays
  Clone ID: LIB189-010-Q1-E1-G4
ccaaaaggttcaaacctaacttacccttgaatgcaaattcaaaccccttcaaaagtgtcaccaaaattaatttcatgggccgtcttttaacaacgtcgtaacgggaaaaaccctgggtttaccaaatttaacccccttgaaaaaaatccccctttcacaaactgggttaataccaaaaaggccccaaccgatcccccttccaaaaaattgcccaccctaaatggtaaatggaaccccccc

SEQ ID NO: 18994 - DNA, 383 bp, Zea mays
  Clone ID: LIB189-010-Q1-E1-G5
acccacgacgtcaacgcagaggcacaagatcgaggccggcgtggcaacggcggcggcgctgggcgccggcggctacgcgtaccacgagcaccgcgagcagaaggacgcccactacgatagcaagcaacaagagcaaaaggttgcccacgggcaatggcaagggcaacggtactcctaataatggcactgaaaccactggttatcccatccattcaaatatgcattccaaaccccataaatataccggccctaaccccgttcacgttcgttcctttaagttaataagagcaaacgtcctcacctgtgtgttgctccattacaaatccaaccatttacctattaacgtctgcaaataacgactaagcgcaagcttctgcaacgtg

SEQ ID NO: 18995 - DNA, 437 bp, Zea mays
  Clone ID: LIB189-010-Q1-E1-G6
cccgggccgacccacacgtccacccacgcgtccgcccacgcgtccgcgatctctttgatcgcctgagccatgcatgccatggtccagttcttgatctttgtgtgtctgtgcgtgtgcatcgacgtgtggctgcagcacgagaagcacaaggccaagaaggacccagagaacgagcacgggcaccgggtcaaggaggaggtggccgccgtcgccgccgtgggctccgccggcttcgcttttcaagaacaacaacaaaaaaaaggaccccaagaaccacgccaacaactgatccgtcccggttgcggttcaaccggtccttcaagcctcgtcttcgtcaacggtgtgccggcaaggccttgatttgggctaccgatatttgcatggacgtaggaactgtgttggtcggtcctcggcgttcttgtatcaagatcaaatca

SEQ ID NO: 18996 - DNA, 468 bp, Zea mays
  Clone ID: LIB189-010-Q1-E1-G7
gtactagtcaggaattcccgggccgacccacgcgtccacccacgcgtccgcccacgcgtccgcccacgcgtccgcccacgcgtccgacgacacaaacacaatcatggccgacattgactcacgaccgcgcaaatcggtcgcattcgccgagggcgagaccattgtcgactccaacggcgaggtcacccaggccgtctcggagaccgaaaaggacaccaccgccgaatcacactcaaagcctgacgccgccgtcgacgaggccaccgacgactttgaggctctcgcgctcagctcgaagaaaaagaagaagtcgaagactgaggatggcgaggtcgacctgagtgcgctcaagaagaagaagaaaaagcccaaggcgccgctcgtcgacgacttcgaggccaagcttgcggctgcatgtggcgacgaggagaatgtgctggccgacgatgcggctgagaagcagtccgc

SEQ ID NO: 18997 - DNA, 417 bp, Zea mays
  Clone ID: LIB189-010-Q1-E1-G8
ccgggccgacccacacgtccgcccacgcgtccgtgaagaaaatgttaaataatgcgccagagtatttgcagaatgttgttgagctatgccaaaacagagtggttgtcttcgataacgtgactgaagaccgaaggctccaagcgcagcaacttgacaaattgctcgatgtagtggattcagtttgtgcaaaaaatggaggaaaaccattttcagatcaaatgttcactagcatcaaggaggtgcatgatagagaaaaagaggtgcatacctcgggatattcagatgagcagatatctgaattgaaaaaggagattcatagaactagggatgaacagcttgcgcacaataacaacatggtcgaggaaaagttaaactgcactgtggagaagttgcaacagcagctcatggaagaacaga

SEQ ID NO: 18998 - DNA, 426 bp, Zea mays
  Clone ID: LIB189-010-Q1-E1-H1
acgcgtccaggctaggcagaacaccaaggactgcgagcacctagcccgccgcgtcggcatgctcgcggagctggtcccccacctgcaggacccggaggccaggcgggcggtggccgggctcaaagatgcgctcgtggaggctcaccagctcatcacatcctgccagaggagggggctcacgtcccagctgttctcggcgtccaggcaggccgacaggttcagggacgtcgagcgcaagatcgaaacctgcgtgtccatcatccctgtcatcggctacatcggcataacaagacgcctcgatggttcgcaatcccagtcccagctgtcggcgggaggggctgaggatcgggagttcacgctggcggagatcgccgtggccaccaacaacttcgccgtcgtgctcagcaacgacgccgacactggcac

SEQ ID NO: 18999 - DNA, 434 bp, Zea mays
  Clone ID: LIB189-010-Q1-E1-H10
gacccacgcgtccacccacgcgtccgctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgat

SEQ ID NO: 19000 - DNA, 438 bp, Zea mays
  Clone ID: LIB189-010-Q1-E1-H9
attcccgggctgacccacgcgtcaacggacgcgtgggatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtat

SEQ ID NO: 19001 - DNA, 423 bp, Zea mays
  unsure at all n locations
  Clone ID: LIB189-011-Q1-E1-A10
accggtccgagattcncggatccacccacgcgtccggagatcttcatcangggaaattcgcatggtatgggagactacggcccgtatacctttgaaccctcgtaggaagtcttgagaacccttgcatgcattcgctgttgtatgcgtgccatgctgttgaatttagctgtactacaccagatagtgatacccgaactcacggagtttaatggaaccggatagaaagctgcccatgtagtttggtgtttgttgcttacgttgtggattttactgtagtgacttgtctaatgctccgtttctccgtttggttatcgaccatattggagggcatggaattaaaataagttcaataccaaatcaaatatagtattgaaatgagatgtaatttcaattctattgtttggatgtcgctgatttggaatt

SEQ ID NO: 19002 - DNA, 433 bp, Zea mays
  Clone ID: LIB189-011-Q1-E1-A12
cccacgcctccgggaagttaaaagcaagagacagctaacccagtacctgaaagctcatcctggaggccctgcatcctcagagttcgattggggaaccagtgatactcccagacgctcagcacgcttgagcgagaaggtcaaggcaactgagagcccagagggtgagaagacccctaaacggggaagatcaagttctaagagaggcaaaaaggaggaaaaagaagacacagaggctgcaaatgaggctggagaagatggtgcttcggaggaaggtaaaggtacagatgtggagatgaaagatgctgaaaacgctgaagacgagaagaaagaggtcccaaatgcagatgctgcagagaagactgaggaaggtgaagataagaaagaggaggcccctgctgtagatgcagcagagaagactgaggaaggttaagat

SEQ ID NO: 19003 - DNA, 235 bp, Zea mays
  Clone ID: LIB189-011-Q1-E1-A2
ccggccggtcctaattaccgggtcgagccacgcgtccgattaacatcaaactcgtcgtccacgcctcctcggcaaggttgcgtacggcgtggccctaaggttcatctcgccgcctccctcaaactcttgattccgcctccctcaacctcttgattccgcctccctgaaggcataccagcgggatcaagctattttgctggccaaccgaacggtcaagccgacgatgacgctcgga

SEQ ID NO: 19004 - DNA, 372 bp, Zea mays
  Clone ID: LIB189-011-Q1-E1-A3
acgcgtacaagagtgggcaaccctgggaaaaatgaacatcagaatatttttcaatcatatccaattgacttggggcagaaataaccgaactagagtctacagtgaggtgagacctgttcgcctcttgagtgactgaaacaaataagagattgttagagctcggacaataccattgagtgtacaggtttgttcaggacccactggctataagctactctattcgttcacaaagactgtattgtagaggtacatgatagaatttattcttatatgctataaaagaaaatgtcttggctacgatgctggtcgattgcaaatgtatcttctctgatcgacttccatatcaaacgagacaaacccgagggggcgtcc

SEQ ID NO: 19005 - DNA, 75 bp, Zea mays
  Clone ID: LIB189-011-Q1-E1-B12
ccccaaaaggatcaaacctaacttacccttgaatgcaacttcaaaccccttcaaaattgtcaccaaaattaaatt

SEQ ID NO: 19006 - DNA, 330 bp, Zea mays
  Clone ID: LIB189-011-Q1-E1-B2
ttttggctttaaaacggtagactaaattccgaaattaccaaccagacctcgaatgtgcagatcaattctacctgtcctgaaaacctatttggatgcaaggccacacagaattttacagacaaactgtgaacagctggaccaaagggcacacatttttctcactgtttaaatgacatatgcacaaatagtgaactccgagagttcactaacggccgcaggtcactaaaatttgcttccattaacgaaaggtttgaacaaagaacagcggaactggctatatgggcacaatgctatggtagtacagctatcagcagcaacggcagcaaatga

SEQ ID NO: 19007 - DNA, 303 bp, Zea mays
  Clone ID: LIB189-011-Q1-E1-B6
aaacattgacccaagtacttagaacactgacgacaccggtacatcacaggcacacatcgcctgcttgtccttattacaggcacgagcatcacgttgctactatcacaaccagtcctgatgcacgccatgcctgatacgactgtattatagtagaaccagtattaaacgggtattagcacagccacacactgctatcaagcaccactactagtagtataatattgtagtgatacaagcagggagcccagcccagccgagcacgagcagggtgcctgccactgccaggctctcccgccgcccttt

SEQ ID NO: 19008 - DNA, 426 bp, Zea mays
  unsure at all n locations
  Clone ID: LIB189-011-Q1-E1-C10
cccacgcctccgacaatgcgcatgacggatttaacttttacanatcagtcctcagtgagatggatttaactttacttctatttcatgttatgcagtctttggaactttgggacataagggagaagaacaccatgaccttcaacaatgcgcatgacggtttggttgcagccctggcatcatccagtgctacagggaaggttgcctcagtaagccatgatagaactctcaagctctggaaatgactttataatagcgatcggcgtgaaaacgattttctaccaaaaatgaccacatgacgcacatgacgaaaaggtagctgacaagatactctggagccgcgtgggctcaagaactaacggtggtttgtgttgtggttcttgtatgctgttcaatatgctattgaagtttgtaactcctaatagaaac

SEQ ID NO: 19009 - DNA, 150 bp, Zea mays
  Clone ID: LIB189-011-Q1-E1-C12
ggaggtagctgcggtaaacctaaaaacattcataaggtcgaaaatggtaaaatttcgtcggcaaatataaatacaaatgctaaaacctgctgagacaaaaataaaaaaaaaaaaaaaaaaaaaaaacaaaaaaaaaaaaaaaatttaaga

SEQ ID NO: 19010 - DNA, 418 bp, Zea mays
  Clone ID: LIB189-011-Q1-E1-C3
gggtcgagccacgcgtccgcccacacttcggcgtaaattaaaagtatcccataatgaacagataccaccaacatagttaaagtttttaccgggattaaagcggccatttttcaaaacggggtcgggtgctgaaaaaactcaaattgttttggggtcccacgctcggtgacgtcagtttggtctgggcaagcgcaggacgataccgatccggccggtcagggcgcacgcgggggcgatccgatccagcgagtctaagggtatccgcaaccgttattcctaaatttttctccctatatcactttttccccctattttccccctatttttcatctctcgcagcggttccccctaaatactccccttataccccactaccactataaaatatcattttctaatacaactatcaatttttttt

SEQ ID NO: 19011 - DNA, 275 bp, Zea mays
  Clone ID: LIB189-011-Q1-E1-C8
tccgggtcgacccacgcatccaccgactcttccgcccacgcgtcctcggacgcgtgggcgcaaccaaacgcgcacgatatgagtccaaatcgacgaactcgatatgtcaccaatactggtcagcatgaagtcgagcgtcctcaggctcaagcactccgcagaagttccgcatgccaccgcctcctcatggacggagaatcgtgtgcatctgggaggtcgtgaaggttgcccctccgctctgctcagcatgccggccgtcttcgacttcacggcca

SEQ ID NO: 19012 - DNA, 407 bp, Zea mays
  Clone ID: LIB189-011-Q1-E1-D1
gggtcgagccacgcgtccgaggacacgtgggctatagcaaccggtccagcactttcacgctcagctccagcaatggctgcctccaccatggcgatctcctccacggcgatggccggcacccccatcaaggtgggctccttcggcgaaggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcctcttccc

SEQ ID NO: 19013 - DNA, 431 bp, Zea mays
  Clone ID: LIB189-011-Q1-E1-D10
cccacgcgtccgatctcggcagccacaagaaaccacccccttccggcacacgggctcgaccacctgactccatcaccgtgcctgtctgtgttctagggacaagaagagcagagatatacaggagcgagcagaggcggggagaagaggatgagcaccacaacggcgtcgtcgctgaaccccaacgcgccgctcttcatcccggcggcgtaccggcaggtggaggacttctcgcccgagtggtgggagctcgtcaacaccaccgcctggttccgggaccactgcttccggcagcgccagctccacgaggccgcctgcgacgacgtcgccgcgctcctccccgacgacctcctcgacaccaacgacctcttctacgcgcccgacgtcgtccaccaccaaccagcgacggcgctgctgcccgggtacgatgtcct

SEQ ID NO: 19014 - DNA, 402 bp, Zea mays
  Clone ID: LIB189-011-Q1-E1-D3
gggtcgagccacgcgtccgaccacacgttcggcggacgcgtgggccggacgcctggaaaataaggaaaatttttgaaaaggtttgaaatatatcttcatcagttgacaccaaatgccattgtcaggctgagtgtctacatatgggctctccgaagctagggcaaagatgctaatgcccaaggtttctgttgagtgcatgaattgcactaccagacgaaggctagagctgatggccttcacaagaactttggatgttataattttgcataccgaaaggacaccagggcttcggtgatcggctaccgcactaagtggccgaccgggtggacaaacgaatggttctacgtgaaagccgatgagaagaagagggaaaaactcatcactatggttatgagtcccctg

SEQ ID NO: 19015 - DNA, 74 bp, Zea mays
  Clone ID: LIB189-011-Q1-E1-D7
agcggacgcgtgggtttttttttttttttttttttttttttttttttttttttttttttttttttttttactat

SEQ ID NO: 19016 - DNA, 218 bp, Zea mays
  Clone ID: LIB189-011-Q1-E1-E12
acggtcgtaaattcccggatcgaccaacgcttcggacaagccttcggccaaggcttcggccaagccttcggccaagccgtccgcaaggataaaattctcacagatggggtattgattagagagatgatggaagattctcttcttaacaagtatagtgtaattatggtggatgaagctcaagaaaggtccatctcaaccgacatgttgctgggtcccct

SEQ ID NO: 19017 - DNA, 391 bp, Zea mays
  unsure at all n locations
  Clone ID: LIB189-011-Q1-E1-E7
caagaatactgagattgcaaagcacttgtcccttccaccagtaaagctccattgcagcatgcttgcggaggatgccattaaagctgctgtgaaagactacgaagccaagaaggcgaagatggggcaaaagagtgaagacagtccatcagagaaagctgctgaagcatgaaagtttctgccttttttaagtgtaattgagctgatatgtttctcagtccatgactccccgctgcttcagataaatgcttctgattgcgaggcgaggcgagggaccgcgtgtaatgttcacaaattctggtagtgcggcatgtgccttaactcttttgaggatggtgacaaccaatttcaaataaatttggtgccatcttagaattaanaaanaannannnaa

SEQ ID NO: 19018 - DNA, 397 bp, Zea mays
  Clone ID: LIB189-011-Q1-E1-F3
ccgggtcgagccacgcgtccggttttcttgggcaatgatgttaagttccggaatgttttcccttcccctttttcctaatgcgtggtccaagtgtaaaatgccaaaaggaatccttaaccaagccccgggcggttctgttctgggggccaaaaaacaaccgaatggggaaaaaccggaaataagagcgtgccgctgtgtgtttcctttgaaggaatgaaaatggtgttcgtgttgtgcattgcttattaaaaaaaaaaaaaaaaataaaaaaaaaaaaaaaaaaaaaaaaaaaaaaaaaaaaaaaaaaaaaaaaaaaataaaattaataaaaattaaaaaaaaattaaaataatataaaaataatttaaaaaaattaaaaaaaaaaaaggggggcccc

SEQ ID NO: 19019 - DNA, 225 bp, Zea mays
  Clone ID: LIB189-011-Q1-E1-G1
gtgtattattttttttttgaaaattaaagtgatttggcatttttttaaagtcgaagaaccggcgaatgctgtaacccagcagcctgaatccctgtcaatttgtacacacgcccaacatttggagatcatgtttcccctggaattgccgtcacaccctatccaagtcaaacgtaaagacagaccatccactgaactcccggaaacaaggggcccacatcaacatgt

SEQ ID NO: 19020 - DNA, 401 bp, Zea mays
  Clone ID: LIB189-011-Q1-E1-G3
gggtcgagccacgcgtccgccaaaccttcgcccaagcctccgatttggaaagattcctaagacaacttcacggacattaaaggaattccaaactggtaatccggaagatgatgctcctaaagggatatcaaccatcaacatcaagcttgtatatgacgattaacctgaaaaggtcaagggaaaagagcaaaagggcgctaagaagcgccaacgcttgggtgaaaatttttcaaatcttttggattccatcaaggaaatatcagcttcttcaacatgggatgattctaaacagcttttcgaggatagccaagagttcagggccttggacaatgagacttatgctagagagctttttgaagagtgcgttgtccacctgaaagaaaggttaaaagagaaagaac

SEQ ID NO: 19021 - DNA, 337 bp, Zea mays
  Clone ID: LIB189-011-Q1-E1-G6
aaagcaattagtagcacttagcagcactgctcgtttttctaacctaccgatacctacacccgatcatggcggtggatcagcgctagctcagtcctcgaatccggtcttcttccagacggcgtcccggacccggctgaggtcgcgccccttgagcgtcctgccgatcccctcgtgcaccgacagcgacgccgcccggctgcgccacgccagctcgtgcggcggcaccatctccgccccgccgcgcgccctgccgtagctgctgccgtcgtcgtcgtcgtcgtcgtccgcgccaggctcccactcgcccgcgcggtggtggtcccggtactccaccccg

SEQ ID NO: 19022 - DNA, 466 bp, Zea mays
  Clone ID: LIB189-011-Q1-E1-G8
aattcccgggccgacccacgcgtccacaaaccatctcgactcgtggggaagattcgctctcgccggcgtcgacggcctagggttcgaggaacgtccgtccgtccgtccggtgaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggttggtctgaattctgaagtcatgggtgcaattcgcttcgcggtgatctcttaagctcatcacatatataaaagcaacctca

SEQ ID NO: 19023 - DNA, 464 bp, Zea mays
  Clone ID: LIB189-011-Q1-E1-G9
ggagccacccacgcgtccgattctcctccatctcttccttttccctttcctttttctcattgcgacgcctgcctgggcgaccgtcgccgctctacacaaggtgcccaggtcttcgccggcgccgagcagccaccagccgctgtgcaacaaatcacgtctgtcgagggcatggatccctacatgacaaggctcggcgccggagccactcaccagctttccagggctgaagcaatgcctgaccgaaggtctaggttttggcagacagatgtgcagcttgcgcctcggatagacatcatctgccctctgcctcgccgcccttctcgcctaccggttctcaatagccccaagctcaatggggcactcccactgtatagagcagaccccacttttgatatcgttgacctcatccttagcaagaatgaccctgatgtggatactgattcaagcaaccaagcgggcttttt

SEQ ID NO: 19024 - DNA, 418 bp, Zea mays
  Clone ID: LIB189-011-Q1-E1-H1
ggtcgagccacgcgtccgataaaagtcaattaggaaggctggtcctagcactaaattggcaacaaaagaaaacgaatttatcgaggcagatcctctgcgaccttgatggctcattgcaattatgagtacatatatattgcctttatcttatgcttagtagaacaaactgagcatatcatatatcatctattttgtttttttctcttaacatacctctggtcacattccatacttttactccttatatattgcatagttatatgtaatatataaatatgcaatatataactttattaattcctacctatgcttatcaacaggttgccctgtgaactttgagttccaaaactacacaatcatcacaagcaagtgcaaaggaccgaagtttccagccagccaatgctgtgccgcactcaag

SEQ ID NO: 19025 - DNA, 433 bp, Zea mays
  Clone ID: LIB189-011-Q1-E1-H5
cggacgcgtggggaatcatcaggttaagatcgatctaaaccaatccagtttatatatacatacgacatgccaacggttaaacaacttattaaaaatgcaagacagccaatacgaaatgctacaaaatcggccgcgcttaagggatgtcctcagcgtcgaggaacatgtgctagggtgtatactatcaaccccaagaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaagacacctagatgctgtcgcagtaaagaatcgtcaacaagggcgttctaaatatggggccaaaaagccaa

SEQ ID NO: 19026 - DNA, 419 bp, Zea mays
  Clone ID: LIB189-011-Q1-E1-H9
acccacgcctccgcaagcactccacactgctgtgcagaacgagagccacaccatcagtagttagagcgaccaatagatgagttcctccccgtcctttggtctcctggctgtagcagcattactcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacgtcgagttaggcgccaactgggtggagggcgtgaacggcggcaagatgaaccccatctggcccatcgtcaactccaccctcaagctccgcaacttccgct

SEQ ID NO: 19027 - DNA, 292 bp, Zea mays
  Clone ID: LIB189-012-Q1-E1-A1
acggtccgtacattccggggtcacccacgcgtccggaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggca

SEQ ID NO: 19028 - DNA, 376 bp, Zea mays
  Clone ID: LIB189-012-Q1-E1-A2
cccacgcgcccggagccactgtcaagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgcccgcgccctacaacccggctacagagcaagttcttcgagacgttcgcggctccgtttcacaagagaggtctgctgctcaagttcctgctgctg

SEQ ID NO: 19029 - DNA, 280 bp, Zea mays
  Clone ID: LIB189-012-Q1-E1-A6
cggtcctaccttccacgggtcgacgcacgcgtccgaccacgcgtccgaatcgccagccctatctttggtgcagtcattggtcgaaaccatcagggtacagcagctgcagcaactcgtgctagctgtgatcacccacgtagcactggcacacctttctccctactctcagcgacaacaatttcttcaagtcaagcacatgtccacttttagccgtgtctgcgtacttgcagcatcacttatgaccatacaaccagctaactactgcctaatcttagcaaca

SEQ ID NO: 19030 - DNA, 426 bp, Zea mays
  unsure at all n locations
  Clone ID: LIB189-012-Q1-E1-A7
cggtcccacattcccgggtccanacacgcgtccgaccacgcgtccgcgccgacaaccgaggtttcgacgttcctgcacgcgtgcgagggggaggcggtgacgaagctcaccaacgagaaggtggcctacttcaacgcgcccatctatctgcagaacaagacccagatcggcaaggttgacgagatcttcggccccatcaacgaatcctgcaccaccgcggcccgaaaaacaagctcaaaccttaaccaccgacgatgccagcacgatggcccgctacgaccccgccatcactatcttctccgccgacggccacggcggcgangtggagtacgctcttgaggccatccgcggcacgaacaccgttgtcctccgcgtcgagaagaagtccacacccaagctcgatgactccaggcgcatagctatgtt

SEQ ID NO: 19031 - DNA, 463 bp, Zea mays
  Clone ID: LIB189-012-Q1-E1-B2
ccggatccacccacgcgtccgcacacgcgtcagcccacgcttccgcactgccaccgccgccttggccgttgccgcaaccgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagaacctagtccgtcaccctcaccgtgccgggcacctacggcttctactgcgagccgcaccaaggagcaggaatggtcggcaagatcacagtcaactaaagctagctatcgattccatgcatctcgatctgtatgtaccccgcccgtccatggatgat

SEQ ID NO: 19032 - DNA, 291 bp, Zea mays
  Clone ID: LIB189-012-Q1-E1-B5
tcccgggtccacccacgcgtccgcccacgcgtccgcggacgcgtggggcaaccggtccagcactttcacgctcagctccagcaatggctgcctccaccatggcgatctcctccacggcgatggccggcacccccatcaaggtgggctccttcggcaagggccgcatcatcatgcgcaagaccgtgggcaagaccaaggtggccgccttcggcagcccctggtacggccccgaccgcgtcaagtacctcggccccttctccggcgagcccccgagctacctcaccggcgagt

SEQ ID NO: 19033 - DNA, 286 bp, Zea mays
  Clone ID: LIB189-012-Q1-E1-B7
tcccgggtccacacacgcgtccgataaagcgtacgcacgcactcgcctccgacagcgaacgcgcaacgtccttctcccgcgccgcccggccggccggtccctgttccctctcctcccctcggagcagcaggaccaggagcaatcgcgttcgtcctctgcgctgcgcggcccgccggcctgaccaagcatagcttatcggccggagctggatgaccgaacgatgcatcatgacctcagaaactcagatagaataaacccggaacaagcccatccagtgatgtccgcg

SEQ ID NO: 19034 - DNA, 133 bp, Zea mays
  Clone ID: LIB189-012-Q1-E1-C11
gatgccccccggcggcgccggtagcgcttcttcatggactcgaccttgttcttgcactggttggaggtcttggcgctgctacagatgcctccagaggccttcccttcgggagctctatagtatccatgcttac

SEQ ID NO: 19035 - DNA, 353 bp, Zea mays
  unsure at all n locations
  Clone ID: LIB189-012-Q1-E1-D4
cccacgcgtccgcaaggagtaaggtggccgacgaggacttggaggaggtggacaaggcctgggaccggcccagcaggagaaagagcacagaattcgatatagccaagagcatcgagctgctggctagctcgttcttgaagattgagcacgccaggatggagatgtacagggagacagaaaggatgagggttgaagctgagattaagaagggggagatggagctcaagagaactgagatcatggcgaaaacgcaccttcagatcgctaggctttntgcaaagaaattgagacagagcagtggaaagaaaggtgtcagttcgtcagtaacagctgaagtggacacccttaccaag

SEQ ID NO: 19036 - DNA, 417 bp, Zea mays
  Clone ID: LIB189-012-Q1-E1-E4
cccacgcgtccgcacacgctgccacgcacccacggtccgcggaccgcgacccacccgacccgcgatcgccatcgcctcacgcactcgcatcctcccggactacccataaaaccaccgcgacggcgacggcgacgggtcctccgcttcgcctacggcatattcccccgaggccccgaaccaaaccaaaccaaaccagcccagatcagcgaaacacactccgctctcccgagaccggacacatggcggcggcggcggtgacgtccaacggcggcgcagtggccgcaaatggaccggcgcccggccggctgggctccgtgtacagcgaggtgcagacgaaccggctcctgcacgccctttcccctcccctccgtcctccgctccaacttccccgtcgtcgacggccccgccagctccgcc

SEQ ID NO: 19037 - DNA, 409 bp, Zea mays
  unsure at all n locations
  Clone ID: LIB189-012-Q1-E1-F3
acccacgcgtccgcaccacgcgtcagcccacgcgtccgcgccgccgaggtcctgggcgccgtcgacaaaccacctccctcccccgtctctcgtcgtctcggaaggaacggccgcccgtcgcgccaaggattcaagggtgtgggagctgagttgggaggaggactgctgctgcagccatgaaggccctcattctcgtcggaggcttcggcactcgcctgcgcccgctcacgctcagcgtcnccaagccgctcgtggatttcggcaacaagcccatgatcctgcaccatatcgaggctctgaaggaagttggtgttacagaggttgtcctggccatcaatttacagcctgaggtcatgctcaactttctcaaggacttcgagagcaagcttggcatcaagattcactgctc

SEQ ID NO: 19038 - DNA, 334 bp, Zea mays
  Clone ID: LIB189-012-Q1-E1-F8
cacgggtcgacacacgcgtccgaccacgcgtccgcccacgcgtccgagaagcaggaattagagttaaagtggacgactcagagctgcgaactcctggatggaaattcaatcactatgagatgaaaggggttcctgtaagaatatagataggtccacgtgatgtcacaaataagagtgttgtggtttctaggcgtgatgtccctggaaagcaaggaaaggagtttggagtgtctatggagccttcgatattggtgaaccatataaatggtcgtctagatgacatacaagcatgccttttacagaaggccttaaaatccgtgatagtaacattgtc

SEQ ID NO: 19039 - DNA, 330 bp, Zea mays
  unsure at all n locations
  Clone ID: LIB189-012-Q1-E1-G2
gggaccacccacgcgtccgcccacgcgtccaggccgggaccgtcgggtacgtggcccccgagtacgggcagacgtggcgcgccacgaccaagggcgacgtgtacagctacggcgtgctgctgatggagctcgccacgggccggcgcgccgtggacggcgccgaggacgagtgcctggtggagtgggcccggcggatggccagagaagggtggagttcggcgggcgccgtcgtcggcaccgtgtcctgngagctcctgatgctcggcatgcggtgcacggcggacgcgccgcaggagcgccccgacatgccggacgtgctcgccgcgctgc

SEQ ID NO: 19040 - DNA, 390 bp, Zea mays
  unsure at all n locations
  Clone ID: LIB189-012-Q1-E1-G3
acccacgcgtccgaacacctcgcttcactagaggaataatcctagcagcttcggttgccctcaaaattgtccggaaaaaggatttgaagcattgtgagagggccctgagacgatggcgaacctgttcctcaagcaggcaaagcagtacgtggcgacgcggccggtctacccgccggagctcttcgacttcatcgcctccaagacccctcgccgcgacatggcctgngatgtcggcaccggcaacggccaggccgcagcgtcggtcagtcgaccatgcatcctcgctctcgcctacacggaacgctgcagacgcactgtccgtgcattatctttataaagtgaaggctggctgggtgaactttcattcaacttgcagctggcgaaactgta

SEQ ID NO: 19041 - DNA, 288 bp, Zea mays
  Clone ID: LIB189-012-Q1-E1-G8
gggtccacacacgcgtccgaccacgcgtccgcccacgcgtccgcccacgcgtccgcaaagagagagagaaacaatcaggggtccatccatttttgtcagccatgacgaacggctatctgttccgcgagtacatcggcgcgcagtccaccggcgtccagttctccgacgtgcccatcaacgccttcgttagcttccacttcatcctctccttcgccatcgactacacgcccgtggggcagcagccgaagccggtgccgaccaacggggtgttcagcccgttctgggaca

SEQ ID NO: 19042 - DNA, 175 bp, Zea mays
  Clone ID: LIB189-012-Q1-E1-H7
aaatatatatatatatatatagcagtagtataacatagcgtatgtttttagcggggggatcagtagtacacgtttgatgtgaatgatgtactcaactgaaagagagattgcacggcgaacctttgcgtctgttcttggccggacaggataattttcgattttctcgacccaaaaa

SEQ ID NO: 19043 - DNA, 118 bp, Zea mays
  Clone ID: LIB189-012-Q1-E1-H9
accacgcgtccgatactctgctatctcgccgtgatcgtgagtgatgattccgtctggttgctactgatacactattgttccatatcggttccatttgaaatatgcgttgttcttaaaa

SEQ ID NO: 19044 - DNA, 372 bp, Zea mays
  Clone ID: LIB189-013-Q1-E1-A9
gggtccacccacgcgtccgcccacgcgtccgcgagttcagatcgagcgcgcgccaagcaagtcttccggccggccgcgaagagagcaatcaagcaagacaagatggtgaagctcgccttcggaagcgtcggcgactccttcagcgtcacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctg

SEQ ID NO: 19045 - DNA, 293 bp, Zea mays
  Clone ID: LIB189-013-Q1-E1-B1
ttttgagaaaagtattctttattacagagtgctctgtcctggctcagaacaaattgtatgtaactttactaatagtttacaagctacatttctgtataaaaaaatactaatgatactttttccatcccaagtccggccggcaaactctgcacatgcatgtatggacctactgaagcttcggacaggccggggcagatggcgtcgacatggaacagaggctcgggtagcaagcttgcttcgacgccgggtcctcttccaacggaggcggcacctggccgtatatcatctcgcag

SEQ ID NO: 19046 - DNA, 363 bp, Zea mays
  Clone ID: LIB189-013-Q1-E1-B11
gtccaccgacgcgtccgcacacgcgtccgcccacgcgtccgcccacgcgtccgggaaagcagagagagcgggaaatcatggagctctgcgtctctacaactgcctccgtcggcgcaaccgccgcgccaatatccttcgccccgccccggcaaggcgcgtctgccttcaccgccctcccgctccaccgccgaatcccaactcgaggctggtgttgcgccagcgcggccgtgcctgacccggcgccctccgaagagctcgcatccgcctcctacaccgtcgtcgtcgcggacaagcccgattcgcctgccgatgacaaggtcgacgaggttagcgccgcgcctagtggctccgcggaggcgcccg

SEQ ID NO: 19047 - DNA, 338 bp, Zea mays
  unsure at all n locations
  Clone ID: LIB189-013-Q1-E1-B3
gcgtcgacccacacttccgacaacacacacccgacaacattaacacacacttaaaaaatcaatttcgttcattcttaaccttaacccaggaacctataacctacccaaaacaggattaataatggcggcttcaacggtggcaaccctctctttcccgttaacaacggcaactttcgcggcggcggcggcggcgggcggcgccgacgtgctgatcgtcgtcncgangaaggcgggcgcncggcgcgtcgtctggttccccgcggcggcgcgccgcggccgccggcggttggtcgccgtgcggtccagcgggccggccacgccgtcggagatctccgaca

SEQ ID NO: 19048 - DNA, 410 bp, Zea mays
  Clone ID: LIB189-013-Q1-E1-C1
attcacgggtcgacgcacgcgtccactattttatgctcgccatattcaagataatcgtgggattgatactgcgctgccttgcaaattggtatgtaaatctacggctcacaagaaaacaacacgtggattgagtacatggcaccacaattctgctgctatcgttacatctgtgagtagaaattttgctgtggtgcatgaagtgcagcaagcactgcagctgctgagagttatatgacagaagtattcatagtatagtacagcgcagatgaatattatagtctcttcttccaagggttttgtcgattcgaggaacagattagtcaaattttgtggtgtttagacttctgacctccgtttgtgcatagctcagcttcatccaaaactatctgctgtcacctaaccaagatgtt

SEQ ID NO: 19049 - DNA, 361 bp, Zea mays
  Clone ID: LIB189-013-Q1-E1-C10
tttttagcgtttatccaatacttcaaaaatactttgcgtccaaatgtggccttatttggtagctggtactacagatcaaataaataacttgtacaaccatcgaaccatcataattccacaggccacagctaatagaatatacatacaggacaaaatcagtgaatatgcaagttgctaccaacggataagctgtacaaaaaatcctcaaaaacgaaaaagagaagaaaaaaaaacataccatctcaacagacaacactcaccgcccacaacacttacatgagatgagcaataacaatctcaatctataaacagagcacagggcactgcataattccagccaacgcatttaccagcgccaatc

SEQ ID NO: 19050 - DNA, 418 bp, Zea mays
  unsure at all n locations
  Clone ID: LIB189-013-Q1-E1-C12
ttcacgggtccaccgacgcgtccgaaactgaaaaaaggccatacaacctcaaggaggcaaggtgataatacgggaaaccttggttggaccaggatcttcgccttgcaaccggaaaaccttgaaaacgcaatgctggtttgttcccaaaaccatgacaatcaacggtgtcaaccgaaatgaccaaaattggaaaaagataacctttgaacccgggttaacatcttacaagatcatacctgtcctgggcactcgatccataattgaagtctgcccatagaaaccaatataattaaggatggcaacagcctcccatcgcccttgcgagtataattccaaaccagcacttcaatacttgaatccgtgaggttttgaggtcacttacgtgtnttactcattgtacgcttttaaacaataacta

SEQ ID NO: 19051 - DNA, 400 bp, Zea mays
  Clone ID: LIB189-013-Q1-E1-C2
attaccgggtcgacgcacgcgtccacccacacgtccggggaacacgagtggttccagacacgcgcaagggtcttgtccgcgttggtaggggtgaagagggattagtccattttcagtggcttgaccgtggacagaacatagttgaagatgatcaaatcatctttcctgatgaggcggtctttgagaaggtgacagaatctcctggaagggtttacatcttgaagtttaagcaagacagcagaaaattcttcttctggatgcaggaaccaaatgctgatggggactcccagacttgcatgcaagttaatgcctacataaatcgatcattagatgctgaggctgatcttcgagtacctattgaagcagaaatgtctgaagatacggctgatgatgatatctc

SEQ ID NO: 19052 - DNA, 398 bp, Zea mays
  Clone ID: LIB189-013-Q1-E1-C4
cgtccagaaaattgattccttgtcggatccggccttgcaggaattctcggcggcctcaaatttgatacaccttgggttccgcgggaatatattgtcaagctttgggcttttacagtttgtaccccctgtcacactctgtgtgttggatttaagcggctgttggatcttaacaggcgatgctatttcaacattccgtaagcgtcatcctacgattgaattgagacatgagctcctgcacgaagttgaggaaaattttgttggtggttcccaatttcgtaaacctagacgcagacgatctcctcatgtgaaagcagaagttggaaacagttttgctggctcaagtaggctacacgatatccgttttgtagatgaaaggataaaatacagcaaggaggaat

SEQ ID NO: 19053 - DNA, 412 bp, Zea mays
  Clone ID: LIB189-013-Q1-E1-D1
gtcgacgcacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatggaaataaaaaaaataaaaaaaaaaaaataaaaatttaaaaaaagggggggcccttaaaaagttttcctttttattttttgttttctggaattttaatttttttcttttttttcatctactttttttttataggctctttttttttaaaatttttgtttttaaaaacctttgtttttttaaaatttttcccttttttaaaatttcctttttttaaaatgtggctttttttcaaagggtttctatttttttcccttttcaaaatttttccgggtctttatcttttt

SEQ ID NO: 19054 - DNA, 424 bp, Zea mays
  unsure at all n locations
  Clone ID: LIB189-013-Q1-E1-D10
ttcacgggtcgaccgacgcgtccgcacacgcatccgggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcncgtctatcttgctcagggcatcctcnaacatgacccct

SEQ ID NO: 19055 - DNA, 408 bp, Zea mays
  Clone ID: LIB189-013-Q1-E1-D2
ggtccagaattcacgggtcgacgcacgcgtccacctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgag

SEQ ID NO: 19056 - DNA, 255 bp, Zea mays
  unsure at all n locations
  Clone ID: LIB189-013-Q1-E1-D8
cggacgcgtgggcgctcaaggccctgggcaggcccaacgccgtggacgggaccatgtcgccgccgttgcgcgaggagttgatgattgcgtacaaggacgacgaggtcgtggacgcctgagtgcggcaagcagagaggaggatcgacgccagcagcgtcttatcttaattgccttgttgttcaatgatgaatcgatcgaattcccttgggttagctttattattgttgttgttattattaacaannannannnnnn

SEQ ID NO: 19057 - DNA, 416 bp, Zea mays
  Clone ID: LIB189-013-Q1-E1-E1
ggtccagaattaccgggtcgacgcacgcgtccgcccacgcgtccgaataattcagcggtcgtcgaatactgcaggacgtcaatggctgcgctttctgggagcaccgctggacttctcggcctcaccggtttcttcggtttcggcttttatgtattcgctgttgttggcctttggggacttttgatgctaaaagcaggttcgcaatggaaaaaatattttgttaatagacgggtcatactgaccaatggtttcttcggtggattattcacatacatcttgttttggacatttatctacggaatggttcacgtttattgagggaggatcaaatgtgccttttcattctgcatttttaatttaattatataccatttttatgtttgttgttctatttattacaataaaaagtccttttt

SEQ ID NO: 19058 - DNA, 435 bp, Zea mays
  Clone ID: LIB189-013-Q1-E1-E12
ttcacgggtcgaccgacgcgtccgcatctcttgaagcagatattgtacaagaagaggctcgcctgcacaccattgagaatgatgggctttccggcgatttcacatcatcatcttaggtatgatttcatctctttttatcttcttgtgcaacgggtgccacttctggtctcttgctatttggttaaccgacctatgatcacacgagccaaggacaggctgccagtgatcccaatgactgtaaccatgatttgtttttatcttgcattggtatcttgtatagtaatggttcagtgcatgatgcaaactaaacaatgtctatatagttgcttttatctttgccatggctattgtgggaactgggaagtatctagtcctgatgtgggaccttatatgttggcatctggaagatggtttttactggatggatactgttag

SEQ ID NO: 19059 - DNA, 427 bp, Zea mays
  Clone ID: LIB189-013-Q1-E1-E3
gtgccggtccagaattaccgggtcgacgcacgcgtccgaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgaatggt

SEQ ID NO: 19060 - DNA, 270 bp, Zea mays
  Clone ID: LIB189-013-Q1-E1-E9
accgacgcgtccgaaaaaaaataaataaaaaataaaaaaaaaaattaaaaaaaaaaaaaagattttaataaaactaaataaatatttaacggatgatataatgtaaagctagaaagtcttcatgtgagcttcgatggaatcgattcgggggtcggtcaccggagggcttagcttgagattccttcgagtttaaatgttacttattttcaatgggccctatatttaaattctctggccggggtttttgcaaattttcccttggaaatcccc

SEQ ID NO: 19061 - DNA, 130 bp, Zea mays
  Clone ID: LIB189-013-Q1-E1-F10
ggtccaccgacgcgtccgacgttccgttccttccgtccatccatccgccatggcgaccgctacgctactgagctcctccttcgccatgcccgccgccgcccgtagggcctcctccccttcctccgcctca

SEQ ID NO: 19062 - DNA, 414 bp, Zea mays
  unsure at all n locations
  Clone ID: LIB189-013-Q1-E1-F3
gcgtccacggacacgtgggtcgacccaggcgtccgcccacgcgtccgcccacgcgtccgatctcctcgctcccagtccccgggaagcatggcgtccgtcaccgcccgcgccccggtagcggcccttcgcccgtcgtcggcatcgctcaagtcgtcgtcggccttccttggccactctagccgcctcggccgcaccgcgtctcccacgaggcgcagcctcaaggcggaggccaagggcgagtggctccccggacttccctccccctcctacctcgacggcagcctggcgggtgacaatggcttcgacccgttgggcctgncggaggaccccgagaacctggcgtggatcctgcaggcggagctggtgaacggccggtgggccaagccttggccttggccgggaaggcccaccccg

SEQ ID NO: 19063 - DNA, 440 bp, Zea mays
  Clone ID: LIB189-013-Q1-E1-F9
ttcacgggtccaccgacgcgtccgcccacgcgtccgccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcatggtacttcgtacgcgtgtttggtgatcgatgtgtggtgtgtgtgtctctgcatggacattttcctactctgcgttttttctctctctactgatatagtatatatgtggtgtgtctatatatgtgtgcacgtggttttcgctcggctttttatcaacgctttgagaataaaagctttctcttcatctgtatattttatttttaatgaaagaaataaaccactatatatttcgacactcttaaaa

SEQ ID NO: 19064 - DNA, 212 bp, Zea mays
  Clone ID: LIB189-013-Q1-E1-G10
gtcgaccgacgcgtccgggaaatgatcgagtacatggataaggtcacgaaaacggttgccacggaggagcacacggtggaggaccccatcgacgagtccgttgcctagacgatcgtcattggaaccctccgtgcatcatggcgtatcacatcgtccatcgagccgacggacgagggtcaaggcgatgatgaccgtattacagacattatgga

SEQ ID NO: 19065 - DNA, 439 bp, Zea mays
  unsure at all n locations
  Clone ID: LIB189-013-Q1-E1-G12
tcgaccgacgcgtccggagaccaacaagcaacatagaaagtggaatccagtagcaacaatagagcaacaatggcgaccaagatattttccctccttatgctccttgctctttcggcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgattcaacaagtagctcctggcaaactttctcnctactctcagcaacaacaatttcttccattcaaac

SEQ ID NO: 19066 - DNA, 409 bp, Zea mays
  Clone ID: LIB189-013-Q1-E1-G2
ggtcaagaattcacgggtcgacgcacgcgtccgcccacgcgtccgcccacgcgtccgggattatttacaagcggtattcaagctcttatttttgcaacgttagccgcagcctatataggtgaatccatggaaggtcatcattgaattaactagtttttgaaatagtctttctttttttagcttagcccaattcatgcatgattccggataatcctcttagttggaaaactaaatagttcgaaaggcgtatgaatatacaacctagagttgtaggagagagaatagactatattatggaagaggtaaagtatatatgcattcaggggggccaagtcaggttagatctatatctttaatgcctataagacagtcatcttttgtgtggctttctaaagaatgattttagaat

SEQ ID NO: 19067 - DNA, 407 bp, Zea mays
  Clone ID: LIB189-013-Q1-E1-G9
agggagtggccaaccggtgataatctagctagccagcctcgccatgcctcgccagaggaccctcgcctccgcggcggcgggcgggcggctgctgctcgtggtggcggcggtcctgctgtgcctgtccgtgcctccggggcgcgcggcgcctccaggcgcggaggtcgcggagttccctgggttcacgggcaaactcccctccaagcactacgccgggtacgtaacagttggtcgccatgagcaacgaaagagacacctgtactactaccttgccgtctctgaaaggaacccaagcttggatcctgtggtcatctggataaatggcggtccagcatgttcagggtttagtgcatttctgcattcatttggaccttttcgaatggagggctcccaagttcatatcaacg

SEQ ID NO: 19068 - DNA, 438 bp, Zea mays
  unsure at all n locations
  Clone ID: LIB189-013-Q1-E1-H11
tccgaaattcacgggtcgacgcacgcgtccgattattatgataacaaacaaaaggttagcagctggcaacttccgccagaggtgtgtgagatcctcaagaatgcggaatctggttccttaaaagaaggttcaacttcactgcaggatgctgcaactatagagaataagggagtaataagcattgatgcaagtactcctgccatacagacaggtggccgtgattcgttgccacttcggcaaacagttgcccctgcatcgccatctccattggatttaataaagaagaaattgcaggatgctggtgcttccagtgcgccttcagctctggctacttcatctgctacctctgaattgaatggatccaaaccagctgatgctgcacttaaggggcaactagtggcgaataatggtgagaaattannnagatacaatggtgat

SEQ ID NO: 19069 - DNA, 420 bp, Zea mays
  Clone ID: LIB189-013-Q1-E1-H3
acgctgccagtacggtccagaattaccgggtcgacccacgccgtccgaccaacgacgatccgaccacacgaccttctcgcgactactgcctagcacaaccctgtacaacgcaatataccctgctaccatcggtcctgacgaaacaggaaaaccaccagtcacagacgcgctagcacgagaagatggagaactcagcggaccgatcgcagttgacgcctacgaagatcaaggtgttctaccagacgttcggcgtgtagaacaaggacatccacgagttcagccacaactgcaccagcaccctcgaccgcaggaactcctccgacgacgtcatgctccactacgagctgctcaaggacgacgtcagccacatagtctccggcaaggtgatcttcagcaccaactgcaactgatccagctaca

SEQ ID NO: 19070 - DNA, 314 bp, Zea mays
  Clone ID: LIB189-013-Q1-E1-H4
gggtcgacgcacgcgtccggagttgtggatcactgtcaaggtatggtagaaccaaggatctaggtatatatatgtgcctccatcatcatcggaccggaataaagctagcaatctctcttcttcacgatcgagagatagcgcgcgtgcgtgtaattaagtattatagattactacatactatatatatgtgcatgcatgatgcatgcgtatgtgtatctatatatcatgtgatggtttgtatatgagctagctatagctagagtcgtgtgtaatagcatactacaaactaagctaatacaatatccaagtttgct

SEQ ID NO: 19071 - DNA, 430 bp, Zea mays
  Clone ID: LIB189-013-Q1-E1-H9
ttcacgggtcgaccgacgcgtccgagctgcacgaggagattgagcagagggttgggggcctcagggagctggaggaagcgagcaaggaggagcagctcacaaagtgatcacgcgggcgaatgggctactcatcagctctctatctgagcttcgttagcaaataagttcagacttctctttactgccatgctcaagtctgtatatggccaaaacccaaaacgattgatcaactgcgctactgcagtgcaatagcaggatacgtatagttttcttttcaagggaaacaggaggggagtgcagtgcacccccgcccatactgcatgttattaataaaagaaagttatttacagaatcaaaaagtaaacaaaacggaatgagccccctgaaacaaaaccatgttaaaacccgtgctggtggccacatcaaaaca

SEQ ID NO: 19072 - DNA, 327 bp, Zea mays
  Clone ID: LIB189-014-Q1-E1-A11
ccgggtcgacccacgacgtccgagaggtggtggtgctcctgctgctgagtccaagaaagaagagaagaaagaagagaaagaagaatccgatgatgacatgggtttcagtttgttcgagtaatgcggtatacttggcatttggttttgctgtaccctttcgaaatctttatgtcgttgtttagtttgttgtattcgactatcttcttagactttgctgaaattctcaagagatttttttactcaaacatcagtccacttgtgattggcatttatatttcaaaaaaaaggatatgagtgaaagcgctggaaaaggccaaaaaagataac

SEQ ID NO: 19073 - DNA, 348 bp, Zea mays
  Clone ID: LIB189-014-Q1-E1-A5
ttttatttctacttaatgaataggcagtgcggttgccatttatatatttttctaaaaaaaacttaggtcatgcatggtaaacatatttggcatagctttgtttctccttgtgtataactacggattccttaaatttctgcaggatgaatggacaggggagcagaaggttcagtacagtgacataccagatgacatcgagccagaagagattaggccgatgggaaactatgcagtttctataacttggcctgatggatttagtcagatagcaccttatgaccaattggaaatgctggagcggttggtggaggctccgagtccagcagcagcgtctgcagtggcctcgtc

SEQ ID NO: 19074 - DNA, 312 bp, Zea mays
  Clone ID: LIB189-014-Q1-E1-A9
cccgggtcgacccacgacagtccgagcggatcatcgtgttcaccaccaaccacgtcaagaagctggacccggcgctcatccgcagagggcgcatggacaaacacatcgagatgtcctactgcggcttcgaggcgttcaagttcctggccaagacgtacctcgacgtggactcgcaccctctgttcgacgccgtcggcgagctactccgggaggtggacatgacgccggccgacgtcgccgagaacctcacgcccaagagcctcgacgacgggccggactcgtgcctcgcggacttggtgaaggcgctggaag

SEQ ID NO: 19075 - DNA, 413 bp, Zea mays
  Clone ID: LIB189-014-Q1-E1-B2
ggtccagaattcacgggtcgacgcacgcgtccgcccacgcgtccgtatctagatcgagagctgccttgtctgcacatgcaaaaccgccaaaagcgagcgcctcatgtctttatattgctctcaaaccctccgtttctcgctccaacccactgccactgtacttgtgttgtgttgtgttgtgtgctgcaagaagaagaggaggaggaatagcatgtgctgagaagcctgccagcgcgctttacgacaagcatatatgggggagatcaccaagcctttgcgaagcagaagcttccgaagatggcctacgactactacgcgtccggcgccgaggatgagtggacgctgcaggagaacatggacgccttctccaggatcttgagcagcggttgatgagataagattgccaagaaacg

SEQ ID NO: 19076 - DNA, 417 bp, Zea mays
  Clone ID: LIB189-014-Q1-E1-B4
gggtcgacgcacgcgtccaccctgcaaaggtgaaggcatcaaaggcttctgcaaaaaacggcaccgcaactccagctatttcctacccggcaaaggtggcccaagcagcaacagaaaaacccgtgctcgccaacggattccctaaaaccggttagctggaccgcccaactgatgctccatacctacccgcaagcaacggtcaacttccccaagagctcgactgaattgctgtacaagggaactattgaccaaccaaggcaggctgtggaactgggcaggcatggcgccctagagcgttgcggctccatctcgtcgctgccggagagcagctggctagctgttagcgttttccctagtttctctctctccctctctctctgtcgctgtgttccccgtttcagtttccttatagcccga

SEQ ID NO: 19077 - DNA, 295 bp, Zea mays
  Clone ID: LIB189-014-Q1-E1-C11
gatctgctccacccatagctgcagttgtggctgcacgtacttgttgagctgttgtgttgtgtccatctcggtactttttgatttgttattagtagtaactgtgatgacgatgcatgggctgctctgtcttctgcagctctagcattacactcactactacgtgtgcgtgttgtaccgttttgtattgagtggtgacttgaacgtggcgctggtgatttgtactaccttctataaataaaagttgaaaaaaaattacaaaacattgaaaaaatctctgcaaaagaaaaatgtgggg

SEQ ID NO: 19078 - DNA, 462 bp, Zea mays
  Clone ID: LIB189-014-Q1-E1-C2
acgctgcagtacggtcaagaattcacgggtcgacgcacgcgtccacccacgcgtccgaatgaatttgctgattaccataataggatgcttcaggaggatttggaaaaactcaggaatcttcaccctgatgtaaccatcatttatgctgattattacggtgctgcattgaacatattccgtgccccactcaagtttggcttcacagtcccactgaatgcgtgctgcggaagtgacgctccgtacaactgttccccttcaatactgtgcgggcgtcctggatctacagtgtgccctgacccatcaaaatacatctcatgggatggtctacacttcaccgaggcgagttacaaagttgtcatccaaggagtactaagggggtacgccaaacctcctctttcagaagcctgcaaaggtgcggagttcaaagtttctcaactttcacaatgtacagataatccaaca

SEQ ID NO: 19079 - DNA, 409 bp, Zea mays
  Clone ID: LIB189-014-Q1-E1-C4
ggtccagaattaccgggtcgacgcacgcgtccaaaatggtccagtgttttataaagaaggaataagtcaaaatccacttacgggcctctacttgtgccttaccaatgttgttacttcagaaagtgggaaattcctcttatcagctatgcgacaccgcttaaccacatggaccgagtatacaatatcaatggattctggcaacatctcaggatcaaaattaacctacattggaaaaataacgtctaacttcctaggcacaagatttttaattgatgatacacaatccccctataatggggctgtaattcctcctgccggaaggaccaccacgaggttcaactccacaaaagtctctccaaagctgccttcagtcagttataacatcgcacatgtatcgtatgagctaaat

SEQ ID NO: 19080 - DNA, 107 bp, Zea mays
  Clone ID: LIB189-014-Q1-E1-C7
cccgggtcgacccacacgtccacccacgcgtccgacagcacatcgatcgacgacgatatcgggaagcaatatggggttggccttgtcgcggctggaggagattagga

SEQ ID NO: 19081 - DNA, 434 bp, Zea mays
  Clone ID: LIB189-014-Q1-E1-C8
gacccacacgtccacccacgcgtccgacagcacatcgatcgacgacgatatcgggaagcagtatggggttggccttgtcgcggctggaggagattaggacgcagtaccgcatggcagcggaagacggcgaggctgacagtccggcaccggcgccagtgtcgccgaccggtgctgctgctgcttccggcggcggcactgagaagaagaagcaggcggacgactcgtcgtcgtcgtcaaagacgacagaatgggttcctcataagttctctgagatcgtcggtcaaagacgacctggtgaggatatgttccgagggatcgaccttccacgatcggatcagcagccgaaagcaaagaagtactgggtacatgggagaaatgcaaactgcctcatgctgttccctaaaggatcagcatcacctggggttcggacgcaa

SEQ ID NO: 19082 - DNA, 299 bp, Zea mays
  unsure at all n locations
  Clone ID: LIB189-014-Q1-E1-D1
gtcaagaattaccgggccgacccacgcgtccacccacacgtccgcccacgcgtccgggtgtangtgtactcaccagggcatcattctgggggaagggatcgagttcctctgcctcttctgttgctttcaactcctctggagaggcatgaaaatactcaacttgctgcataagactacttattactgtacttggggcctgggggacaaaatttctctccatgactactagtctactaccatgtaaatgtangagtttatattatatcctgcaatatatactacctattatctacagtatt

SEQ ID NO: 19083 - DNA, 430 bp, Zea mays
  Clone ID: LIB189-014-Q1-E1-D2
gtgcggtccacaattaccgggtcgacgcacgcgtccacacctggagacatgcattccacatcctgcgaagcaacatcatcaatgcttgccatgtcaccagaacaggctgcgcttttccacattaccgagagcttccgctatgccgcgcttctttacactgagcgcctagcgcagccgactcttcccgcttcagctctgaacttccaaaacttggtatcacagggactttaccacatttctcagattggtatgacgagctgcgttaacaagttcctactatggccattattcattattggcacggaatgcgttgaccctgaacaccgcgctgtggtgcgacaacgatgtgtggagattcaacgtgagagcgggttcttcaacaatctcagtggtctagaagtgctcgaacgagtatggcgcgaagatgacg

SEQ ID NO: 19084 - DNA, 271 bp, Zea mays
  Clone ID: LIB189-014-Q1-E1-D3
gtgcggtcaagaattcacgggtcgacgcacgcgtccgaaaagagtgcctcggtaaattgggagcttggaggaagtggacaaggtggagaaattcctggcttgaatgtccctgcttcatgccagagctctctcatcagatggactccccaagacatcaagtttagggagggaatatgtactctctctttcccaccccaaataagtcttcttcgtctcatatttcgataaatcaaacaatctcaattttgatctaatatatacacacaacatt

SEQ ID NO: 19085 - DNA, 437 bp, Zea mays
  Clone ID: LIB189-014-Q1-E1-D4
ggtcaagaattaccgggtcgacgcacgcgtccaccggcataatccggcggcataggctaagaaagggttcctgcccgtcgtcgacaagaaggctggctactctttcctctacccgttcggatgggaggaagtggctgtgcaagggcaagacaaggtgtacaaagatgtgatagagcctctcgagagtgtgagcgtcaactctattccaactagcaaggaggatatccgtgatcttggtcctccggataaggttgccgaggctctgattaaaaaggttttggcaccatcaacacagaagacaaagttaattgaggcgaaagagaatgatgttgatgggagggcttactacacttttgagttcacagctcaggctccaaactacaccagacatgcacttggtgctattgtaattgcaaatggcaaattttacacattga

SEQ ID NO: 19086 - DNA, 431 bp, Zea mays
  Clone ID: LIB189-014-Q1-E1-D7
attcccgggccgacccacgcgtccacggacgcgtgggtgctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgcctgacaagggcgggctga

SEQ ID NO: 19087 - DNA, 420 bp, Zea mays
  Clone ID: LIB189-014-Q1-E1-E2
attaccgggtcgacgcacgcgtccagcaacaccgcaatcagactctgccatgtttttcttcataacaaataagctcgggtttactccaaaatttctaggacgcgttacgcttgtcaaatctgttgcatccttactgggaatcggagtgtataatttgtttctgaaggaagttccattgaggaaaatctttcttgtgacaacagtcttaggttctgctctcggaatgacacaggttcttcttgtcactgggctcaaccggaagcttggcataagcgacgaatggttctccattggggattctttgattatcacagtcctcggccaggcttcctttatgcctgtcctggtgttggctgcaaagttgtgccctgtgggagcggaagcaactttatttgccactttgatgtccatctctaacgc

SEQ ID NO: 19088 - DNA, 309 bp, Zea mays
  Clone ID: LIB189-014-Q1-E1-E4
gtcaagaattcacgggtcgacgcacgcgtccacggacacgtgggtgcgaattgggaagagagtttttagttagacgagcttttgatggccctaaagatgttttcccggatgatgtttgtgctgctggaccgtttcctgttagcttcgatggcatcctccccatatcgataaactgttgcttaccctgacaatcggaagagtttaaatgttaaagatttaaaaaaaaataaaaaaaaaaagttctataaaaaaaaaggacgcaagcagctcgaaaggaataaaacaaaaactcgtcctccatggtagatc

SEQ ID NO: 19089 - DNA, 389 bp, Zea mays
  Clone ID: LIB189-014-Q1-E1-F10
ggtccacccacgcgtccgaccacgcgtccggcatttacttatatacaacgagtcatgtagctgtgatgtaacttcctctaacttggtgccatgtggactggagtcaccgatgtgtgctgccaagtgtctggcccaaccgttgaacacgtggagagatgctctccatatctttagaggaggatataaggtgatttgatgatttatttattaagtgtttgtacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccccaaaaaaaaaaaaagggggggcccccccaaaggtttcccc

SEQ ID NO: 19090 - DNA, 396 bp, Zea mays
  unsure at all n locations
  Clone ID: LIB189-014-Q1-E1-F4
attcacgggtcgacgcacgcgtccgcccacgcgtccgcccacgcgtccgcccacgcttccgcaagcaggaggcggacaaggtaagcagcaatcccaggaaccctaccgccgccgaacccgcaggaatgggtatcgacctcgtccccggtgggaggaataagaagaccaagcgcactgcgcccaagtctgacgatgtctacctcaagctcctcgtcaagctctaccgtttcttggtcangaggaacaatagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaagga

SEQ ID NO: 19091 - DNA, 463 bp, Zea mays
  Clone ID: LIB189-014-Q1-E1-F6
taaaggtctaaaattcccgggccgacccacgcgtccacccacgcgtccggccggcgcctcccacgtctccagtccgacactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccgggccaatacctcctgattcgcgttaccggcgaggagctcaagccggcgtacatggtcatctcc

SEQ ID NO: 19092 - DNA, 384 bp, Zea mays
  Clone ID: LIB189-014-Q1-E1-G12
aagctctctgctagcacccatcttgcagcaggcggagccgcccgacccgatccgtgcgtgtgtgttggtagagatggctacagcagcttacgctcccatggcgagccaggtgatgaagagcatcccggtgcactcgaggccgaggggcctgtcaggcgctgcgctcacgcggccccggccccggttcagcgtcgtcaaggccgccatccatcccgagaatgcaacgtaccagctggtgcagcccatcaacggcgacccgttcatcggcagcctggagacgcccgtcacctccagcccgctcatcgcgtggtacctctccaacctgccggcctaccgcaccgccgtgagcccgctgctgcggggcgtccaggtcagcctcgccca

SEQ ID NO: 19093 - DNA, 353 bp, Zea mays
  Clone ID: LIB189-014-Q1-E1-G6
ttttgactaatttctttctttttcctcgagaaacatcatatcatttcacccttatgtacctgacaatattacactggaggtaaacctaggcagtcaaggtacagggaaaaaaagaacaagaaaccgtttgcttctttttctttcccgttgcggttctagggcacaacttcgcaagtgtcgcagatatccagccgacgaaggaggttaggctatcggtgcctcgccgggagcccaccgctgccgctcttgcggatgaaagcgtttctgctcttcggctttggtatgtcattgatgtccatcacttggattgtcctctgctttttggcattttgtgcttcttggtaattctccct

SEQ ID NO: 19094 - DNA, 357 bp, Zea mays
  Clone ID: LIB189-014-Q1-E1-G8
ttcccgggccgacccacgcgtccagatggccagcctcaccgacctcgtcaacctcgacctgagtgactgcaccgacaggatcatcgccgagtacatctggattggaggatccggcatagacctcaggagcaaagcgaggacggtgaaaggccccatcaccgacccgagccagctgccgaaatggaactacgacggctccagcaccgggcaagctcccggagaggacagcgaagtcatcctctaccctcaagccattttcaaggacccgttcaggaagggtaaccacatccttgtgatgtgtgactgctacacgccacaaggcgagccaatccccaccaacaagaggtacagcgccgc

SEQ ID NO: 19095 - DNA, 385 bp, Zea mays
  Clone ID: LIB189-014-Q1-E1-G9
ttcccgggtccacccacgcgtccgaactctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagacattgagggatggactgcaaggctgctcccg

SEQ ID NO: 19096 - DNA, 454 bp, Zea mays
  unsure at all n locations
  Clone ID: LIB189-014-Q1-E1-H1
attcacgggtcgacgcacgcgtccgaggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattaagcaactcagacaaagaacgagtgctccaatcaaagatgtcaaggcctctctagttacctgcaactgggatattgaggctgcacagaaggacctaaggaagagaggtgttgctcttgctgccaaaaagtcttcacgcactgctgctgaaggtttgctagctatcgcacaagatgacaanaaggctgctgtagttgagcttaactgtgaaactgatt

SEQ ID NO: 19097 - DNA, 372 bp, Zea mays
  Clone ID: LIB189-015-Q1-E1-A1
gacccacgcgtcaggactagttctagatctgagttagccggcggatccgatccgtgcgcgtgcagtgtgtgtgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaagtggtgcagcccatcaacggcgaccccttcatcggcagcctggagacgccggtcacctcgagcccgctcgtggcgtggtacctctccaacctcccggcctaccgcaccgccgtgagcccgctgctg

SEQ ID NO: 19098 - DNA, 227 bp, Zea mays
  Clone ID: LIB189-015-Q1-E1-A2
cggtcgagatttcccgggccgacccacgcgtccacgccagtacgccaccaccaccgagcctggactaccgccgccgcccttcgccgatatcctcagcggcgaacagcgcccaacagatcccgcccctgcgatggagtccgtggtgaacccgaaagcatacccgctggctgatgcgcagctgacgatgggtaccctcgatatcatccagcaagccgccaactacaaac

SEQ ID NO: 19099 - DNA, 183 bp, Zea mays
  Clone ID: LIB189-015-Q1-E1-A3
caaccaaccctggaataccgccgccgcccttcgccgatatcttcaccggcaaaaaccgccaacaaattcccgcccttgcaatgaattcggggggaaacccaaaggcattaccacatgctaaaggcgaagcaaaagggcggccgccccaaaggatccaagcttacttacccttgcatgcaactt

SEQ ID NO: 19100 - DNA, 363 bp, Zea mays
  Clone ID: LIB189-015-Q1-E1-A4
cggtctagaattcccgggccgacccacgcgtcaggggcaagggcaagggcgtgtaccagttcgtcgacaagtacggcgcgaacgtcgacggatacagcccaatctacaacgaggatgactggtctcccaccggcgacgtcgacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcagggtgtctgtctataatctagcctccatggatgctcaaccttcgtcatgtaacaataatcagtgctactcttc

SEQ ID NO: 19101 - DNA, 296 bp, Zea mays
  Clone ID: LIB189-015-Q1-E1-A6
ccaggtaccagtctagaattcccgggccgacccacgcgtcaggaccccaacttcttctgagcggccggctgcgggcatgttcttgagcctgcctgtattctactccgtgtgtgttgagccatatatctgatgctcaaggattggttaatttgaacaagtggtgcaactgcgcgtgtacatggatttgctcttcctctatgtctctgtcctctgtctccggttactttccctgtttcactatgccatgcacatagacattgccatgttctgctgccagctcagggcttgtgaataac

SEQ ID NO: 19102 - DNA, 106 bp, Zea mays
  Clone ID: LIB189-015-Q1-E1-A7
cgggccgacccacgagtcagcggacgcgtgggcggacgcgtgggttttttttgtaaggtacctacaggtttggtcatatgataatttctccggaacggcatacctt

SEQ ID NO: 19103 - DNA, 401 bp, Zea mays
  Clone ID: LIB189-015-Q1-E1-A8
aattcccgggtcgacccacgcatccgcttcaggttgccacttacatactgtggaagaatgtaccccagggagctgcaactacttgctacgtaggactgagccctcaactcaagggagtgacaggaaagtagtttgctgactgcaacgtggagaagacgagcaaactggcgaggagcgaggagttggcgaagcagctctgggacttcagcgaggagctgatcaagtctgcgaaatgagagccgaaaatgttgtggtcctgcttggcatctagtggtacaagtgatgactgattagtatatagcacggaggaacctgggcgatggctggacctcatggtgttcaggaataaaatctgcttgctttcgtacattaattagtccggtgtggcaaacatcaatttg

SEQ ID NO: 19104 - DNA, 408 bp, Zea mays
  Clone ID: LIB189-015-Q1-E1-B4
ggtcaagaaatcccgggtcgaccacgcgtccacccacgcgtccggagaggagctaccaggctcacatcgcgggttcgcaccacttcccaaccggaaccttcaaggcccgaatcccgaacctgttccgggccccaaccggaaaggaaacctcgttttccaatgggcccctaaccaagtacgaggtccaacttgtgctcggatgttctcagactatctatcggagaccaaggaggattcagggataaagaacatcatggtactggagcgcgggtttaacggatgggaggtttcagggcagcctgtctgcagctgcaccgacgctcattgcaaagggacttgttcttaagcacacgagtttatatctctcttaagccttgaacaaccaaggatcggcatggtctccgtttc

SEQ ID NO: 19105 - DNA, 376 bp, Zea mays
  unsure at all n locations
  Clone ID: LIB189-015-Q1-E1-C3
cggtctagatatcccgggccgacccacgcgtccacacccacccacccactcgcttcagccgcctccgccgcgcgtacaagcaggtggagacaggatgccggctggccacggcctgcgctcgcggacgcgcgacctcttcgcgcgccccttccgcaagaagggctacatcccgctcaacacctacctccgcacctacaagatcggcgattacgtcgatgtcaaggtgaacggcgccgtccacaangggatgccgcacaagttctaccacggncgcaccggtcgcgtctggaacgtcaccaagcgcgccatcggcgtcgaggtcaacaagcaggtcaatgggcgcatcatcaggaagcgtatccatgtccgtgtggag

SEQ ID NO: 19106 - DNA, 73 bp, Zea mays
  Clone ID: LIB189-015-Q1-E1-C4
cctaaaggatcaaagcttacgtacccgtgcatgcaacgtcaaaccccttcaaaagtgtcaccaaaattcaatt

SEQ ID NO: 19107 - DNA, 450 bp, Zea mays
  unsure at all n locations
  Clone ID: LIB189-015-Q1-E1-D3
ggtctagaattcncgggccgacccacgcgtcagcggacgcgtggggatctgtgacttcgacttcgagccctgtggctactccatgaatgctgttcatggccctgctttgtcgaccattcatgtgaccccagaggacggcttcagctatgcaagctacgaggtcatgggcttcaacccgggctctttctcttatggtgacctggttaagagggtgctgaggtgctttggtccaactgagttctctgtcaccgtgaccatcttcggtgatcgggacaatgcgaagacctgggggacgaaactggatgctgaggcctatgcttgcagcaacatggttgagcaggtgctgccgtttggtggcttgctcatctatcagagcttcactgttacggccgaaacgacccatgggttcgccgaggtcagtcctgcatgacttcgctggtgacattgtca

SEQ ID NO: 19108 - DNA, 417 bp, Zea mays
  Clone ID: LIB189-015-Q1-E1-E1
cggtctagaattcccgggccgacccacgcgtcagcggacgcgtggggtgctcagttaggaactgcgccaagttgccaacgtcgctcggtccaccccctagttccagcatagatgagattggaggatgggggacagtaccaacactggagtcactaggccccagtgttacgaagtctgagaaaggaatgcatttcataggaggagagagcgcagctcttggtagggtacatgagtacttctggaagaaggatcagctgaaagattacaaggtgaccaggaacggcatgttaggtccagactactccacaaagttctctccttggcttgcttctggcagcctttcgccgcgttatatttgcgaagaggtgaagagatatgagaagcaaagagtggcaaatgattcaacatattgggttt

SEQ ID NO: 19109 - DNA, 420 bp, Zea mays
  unsure at all n locations
  Clone ID: LIB189-015-Q1-E1-E2
cggtctagaattcncgggccgacccacgcgtcagctcactgcagtcacacatcacacatcccatcttctgacatccccccatctctctgcaaaactcgcacaaccggtcgccaaactgcggtatccacatctctccggctccaacatggacttctccgacatctttcgcatggtgaacttcgccgtcgccgccttcattgttctcggcggtgttgcgaaattgttccctttcaacgatttctcgcacatcattcttggtgtctacctgatcatcttcggcgctggcactgctcttctcgaattccagatccctccacagatcgctcgttatgcctcgttcatgttctctttcctcggccgcggtatcttttacgtttttatcggttgcgtaactgtcggctctggctggtatcgctacat

SEQ ID NO: 19110 - DNA, 370 bp, Zea mays
  Clone ID: LIB189-015-Q1-E1-G5
gtaccagtccagaattcccgggccgacccacgcgtcagggtatttgaaccatttgggcaagtagagcttgtacagcttcctgtagatccaatgactggattgtgcaaaggttatggttttattcagtttgcacggcttgaagatgcaaaagctgcacagagcttgaatgggcagcttgatatcgctggcagagttattaaggtttcaagctgttacgatcatgtgggaatgcaagctagtggagcaactactggagaattagatgacgatgaaggtggaagcttggcactaaatgcaagttccagagctgctctaatgctcaaattggacaggagtggtactgcgaacagcttaactggtggtattggtg

SEQ ID NO: 19111 - DNA, 354 bp, Zea mays
  Clone ID: LIB189-015-Q1-E1-H1
ccgggccgacccacgcgtccacggacgcgtgggtgcgcctctacatttcttctctctctgctcctccccctccgcctgattcatccaagacaaggattgccaagtccgactcggaggaacaacacttcgaatccaaagcccaagcctgggcgtccaagacctacccgcagcaggctggcaccgtccgtaagaacggcttcatcgtcatcaagaaacgtccctgcaaggttgtggaggtttctacctccaagactggtaagcatggccacgccaaatgccactttgtcgccatagacatattcaatgggaaaaagcttgaagatattgttccttcatcacacaactgtgacattc

SEQ ID NO: 19112 - DNA, 344 bp, Zea mays
  Clone ID: LIB189-015-Q1-E1-H6
ggccgacccacgcgtcaggagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcaaggcgacgaagatcaagcttacaggaaaatcaggctccgtgctg

SEQ ID NO: 19113 - DNA, 265 bp, Zea mays
  Clone ID: LIB189-015-Q1-E1-H7
caggtacctatctagaattgccgggccgacccacgaatcagcccacgcgtccgcccacgcgtccgcccacgcgtccggggagcaataccatagcccccggaaactgctgctcgccatgatcgctgaagtccgagagctgtcaaagctgttcatgtggaaaggggaggtgctcacgggcctcacggactgagacgatgagggcaacgagcatctcgactatgagctctccgacgtgctgctctatctggaccgcctctccgacatg

SEQ ID NO: 19114 - DNA, 445 bp, Zea mays
  Clone ID: LIB189-016-Q1-E1-A4
ggtcctaaattaccgggtccacccacgcgtccggcagccagctacactgtgccaaaccgtgctctctggcaggcatcatttgatgctttctttgggcttctaacaaaatactgtgtcagtaagtttgaaagtatccaacagatgtttgtcacacagacaccgagctcaggaatcggacctgaggcttccaaagctactagtaaggagatgcctgttgagctacttcgtgcaagccttcctcatacaaacgagcagcagcgccagcggcttcttgattttgctcagagatccatgccagtaacaggtttcaatccctcaggtgctagaggtgggcacatcacttcagaatctgttcctggatgatgtaactgaaggagacacacaagggcaaagagtcaatgcttttaaacattgatgagatgggtctcagctgataattgttgta

SEQ ID NO: 19115 - DNA, 233 bp, Zea mays
  Clone ID: LIB189-016-Q1-E1-A7
gggtcgacccacgagtccgattgggtcctgcctaggccccatagatatagctcttttttgagaaggaagagagattaattcagcagcagcttttataaattctttgttgtcatgaagcaggtggttcttttgtagttgatgaaagggatttgtcgtcgctatcgtttacataattcagacaataattttatattgtgtaattctgagaatcaaagcactgtttgtgttatagc

SEQ ID NO: 19116 - DNA, 395 bp, Zea mays
  Clone ID: LIB189-016-Q1-E1-B1
ggtcgacgcacgcgtccgaccacgcgtccgcccacgcgtccgcccacgcgtccgcacacatgcatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaagaggggccatggggtttcggccacgctggcacggagtacaagattgatctgtgcaggttcgacgagagcttgacggagatctccgggaccacgggcccagcctacaacattgacaatctggtcaagtctcccaaa

SEQ ID NO: 19117 - DNA, 400 bp, Zea mays
  Clone ID: LIB189-016-Q1-E1-B2
gtacggtcctacattcacgggtcgacgcacgcgtccgaggacgcgtgggtcagattcagatcagatcgtagcagccaaggattccgcgctccgggggtgccatgaagctgaagctcctctctccctgccttctcctcctcgccttctttgccaccgcggcgtacgcggcgtcggggtcgcgcgcggcggccgtcgtcaggggcgcgggcgccctgtcgcagtcggagttggagttcggaccggagaaccagtgcgtgtacacggtgtacgtgcggacggggtccatctggaagggcggcacggactcgaccatcggcgtgacgctgctgggcgccgaccgcacgggcatcgggatccgggacctggccgggtggggccgcctcatgggcgccgggcacga

SEQ ID NO: 19118 - DNA, 302 bp, Zea mays
  Clone ID: LIB189-016-Q1-E1-B3
cgggtcgacgcccgcgtccgaaccataccagaccagaccagaccaatggccctgcgcctaccaatctcatcgtcccacgggctggcctccacgccggcgccaatctccacgacgacgtgccggccggccgtcttggcgacagccgcggcccagaagaggagcctgctgccggcgactgcctccgagacgaggggagtcgcgccggtgaggtccagcgggatcgagacgagcacggtgggtctgggatgtgaggccgtcaccgggcaggtcacggaggtcaacaaggacaccttctggcccat

SEQ ID NO: 19119 - DNA, 471 bp, Zea mays
  Clone ID: LIB189-016-Q1-E1-B4
gtgcggtcgtaaattcacgggtcgcagcacgcgtccgaccacgcgtccgaatattttgagcattcagaaacacaccaagcgaagcacattagcaacaacctaacaacaatggctaccaagatattatccctccttgcgcttcttgcgctttttgcgagcgcaacaaatgcgttcagtattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgct

SEQ ID NO: 19120 - DNA, 424 bp, Zea mays
  Clone ID: LIB189-016-Q1-E1-B8
cgggtcgacccacgagtccgaggacgcgtgggcggacgcgtgggcggacgcgtgggcggacgcgtggggcacaaccccggcggcaaggagcggtacgagcgcgagttccgcgagctcgcaaagggcgccggcttctccgggttcaaggccagggacatctacgccaacgcctgggccatcgagttcatcaagtgaaccaccgtcgccgcgatgagatggcatggctgccacatgctttgcttgcttggtcctcgtatcgtacgtcgccgtcgtcgtcttcttctggttattgcgctgctacctcgctgctctcgcgtatgcatgtacttttgcctaactttctttcttcataacatgcactctggctggcctagactgcccccgattcatggtggccggtacgtcttgtcgagctcttgcatgt

SEQ ID NO: 19121 - DNA, 338 bp, Zea mays
  Clone ID: LIB189-016-Q1-E1-C1
cgggtcgacgcacgcgtccgaaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctc

SEQ ID NO: 19122 - DNA, 292 bp, Zea mays
  Clone ID: LIB189-016-Q1-E1-C2
cgcacgcgtccgaacacaacgagaaatgatagcgtcctgatcgtcgccctcatcggcacccaacaccgcctcgggcacatgattcggcaccttgacgatcggaagggagctgcactcgccatgtacgtccctcttctgcgcaactcccgcgtcgacactcttcatcaggcccaagcctgaacgctgtagccatagccgcgatcgcacatacagcgtcacctcccaccttgcggtgtcgcacgatctcccccaaggtcagaggcctcaacatctggaaagacttaacccagct

SEQ ID NO: 19123 - DNA, 385 bp, Zea mays
  Clone ID: LIB189-016-Q1-E1-C3
gggtcgacgcacgcgtccgttccaagttaacgtctgagaatgcatctttgctgaagcgactggctgatatgactcagaaatacaaggacgcttccgttgacaataaaaatctaacagttgatgttgagactatgaggagaaaggttcgttcgtcttgaatgcatcacagacctttttcttctttttgttgtacgagagctcttaactgcatccatttatcgatcataacatttttactgggctctgcgtatactcaccgtaatcaacgtttacatctctctagatggctgcaaagggcagtgaaagtaatatgattgctcatagttcttattttagaacctgcaagtacagttttagtttccaatggtttttaactgcacccaaa

SEQ ID NO: 19124 - DNA, 424 bp, Zea mays
  unsure at all n locations
  Clone ID: LIB189-016-Q1-E1-D1
cggtcctaaattaccgggtcgacgcacgcgtccgacagccaccagaggatctgaattctaatccggtgtttgctgccatcaaatcaaaggtcacagataacctgaccaagcatgcttctcctgagacccgatctacaccaggtcaaccatgggttagaggatgggacgacataaagaaaggcaaagatggacccaagtatggaaatcagtgataagctgcttgaaatggggatgacggctttccatcctaaataatagctgtccgcccaccccaccccccaatatgcttgttttgtgattgtgtagaatanagtgaactgccaccggcatgtgtgaagtttgttaaattgtagaatcagcttgtaactatggatggtactcctgatgtttgcctggcaattccagccttccaggtatcgtctaa

SEQ ID NO: 19125 - DNA, 402 bp, Zea mays
  Clone ID: LIB189-016-Q1-E1-D2
cggtcctaaattaccgggtcgagccacgcgtccgaatgcaagcaacaggaaacggatttcggagtcgccgcttcactgtagactggccactagttgttcacagcccgagcgtggctggattctagaaattggaaaccccactaccttgttgtcatgctgtgtgacacacgtagtacaaaggtcgtcttgaacaacatgactgcacatgcagcagagaggatatttcgtgacctgaaaatgtcagcatctgctgttctgtactgtgcctcattggcgttaacagtgcataggtatttgacatgcataaatgaccgtgcaagtatttgacttagactgacgaagacttgtacgacggcatttcatttaggaaaataagaaactccaaacagagttgaaggaaaa

SEQ ID NO: 19126 - DNA, 433 bp, Zea mays
  unsure at all n locations
  Clone ID: LIB189-016-Q1-E1-D3
ggtcctaaattaccgggtcgacgcacgcgtccgtacaggttcctggttcaaccacatacagcttagctttgtattatatgatggatacaccattataaaaggtccctctgcttgaaagatttgtaaatggagatgatgcattcagaaattcaaggttcaagctcattccttacatctcaaagggatcttggattgttaaacagagtgtgggcaagaaagcttgcttggttggacaagcattagaaatcaattattttcgtggaagaaactatttggagcttggagttgatattggttcatcaaccgtggcacgaggtgtggtgagcctagtgcttggctacttgaacaatcttgtgatcgaaatggcctttcttgtacanggaaacacatataaagaactccggaattcctcctaagtacctgccgactgaat

SEQ ID NO: 19127 - DNA, 460 bp, Zea mays
  Clone ID: LIB189-016-Q1-E1-E4
gggtcgacgcacgcgtccgaccacgcgtccgcagaatctgagatatctggacacaaacctggagatcatgtgtggacagcagggagcactgcctatggttgagaagttgacatgccgtgccagcatggggaagtatgttgccttcgccaggagcagcatgcctttcgacgatggcagcgtggtgaatcctgctgctgttgctgaggcagaattgccagtaattctacctttggacattggctggcccgtgaacatgccttgcctccggggcatcacctatttgctggactaccaggactgcagtgccaaggagtgggctcatgtggagacattgctcatgcacgtgagaaaaatccaccccaactgtccacccttccgaatcaaaaagaaccgcagagacaaggagattactatgatcgacgcaatcatctaccttgaagatgtcaaggatgtgttcaag

SEQ ID NO: 19128 - DNA, 321 bp, Zea mays
  Clone ID: LIB189-016-Q1-E1-E5
tctgctttaggccgtttgaaaaaaaagacaagtacatggatatgtacttgctttgccattttggatcctagatgatgttgttcaggttgagaattgagataatcagaaggaatgtatagcttctgctagtagttttccaagtcaggaggttgtctataactttgatttctgcaactgaatcccaagtgtggaactgcaaattgctgaaaagtttagactgtttaaggtggttatataaattgctgccctgcaagtttctgcaaagcaattaaggctttgttcatccttcgaaatatgggaattttatgttttgtgaaaaat

SEQ ID NO: 19129 - DNA, 272 bp, Zea mays
  Clone ID: LIB189-016-Q1-E1-F1
ggtcgagcacgcgtccgacgggtgcaggaccaggctcgcggaagaccgcctgtcccgcttcgagaagcagtagcagctctagataaagctattagttagcacaggatcgaccatatgtatgcttctgtatgtcagttgtcttcgcatgcatatgggcgtttataacgtgctagctcgtgtcgtacgtacacgtgtatgcacgcatggtgcaccacacatgaatggtgtcgtcatccaatatcatcccacgtttctttaaaaaaaaaaagaat

SEQ ID NO: 19130 - DNA, 373 bp, Zea mays
  Clone ID: LIB189-016-Q1-E1-F3
cacgcgtccgacacatacatagtttcttctactacacgacgacaaacatggggaagcctgcgaagatcggagagtggggtggatacgccggcgatcgtcgggatctgagggctactccggaccggctgatcgaggtgaaggtcacgggggacaacagcagctgcatccgctccatctccttcatctacatcggagccgatggcaaaccgtacgatgaggggccatggggtttcggccacgctggcacggagtacaagattgatctgtgcacgttcgacgagagcttgacggagatctccgggaccacgggcccagcctacaacattgacaatctggtcaaatctctcacaatcgtcaccaacaaacgcgctta

SEQ ID NO: 19131 - DNA, 57 bp, Zea mays
  Clone ID: LIB189-016-Q1-E1-F4
gcgtccgaccacacgtccgcccacgcgtccgcccacgcatccgcccacgcatccaag

SEQ ID NO: 19132 - DNA, 257 bp, Zea mays
  Clone ID: LIB189-016-Q1-E1-F6
aatgcccgggtcgacccacgagtccgaaaaaaaaaaaaaaaaaaaaaaaaaaaaaaaaaaaaaaagaaaaggaaaaaaaaaaaaaaaaataaaaagattacatacacatcaataaaaagataaaaattcttcgagatggtcacaaaactttaaattcattgtcgtgagttattaaaactttgtgactggaaataccctgtcgttagccatcttaatctccttgcattacttacccctttcgctatccagcgtaatat

SEQ ID NO: 19133 - DNA, 449 bp, Zea mays
  Clone ID: LIB189-016-Q1-E1-F8
aatgcccgggtcgacccacgcatccgcggacgcgtgggctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagctccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaata

SEQ ID NO: 19134 - DNA, 239 bp, Zea mays
  Clone ID: LIB189-016-Q1-E1-G1
ctggactggctaggactggtatgattagatggcctatcaataaagcaacaccgcttactgctgacaatcctctattgacaaatgccaatttatgtcgcgcaaccaatagcgatataagcgaaaaataagccctgaaaccggaccaggctaaatgtgaattctgccgaacgatagggacgaaacagaaatttaagaagtaatatacgcctcagttcgttagcctgtgccaaagatcacag

SEQ ID NO: 19135 - DNA, 181 bp, Zea mays
  Clone ID: LIB189-016-Q1-E1-G2
gcgtccgatgagaggctaacctgagcccgacagaaccggcttggtcgatttggaacctggtaaggcccggtattttttttattgaaagtgtaactttctaaattaggtcctgttggtttgcgttggattgcgtccggaatcgtttcaaggtttatataaattagagaagcaatccggttag

SEQ ID NO: 19136 - DNA, 446 bp, Zea mays
  Clone ID: LIB189-016-Q1-E1-G4
cgtccgaccatagatgtgtatcttgctggaacggtcatgttgatatttgggatgggtctctacggtcccttcgtcagcaacccttccgtgggtgttcgtcctgaatccgaccgtgcactgagcggatcgttgctgttcgggatgttcgctttgaaggaacgccccaagtggatgaagatcacctccctcgacgagctgaagacaatagtggggcacgtcatcgtgatgatcctgctggtgaagatgttcgagaggagcaagatggtgacaatcgccacggggctggacctcctcagctactcgatctgcatcttcttgtcgtctgcctctctctacatcctgcataacctccacaagggcgacgaccatgaggagtgaggagagtgcaataatataatgcccaatctgtaactctatgacagaagagataatggtaaggcttgggt

SEQ ID NO: 19137 - DNA, 378 bp, Zea mays
  unsure at all n locations
  Clone ID: LIB189-016-Q1-E1-H2
ggtcgacgcacgcgtccgaccacgagtccgcagctccccccgcaaaaaccctagctttacctccccacaagcgcctccaagatgaagctcgtcaggttcttgatgaagctgaacaacgaaacggtgaccatcgagcttaagaacggcaccgtcgtacagngaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggc

SEQ ID NO: 19138 - DNA, 305 bp, Zea mays
  Clone ID: LIB189-016-Q1-E1-H6
cgggtcgacccacgacgtccgcccacgcgtccggcaggagctggctctacccatttttctggtggtgtaaggtttcattgcaaccggaccaaggattacgtaatggtagcaggtagcatgatacaagtgaaaacgatggctgtttttttaaatagggagagtctcgctctccagctgtggtgaagattgtatatatgctcgtgttgccttattaataattattattgtgcggttgcttcttgaggaaaaaaacaacaaaaagaaacaaagttcataaataaaaaacgggaagcttatcaacaagc

SEQ ID NO: 19139 - DNA, 397 bp, Zea mays
  Clone ID: LIB189-017-Q1-E1-A10
ggtctagaattaccgggccgacgcacgcgtccgcgcctccgcttggtctcgctctcgctgcattcgtcttccccgcccgtccgtccgcccgctgatctcagatccagaccaaacgaactccacactaccctctgcccagctcgcgcacgcatgaaaccctagtgaccccgtccagatctcggcgtccggatcactgcgcggcgccgccatggcgccccccgcgctggactctctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactac

SEQ ID NO: 19140 - DNA, 371 bp, Zea mays
  Clone ID: LIB189-017-Q1-E1-A11
tccgggccgacccacgcgtcgaggaaagcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggcgcaaatttctatatcgttggaagggatcctgctggtatgagccaccccacagagaaaagggacctctatgatgctgatcacggaaagaaggttttgagcatggctcct

SEQ ID NO: 19141 - DNA, 425 bp, Zea mays
  Clone ID: LIB189-017-Q1-E1-A12
gctgccaggccggtcaagaattagcgggtcgagcacgcgtccggacttcgtgcacctcttgctgtcgctgcagaaagactacggtctcaccacggataacatcaagggcatacttgtgaacatgttcgaagcagccatcgagacatcattcctggtgctggagtactccatgagcgagctgatgaacaaccgccacgtcctggccaagctccagaaggaggtgaggacggcgacgcccgacggccgcatggtgatggaggaggacctgagccggatgccatacctgaaggccaccatcaaggagtccatgcgcatccacccgccggcgccgttccctcctgccgcacttctccacccacgactgcgagatcaacggctacaccatccccgccggcacgcgcgtcatcgtcaacgcgtgggcgctc

SEQ ID NO: 19142 - DNA, 295 bp, Zea mays
  Clone ID: LIB189-017-Q1-E1-A7
cccacgcgtccgcccacgcgtccgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattaaaaaaaaaaagaaa

SEQ ID NO: 19143 - DNA, 74 bp, Zea mays
  Clone ID: LIB189-017-Q1-E1-A9
cccacgcgtccgcccacgcgtccgcccacgcgtccgcccacgcgtccgcccacgcgtccgcccacgcgtccgac

SEQ ID NO: 19144 - DNA, 393 bp, Zea mays
  Clone ID: LIB189-017-Q1-E1-B10
gggtcgacgcacgcgtccaatttacaacagtcgggaatgatttgacgtttcaaccgaatcctaattctgtatatcaaactgagcacctctcatactttaaatttgctggacgagtggttggcaaagctctcttcgatggtcagcttttagatgctcattttactagatctttctacaaacacatacttggtgtcagggttacgtaccatgacattgaagctatcgatcctgcatactacaagaatttgaaatggatgctcgagaatgacataagtgatgttttggatctcaccttcagcatggatgcagacgaagagaaactgatattgtacgagaaggcagaggtcactgattgtgagttgattcctgaagggcgtaacatcagggttactg

SEQ ID NO: 19145 - DNA, 397 bp, Zea mays
  Clone ID: LIB189-017-Q1-E1-B11
ggtcgagccacgcgtccgcggacacgtgggcggacgcgtgggcccacgcgtccgcggacgcgtgggcgaggacgaggccaagaggtacgagcaggagatgatggagttcgggacggcgtcgccggagtacgtgatcgtcgcggccgtcgcgctgctcaacctcgtgtgcctggcagggatggcggcggcactggatgtgttcttcgtccaggtcgctctctgcggggtgctggtgctcctcaacgtcccggtctatgaagccatgttcgtcaggaaggacagggggaggatgccgttcccgatcacgctagcctccgttggctttgtgacgctggccctcattgtgccattcttttgactttgaggtgccaataatacgtgtacgggcacacgcacg

SEQ ID NO: 19146 - DNA, 390 bp, Zea mays
  unsure at all n locations
  Clone ID: LIB189-017-Q1-E1-B2
gacccacgcgtccacccacgcgtccggccgacttcttcgtcggcgacgccgactcgcccaacaactaccccaacggcggcctcctctacgtccgctcctcgcccgccacggtgggcttctaccgccactggcaggcgtcgcgcgcgcggttcccgggccaccacgagcagtacgtcttcgacaggatcgtcaaggaagggtacgccggcgcccgggtgcagttcctggacacggccgtcttcgggggcttctgccagcacggcgacgacctgngcagggtggccaccatgcacgccaactgctgcgtggggctggacaacaagctcttcgacctcaagaacgtgctacaggactggaagacctacagagcgcgcgccgccgctggcaacg

SEQ ID NO: 19147 - DNA, 253 bp, Zea mays
  Clone ID: LIB189-017-Q1-E1-B3
aaaggctctgttaataatgccatcttactagtttaattggtattaactcaaagtctcaaacgtgcctcttgttgcattgacacacatgtacaatacaatcgtacatatagtacgttttattcgacaagcagcctctgcatgcaataatagtacaacccccgatttaattaattggactaatgcatgctgaggatggatcagatggaaatgctgctggggatgcccctcccggtgactcccggcttggaaaaag

SEQ ID NO: 19148 - DNA, 388 bp, Zea mays
  Clone ID: LIB189-017-Q1-E1-B5
gggccgacccacgcgtccaccgactgctcgaaagcgcagtcactggccattccatgcccacgactgcagtgcctactaccggacccggatgccgggggtcaccgccggatctcgctctgtctagctcaatagccatggttcacagcgccccgaagcgactgggcgtatcgaagccgtcgtggatcgttcgcactgagtcaaacgtgaggatggagagagcaaaacgacctgatcctccttgcaccatctgcaaaggctcagggataatatactgccgcaactgctttggtcgacgaagaacataccatgccgatgtggccatgcgtccgaactgtgaatggccacaatggtgtcaaatttgtggtggtactggactggattactgcct

SEQ ID NO: 19149 - DNA, 208 bp, Zea mays
  Clone ID: LIB189-017-Q1-E1-C12
acccacgcgtccgcccacgcgtccgtgggttatctagtgtctctgccattgcccatggatggtactgtctttcaaagtatttgtatggtttgtgtcgtgagtcgtgactgagctggtttcatggaccagttgtgttctcgttacccaaaactatcgtgcgaccgcatatggcttaatcatgaataaatgttgtgtttgaatttaaaaa

SEQ ID NO: 19150 - DNA, 85 bp, Zea mays
  Clone ID: LIB189-017-Q1-E1-C2
agaaaaaaaaaaaaaaaaagaaaaaataaaaaaaaaaaaaaaaaaaaaaaaaaaaaaaaaaaaaaaaaaaaaaaaaaaacaaaat

SEQ ID NO: 19151 - DNA, 365 bp, Zea mays
  Clone ID: LIB189-017-Q1-E1-D10
gcgtccggtatggcgagtgtgaacttatcggcacatgcatactggaccccagatccaactttcagaagctatttaaactacggagctggcattagtgaggtggaaattgatgtgctgacaggagcaacaacaattctaaggagtgaccttgtctacgattgcgggcaaagcttgaaccctgctgtcgacttgggccaggtggaaggcgcattcatccaaggagtaggcttctttacaaacgaggagtacacaacaaactctgaggggttggtcatccacgatggcacatggacgtacaagatccccacagtcgacaccatcccaaagcagttgaacgttgagctgattaacagcgcccgtgacca

SEQ ID NO: 19152 - DNA, 365 bp, Zea mays
  Clone ID: LIB189-017-Q1-E1-D12
atcttccacagagaggcagacggcaggactcgcttcaagctcctcatctcgcgcagggggggtcgcctgagatcacagcgacaatggtgaaggcagttgctgtcctcgccggcactgatgtcaagggcaccatcttcttttcacaggagggggatggtccgaccaccgtgactggaagtatctctggcctcaagccagggctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtgttgttaat

SEQ ID NO: 19153 - DNA, 423 bp, Zea mays
  unsure at all n locations
  Clone ID: LIB189-017-Q1-E1-D4
ggccgacccacgcgtccacggacgcgtgggcgggcatcaagatcacgttcgagaagacgacggtgaagaccaagggcaacctgtcgcagcttcctccgctggaggtgccccgcatcccggacaacctccggccgccgtccaacaccgggagcggcgagttcgaggtgacctacctcgacgacgacacgcgcgtcacccgcggggacaggggggagctcagggtgtttgtcatcgcgtgacctgatcgcgcttgcggcgccgttctgctggtccgtgagattgccatccttcttcctccctgttgctccagtagatttgttggtttcttcgtctgaccaatgtataccgttctgttcttccgtgaactgaatctgcgattaacttagtaactatcttgtgtggtttaaaaaaaaanaananaaa

SEQ ID NO: 19154 - DNA, 437 bp, Zea mays
  Clone ID: LIB189-017-Q1-E1-E10
cgggccgagccacgcgtccacccacgcgtccgcccacgcgtccggcttgatctccctccgccactccatccatctcctcgctcccagtccccgggaagcatggcgtccgtcaccgcccgcgccccggtagcggcccttcgcccgtcgtcggcatcgctcaagtcgtcgtcggccttccttggccactctagccgcctcggccgcaccgcgtctcccacgaggcgcagcctcaaggcggatgccaagggcgagtggctccccggccttccctccccctcctacctcgacggcagcctggcgggtgacaatggcttcgacccgttgggcctggcggatgaccccgagaacctgcggtggttcgtgcaggcggagctggtgaacggccggtgggccatgcttggccttgcccggaatcctaaccccggaggtgctgacca

SEQ ID NO: 19155 - DNA, 387 bp, Zea mays
  Clone ID: LIB189-017-Q1-E1-E2
gacccacgcgtccagagacggaaagccaggtgaatccgaagcagctccccttgcatttgttgatgaaacagctccccatgtaattattggtgaagagaagaaagaggaaaatactgagaatgagaacagtcaggcagccgaatctgccgtgccttccctggcatctttagagggagagaagaaagagaatggtggtgcccctgaacaaccagccctgcctgtagctgagacgaaggcagatgctcctccggcagaggcagaaaagggggctgaaaattcaggccagccgaataccggctctcaagaaccgaaggcagcaaactgcgacgaggggcagattcaacctggtgcctctgctgtgaggtgcacataagggagcttgatctc

SEQ ID NO: 19156 - DNA, 410 bp, Zea mays
  Clone ID: LIB189-017-Q1-E1-E3
ggtccagaatacccgggccgacccacgcgtccagtcatctttctgtctctccctctcatcgccgcgtcacgcacagccgccgccgtcgtgcgcgtgtgccggaacggccgcgtggatcctccgccccgtcccagcggcgacttgtccgtgcgaagatgctggggttctcgaccggacagctgctggtcgtcctcggggcctgctccgtcatgatgaagcccagtgatatggtgaagattgcgaggacggccgggcggatgactggaagagcggttgggcggctcatagtggctcgccggcagctggacgagattctgggccagtctgcagccacccaggttcataaggagcttaaagacgctatgacacaattagactcgatccgttatgaagtccagaacttatcaaga

SEQ ID NO: 19157 - DNA, 398 bp, Zea mays
  Clone ID: LIB189-017-Q1-E1-F10
attaccgggtcgacgcacgcgtcaacccacgcgtccgggggaactcaagtgtggagccatatatagcagctcataacatgctactggcacatgcatcagctaccagactgtacagagaaaaataccaagctgtgcaaaaaggagttgttggtataaatatatatacaatgtggtcatacccactaacaaactccactgccgatttagaagcaactcaaagatttctggacttctattccggctggatactagaaccattggtgtttggagattatccaagcgtaatgaagaagaatgttggttctcgccttccgtcattcagtaaagttcaatctgaagccattcgtggcactctagatttcattggaataaaccactattattctttctatgtgaac

SEQ ID NO: 19158 - DNA, 409 bp, Zea mays
  Clone ID: LIB189-017-Q1-E1-F12
cggtctagaattaccgggtcgacgcacgcgtccgagagagccagagaggtgggcagatggcgacaccgtcgtcgtcgctttgctccagcttcgcctccctgcggaccgcctccatcggccacccccgcggcatcgcgtcatctacgcccaggaaggcgttccaagtgagggcatcagctcgggttgacaagttctcaaagagtgatatcattgtgtccccttcgattctgtctgcaaacttcgccaagcttggtgatcaggtaaaagccgtggaggtggcaggatgtgactggattcatgtcgatgtcatggacgggcgctttgtgccaaatatcacaattggacctttggttgttgatgctctgcgtcctgtgactgatcttccattggatgtacatctgatgattgt

SEQ ID NO: 19159 - DNA, 455 bp, Zea mays
  unsure at all n locations
  Clone ID: LIB189-017-Q1-E1-F2
gggccgacccacgcgtccagcttccctttccccgcacggcggagttcacaatccccaccggccggcgtancggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggcgaccgcgctggcctcgctcgacaagctcaacgagacacttgaaatgttggaaaagaaggaaaacttgctagtgaaaaaggccaatcttgaggtcgagaaggctaagaattttaccaaagccaagaataaaagagccgcaatacagtgcttgaagaggaaaagactatacgagcaacagattgagcagcttgaaaattccagcttaggatacatgatcagatgat

SEQ ID NO: 19160 - DNA, 404 bp, Zea mays
  Clone ID: LIB189-017-Q1-E1-F4
ggtccagaataccccgggccgaccaacgcttcgaccaaagcttcggcttcatcacaaaccgcacattggaaatcttccccaatttggatggcttggccagggacattgaaaggtcccacccaccattaaatttgtgaaggaatttcgtaaacggtacttcaccccccggttcggtccttggttcggttgttcacatgaaacaggaaaattttgacaaggtcattaatcctgtatccgttgcacatttcccaaagttacaagtaatttgatttgcaactcaagaagcttgaaggtattggtttccagacatgctttcccagtgagattggtaactcaacacaagatttggtactggaaagcaagatattgatgggacacaagtgcacatcccttgatcagactga

SEQ ID NO: 19161 - DNA, 406 bp, Zea mays
  unsure at all n locations
  Clone ID: LIB189-017-Q1-E1-F9
ggtctacaattaccgggccgacgcacgcgtccacccacgcgtccgcccacgcgtccgcccacgcgtccgcccacgcgtccggtcgaaccagggacgcgctcccttctccgtttctttcagccacctccgccgctggtggagctacgtttctgtgcgatcctcgtcctctggggccggaagccagtcaagcgttgcggatgaaccagaggctgcagaatgggccttgcaggatttctacattttgcggaaggatgttgagttggctcttgagcgtgtcaatgaagtcaggcagtctgccggtttgcaacagctcgaggaggatatcgcttcgcttgagaacaagtccagtgatagttccttatgggatgatccttccaaggcacangggatacttgtttctctgaca

SEQ ID NO: 19162 - DNA, 380 bp, Zea mays
  Clone ID: LIB189-017-Q1-E1-G10
gggccgacgcacgcgtccaggtgaacctctggtgcagcaggggcagggacgccgtgggcaagatttgcctcgcactggagccgctgcgcctccgggtcgtcacggccaccatcaccgcgcgcggcgacactgtcttccacacactgttcgtggagacaggagaaacaggtggcgctcggctaaaggaggcgatactggctgctctcgctcggctcaacgtcctcgctaacgctgaccaagtcgtccatgagttactgggatgattgatgcggtggcatcttggacagcaacacctggtgttgttgtcgttgtcagcactctcgactgtccgattcaataatgatgtacctcaggaatgtttgaatatgatatcattgcca

SEQ ID NO: 19163 - DNA, 393 bp, Zea mays
  unsure at all n locations
  Clone ID: LIB189-017-Q1-E1-G11
gggccgacccacgcgtccacggacgcgtgggcggacgcgtgggcggacgcgtgggccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaangaatgggcggtggaggatcccatgttgatccatttgacatcttctcatcattttttggaccctcttttggacgaagtggtggaagcagcaggggaagaaggcaaangaggggagaagatgtagttcacccacttaaagtttctctggaagatctttac

SEQ ID NO: 19164 - DNA, 412 bp, Zea mays
  Clone ID: LIB189-017-Q1-E1-G12
gggtcgacgcacgcgtccacccacacgtccggcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcatcgttcggttcggagcggatctgaggcgacgatagatggaggctgcgggatctctcggtctgcagtcctgctccacctcgatggatgat

SEQ ID NO: 19165 - DNA, 360 bp, Zea mays
  Clone ID: LIB189-017-Q1-E1-G3
acaagcaacatagaaagtggaatccagtagcaacaatagagcaaaaatgagaaaaaaaaaaaaataaaaaaaaaaaaaaaaaaaaaaaaaaaaaaaaaaccaaagcttccccggacgcgtgggctagttcaaatcccaatcggaagcgctagaaggattaagatttaggtacacgtgcatgcaaagtcaaagctcttcaacattgtcagtgaaattcaattcaaaggccttggttttacaatgtcgtgattgggaaaggcaagaccttacccaaattaatctccttggagcacatccccatttccctatcgggcgtaatagtaaaaaggcccacaccgatagccattcccaatagttgcg

SEQ ID NO: 19166 - DNA, 364 bp, Zea mays
  Clone ID: LIB189-017-Q1-E1-G8
gcctgcccgagccgccgctccccttcctcggtctctcctcgcttcccagtcccagtcctagcccagcgcgccgcggcgctaactggccagctggtagtgatggcaaccgagccgccgccggcagcggagaagaagaaggcgccgctccccaaggtggtcacgctcaataaagccctcaagctggcccagacatgggtggacaaaatgagtgcatcggagccggatgaacccaacgataaggatttcgagggccggccaccaaagctcggtcttggtgctaaagcggcacctggtgtgaagcgtgtggttcccactgacccagttgagaggaggttgcttgggaaggtgaatgcgcataagagga

SEQ ID NO: 19167 - DNA, 411 bp, Zea mays
  unsure at all n locations
  Clone ID: LIB189-017-Q1-E1-H11
ggtctaaaataaccgggtcgagccacgcgtccacccacgcgtccgggcaacctccaggacaatttctttgccagtttcgctctgggttggctgatcactaatggtgctggtcttgcatcttaccccattgataccgtccgcagaaggatgatgatgacatctggtgaggctgtcaagtacaagagctccttggatgcgttccagcagattcttaagaaggaagggcccaagtccctgttcaagggtgctggtgctaacattcttcgtgccattgctggtgctggtgtgctttctggctnatgacagctccagattctcttcttccgaaaaaaagtacggttccggcggtgctttaaatggagaaatatgatgacgaacaagagcagtgtgtgttcccggtcctttccaatc

SEQ ID NO: 19168 - DNA, 203 bp, Zea mays
  Clone ID: LIB189-017-Q1-E1-H2
acccacgagtccgcatgcgtaaaatcacgagctaaatctagcagctataggtgcgcacccgtcctgtacttaatgtttccgagtatatggttagcacacattttgacacacttcgtagttataccagcattcttggtagtaattcaaaaatgatcactttgattacttattagttaaaaacagcaaagcaaataataaaaagt

SEQ ID NO: 19169 - DNA, 410 bp, Zea mays
  Clone ID: LIB189-017-Q1-E1-H7
ggtacctagtctataattcccgggccgacccacgcgtccagtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgagggactcaagaactgggatgcggac

SEQ ID NO: 19170 - DNA, 312 bp, Zea mays
  unsure at all n locations
  Clone ID: LIB189-017-Q1-E1-H9
gggccgacccacgcgtccagtcggtcggtcagccgttcgttggcgagattgtttgctgctggagtcggacgtgctcgcagcagtttcgctggtccgtgaccgcgccatttgttgccacgaatggttgttcggtacgttgaggaacgatgtgtatgtagtgtgcacgtttccggtgcatcttgttctcctctgcctgtcctgtatgtttacccccctgcaccccctcctccctcttttgtagagagagggtctgtatgttcagtggaagatgattgttctatttgatttttattttatggaaaaaaaacnaac

SEQ ID NO: 19171 - DNA, 237 bp, Zea mays
  Clone ID: LIB189-018-Q1-E1-A1
tcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgcc

SEQ ID NO: 19172 - DNA, 385 bp, Zea mays
  Clone ID: LIB189-018-Q1-E1-A10
ggtaacggtccagaattcccgggccgacccacgcgtccacccacgcgtccgcgcgtcatcgtcttcgacaacccacaacctctgctctaacctcatcgcactcgcggaatcgtcgtgaagccgctagccgtctgcctcgtcctcacacccgacaagctgtcgtgctcggtgtgttttcaccgtgcggccttacgtgttcctctcgcttcatcggcttgtcgcgtgttagagcaaagctccatgatgaagtggacatcatcgagagattgctccagtacttgaagacccattggtgtggttccacctaactggttatctagtagaaggattttggatcatctctgcaacaaaggaaaagttttgatgtccttggcttcatcagatg

SEQ ID NO: 19173 - DNA, 385 bp, Zea mays
  Clone ID: LIB189-018-Q1-E1-A12
gtaaggtcaggaattcccgggccgacccacgcgtcaggagagaaacttctcttccagaagggggcaaagctcgcggcctcgcgtcgcgccggtcgttccggtccaacgcggcgacgccaaaggctgccgtccccgggcttcctcctccccctcgccaaaccacaggaagaagcgagcagggcaccgtgttttctcgatcgatggcatcggcgcctgccgattcctacgggtgcgcggcgtgcagcgcgctcctggacctgtcggcggtgcacctgtacccggcggacttctacttcgaggccgggaacaacggcacgctgtccttctcgtgggtggacgagtcgcgcctgcggttcgcgcccgaggaccgcatctgccccttctt

SEQ ID NO: 19174 - DNA, 360 bp, Zea mays
  Clone ID: LIB189-018-Q1-E1-A4
gagccacgcgtccacccaaacgtccgctgattagcctgagcaatggcgaactctccgtcattgggtttcacacaatttagacttgcagaaccaaatttttggggctttacacgtcatgagggttcttgccaaaaaatatgatttcaagtctgaggatgagaggataccattatttcacatcgtataggacacatttcctcgtcaactaaacatttttatcaaactggttcaaattgtcaatccacgaagtgaagttgctgacttaatcaagttgatatgtaaaatattttggtcttctatatatttggagattcggaagcagctatttgatacaaatgtcgtcaatgcatggatggttct

SEQ ID NO: 19175 - DNA, 356 bp, Zea mays
  Clone ID: LIB189-018-Q1-E1-A6
attcccgggtcgacccacacgtcagctcatccctctcttaccaagtcatcctcgggttagggttccttacggttttgtgaacgggccatgcgagctgttgttgtggagtaccgttgcttcatctgtcggcttacccgcgccaccagcaactactcccaggcaaatgccttcgcatcctaaagccagatgctcaactccaacgtcatcaacgaccattaaaccgggaagtcactcggtatccgcaacatcaacatctcctccgatataaccaattgcgacgcattgaaccacgactgcttatatgcagcatcaaatacgattaccatttatccagccagctacatcaagccgtgctt

SEQ ID NO: 19176 - DNA, 105 bp, Zea mays
  Clone ID: LIB189-018-Q1-E1-A7
gacccacgcgtcaacggacgcgtgggcggacgcgtgggcggacgcgtggggcacgcagtacgccggcaaaatgaaaaagggctcctccgcgtcatgcactaactc

SEQ ID NO: 19177 - DNA, 406 bp, Zea mays
  Clone ID: LIB189-018-Q1-E1-B1
gggtcgacgcacgcgtccagttcaacatttggcatataataacccacttaatatgtgttggacacttaatcaccaaaatatactagaaatggcctaagggcacatttcccttttaggttcgtggactaattttgaggggacttggcccaaatcggtttggtatcaatcttttcttttctctctttttttgttgatatttttatgtatcaattcaaatctggtttgaattttcaattcatgtttaaaggcgcaaacaaaatcccaacatgagatacaattgaagttttatttatttattttaggagaggataaagtgtagtctttgtcatgactcattttaatttatctatggtttgaaaaagaaatagtctgcaacctttcttttaatgttccaagttttaaattt

SEQ ID NO: 19178 - DNA, 181 bp, Zea mays
  Clone ID: LIB189-018-Q1-E1-B12
ggtaacggtcacgaattcccgggccgacccacgcgtcagaaaaaaaaaaaaaaaaaaaaaaaaaaaaaaaaaaaaaaaaaaaaaaaaaaaaaaaagggggggcgccccaaaaggttcaagcctaacttacccttcaaggcaagtccaaacccctccaaaatggcccccaaattcaattcca

SEQ ID NO: 19179 - DNA, 358 bp, Zea mays
  Clone ID: LIB189-018-Q1-E1-B2
ggccgagccacgcgtccacccaagcgtccgcccacgcgtccgcccacgcgtccgcccacgcgtccgcccacgcgtccgcccacgcgtccgcccacgcgtccgcccacgcgtccggcccccttcccattccttgcagtaccttcaacagtgatggttccatatttgcctatgcggtttgctatgactggagccgtggggcctaaaatcacaaccctgcagctgcaaagacatccatctatctccacagtccacaggaaaccgaggtcaaaggaaagccgcgcattgcaacaggcatgaagtgattgcattgaaggtgttgcaaggaaccatgatgtcatccagcagttttgtcatgcct

SEQ ID NO: 19180 - DNA, 279 bp, Zea mays
  Clone ID: LIB189-018-Q1-E1-B4
gggtcgagccacgcgtccactatgagtctctcgtgtatcataaaggactgcatagaagtctacatggcaggagtgctggaatttttgcccgaagcaaaagctgtcctctactcccatggactaatgtatctctggcaggcaatgctggtccagcatcaaaaaatttctttcatttcgacatttgcccaatagttgtgttcatgttcttgttaaaccctgttgtgaatgagaagggacgacatttacctccttaatatagtaaaaacatgttcgtcaaaa

SEQ ID NO: 19181 - DNA, 377 bp, Zea mays
  Clone ID: LIB189-018-Q1-E1-B5
ccgggccgacccacgcgtcagcccacgcgtccgaacaatccccaaacgcctccgcctccgcctccctagggttttgctctcggctcgtcggatccagttcgggggatcctccatggcgtcgcgtccgtcgctgaagtcgaagcccaagggcaagggcgggaagaaggccaccgccgacgacgaggacgccaccgcggcggcgaccacggtgcggctcatgaaggagtggaccacgtggacgatgaagaaggcgaaggtggtggcgcactacggcttcatccccctcgtcatcgtcatcggcatgaactccgagcccaagccctccgtgttccagctcctctcccccgtctgatcggatctccccgtcagggcccgga

SEQ ID NO: 19182 - DNA, 408 bp, Zea mays
  Clone ID: LIB189-018-Q1-E1-B6
attcccgggccgacccacgcgtccacccacgcgtccgcaatcgaccaccaaactttacatacaagatgaaactcgtcagattcctcatgaaattgaacaatgaatcggtaacgatcgagttgaagaatggtacaacagtttctggaacgattactggtgtcgacccttcaatgaatacgcatctcaaaaccgtcaagatgactgtacgaaaccgggaaccgacgacacttgaaactctagcgattcgcggcaacaacgttcgatactttatcttgcccgacagtctaccgttagatactctcttgatcgatgatgcacctaaacctaaaaagaagaaggctgacggtgctgcacgaggaggagctgccggtcgaggagcgagaggtatggatcgtggtggaagaaggg

SEQ ID NO: 19183 - DNA, 384 bp, Zea mays
  Clone ID: LIB189-018-Q1-E1-B7
aattcccgggccgacccacgcgtcagccacatctccactcccacaacaacccgcaataccaacgacacaatgctcggcctccgcaccgccgcccgcgcctcgtctgcgctccccgttttccgcaacgccgctgcgcgccgcttcaactccagcgccgcgaagggccttgagggccctgccgacaacgccttcaatcgcgagagggccgctgtcaagcagcacgctgctgacacttctggcacctggcgcaagctttccatctacgttgtgatcccctccatcatcctcgccagtgtcaacgcctacaggctctggaccgagcactgggagcacgtcgcccagggaccagctcttgaggacaagcccgagtaccccttccagaac

SEQ ID NO: 19184 - DNA, 362 bp, Zea mays
  Clone ID: LIB189-018-Q1-E1-B8
attcccgggcagacccacgcgtccgcccacgcgtccgggccgcggcggttatggtggcgggcgccgtgacggcggttatggcggcggtggcggctacggcggtcggcgcgaaggtggcggcggcggctacggaggcggtggcggctacggcggtcggcgcgagggtggcggtggcggctactgcggcggtggcggcggcgagctggagggactgatgtgtgggcccatcctgacttccgacgagttatcttatctatctatagtatcgtgttactgttcgcttctgtcaccgtgttactgctcgtactacctttgcattaggtgttggtaccctgttgtccgctttggttgctcccgctatg

SEQ ID NO: 19185 - DNA, 388 bp, Zea mays
  Clone ID: LIB189-018-Q1-E1-B9
ccgggccgacccacgcgtcagcgtgttcgtccgcgacacagcgaatgaattgacacgccgcgcgcgagctcgctcggctggcttgctgacgcgcagtttctctctgtcctctcgcgccgccgcaggatctctccaacaaggtcctgctcaatgccgtcagagccttctcgccgccgctgctgctccgcctgggagggtcgctgcaggacaaggtggtgtacgggtacggcagcgcgggcgccgggcggccgtgcgcgccgttcgccaggaacgcgtcggagatgcacggcttctcgcatggctgcctgcccctgcgcaggtgggacgacctcaacgccttcttccggagatccgggtgagctccgtccgtccggccggccggcggttt

SEQ ID NO: 19186 - DNA, 408 bp, Zea mays
  Clone ID: LIB189-018-Q1-E1-C1
gtctagaattagcgggtcgagccacgcgtccgccacaggggtggtggccaggtcattccaactgccaggagggtcatttatgcttctcagctcacagccaagccgaggctgctggaaccagtttacctggtggagatccaggccccagaaaatgcacttggtggcatatacggtgttctgaaccagaagagaggacatgtattcgaggagatgcaaaggcctggtaccccgctctacaacatcaaggctttcctccctgtcatcgagtcctttgggttctcaagccagctgagggctgcaacctctggtcaggcgttcccccagtgtgtgtttgaccactgggacatgatgggctcggatcctttggaggctggctcccaggctgcccagctggtgctggatatccgc

SEQ ID NO: 19187 - DNA, 420 bp, Zea mays
  Clone ID: LIB189-018-Q1-E1-C11
aattcccggtccgacccacgcgtcagaaaaaaaaaaaaaaaaaaaaaaaaaaaaaaaaaaaaaaaaaaaagaaaaaaaaaaaaaaaaaaaaaaaaaaaaaaaagaaaaaacaaaaaagaaaaaaaaaaagaaaacaagaaaaaaaaaaaaaaaaaaataaaaagaaaaaggggggggcccccctgggggttcaatcttttgatcgccgattttcgcagggaaaggccctccaaaagggcccccaaatttacttgcaggggcgatctttttaaaccatcttacagggaaaacccctggatttcccaatcttcccccctttacaaaaatccccctttacctgtaggggagttacacaaacagggccactgcaattcaccttgccaaaaatttacccgccacatggggcaactgggtcccccc

SEQ ID NO: 19188 - DNA, 410 bp, Zea mays
  Clone ID: LIB189-018-Q1-E1-C2
gggtcgagccacgcgtccgcggacagcgtgggctggaattcttggaaacatttttgacggtatccagcgacctctaaaaaccatcgctattaagtcaggagatgtgtatattcctcgtggtgtttcagttcctgcccttgacaaagatgtattgtgggaatttcagccaacgaagctaggtgttggagatgtcatcacaggtggagatctatacgctactgtttttgagaacacattgatgcagcaccatgttgctcttccaccgggttctatggggaaaataagttacattgcaccagctggccagtacaacctgcaggacacagtgctagaattggaatttcagggcataaaaaagaaatttaccatgcttcagacatggcctgtgcgttcaccaaggcctgttgcat

SEQ ID NO: 19189 - DNA, 107 bp, Zea mays
  Clone ID: LIB189-018-Q1-E1-C4
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 19190 - DNA, 309 bp, Zea mays
  Clone ID: LIB189-018-Q1-E1-C5
gccgtgtgttgattgggatatagagagtttttttcctctcttgatggaagtacttgggaagctatgttgatagactgaacatttttttgtaaaaaaaaaaaaaaaaaaagaaaaaaaaaaaaaaaaaaaaaaaaaaaaaaaaaacaaaaaaatatgaaaaaaaaaaaaataaaaaaaaaaaaaaaaaaaagaaagaataaggggggaccgtccaaggggttcaatcctaagacacgtcggcatccagcggcaaacacctcatcgaagacctcaaagcaaagtgggacgccgttgatgataaacccaccg

SEQ ID NO: 19191 - DNA, 400 bp, Zea mays
  Clone ID: LIB189-018-Q1-E1-C7
aattcccgggctgacccacgcgtcagcggacgcgtgggctccttcccggtctcctccgcccgttgccttcgtcccctccatctccggctgcgtcgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaac

SEQ ID NO: 19192 - DNA, 291 bp, Zea mays
  Clone ID: LIB189-018-Q1-E1-C9
attcccagtccgacccacgcgtcagaacccatttccctcgctcgcatcccgtcccgccccttgtctcttccgcttccgcccgaccccgcgcgccgcggaccagcagccatgtcgtgctcccacctctccaccgcctggtcctcctcggcgctcgccagcagcgcctccaccaaccgtcggcgctcccccccgcgctcgggtctcctggtgaggtgttccctccgtgagctccgcacccgcatcaactccgtcaggaacacgcagaatatcacggaggacatgaatctggtg

SEQ ID NO: 19193 - DNA, 339 bp, Zea mays
  Clone ID: LIB189-018-Q1-E1-D3
cggtctagaattaccgggccgacccacgcgtccacggacgcgtgggcgcatgtgaggtgctgtccagcattgagcagaataatgcagaatacttgcgggatgagccattgacggctgcttcgctgatcaaaacacctccgtgaacacaaacatgaggcacagaagaaatgatgaaaaataaaagggattgtaacagttttggtgcctttgactgtaactggcagagtttctggggacagagtggcatggattaattgcacctgatcactctgtatgtcgctgtcatgtgtgcaatgttcaatacgtacgtaataaagaatggaaatatatgccgcaaaa

SEQ ID NO: 19194 - DNA, 373 bp, Zea mays
  Clone ID: LIB189-018-Q1-E1-D6
attccggtccgacccacgcgtcagcccacgcgtccgcggacgcgtgggcgggcgcgtggcgctaggtggaatactcaggtgaggttggatcagcgctggggcctactcgacagttttacacccgcttaacccatggtttacaaagtgctcaactgggactagggtgagctatctcttcatatgattcacgattgcacacagacaggaaggatgtgatccgttgacatcctgaatatgggtcgtcaggaaagtcacttagtacagatctaccaagtgatggcatgtatttgcaatatcctccacgtggattgttgtcacgatcttggccatctacagttgatacatcagaatgtatcagaatcttcagagtttt

SEQ ID NO: 19195 - DNA, 310 bp, Zea mays
  Clone ID: LIB189-018-Q1-E1-D7
ccgggcagacccacacgtcaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgctgcttcggcttcgtcaccttctccacggaggacgcgatgcggaacgccatccagggc

SEQ ID NO: 19196 - DNA, 387 bp, Zea mays
  Clone ID: LIB189-018-Q1-E1-D8
ccgggccgacccacacgtcagggtccttctggggctggcccgaggtcaacatccgtccctgggcgccgctgctggaggagatggccgccgagatgggtcgcctgccgtgggcggaccgggagccgtacgcgtactggaagggcaaccccaccgtgtccgccgagcgcgccgacctccgccgctgcaacgactcctcgtcgtccggcggcacgcgcgtgttctggcaggactggggcgccgccatccgggacggcttccgggactccaacctggccaagcagtgccgctaccgctacaagatctacgtgcgtggccggtcctgatcggtcagcctcaagtacatcatcgcctgcgactcgccggtgctgctcatcgccacccccttca

SEQ ID NO: 19197 - DNA, 401 bp, Zea mays
  Clone ID: LIB189-018-Q1-E1-D9
aggtaacggtccagaattcccgggccgacccacgcgtcagggcacctcacccgatccctatgggggtggaagcatccacctagtgtgtgatcattgcggtaccagtgacaactacaccactgacgacgctgatgatggccaattcacgtgccgtacatgctctgccgtgcacactacacaggcaactgctgctgatcctcatgacttccccgccactggcaacatctctgtccgtcgtgttgccacccagcccacccccaagcttggtgcccgcacacccgcgccttacctgaggacccctcaggctgctcccgtgcctgctactgccgcttttgatgacttcacagagctgagtgagccgcgggactttgtgtctggatctggcacgtgtggggagcctg

SEQ ID NO: 19198 - DNA, 391 bp, Zea mays
  Clone ID: LIB189-018-Q1-E1-E10
attcccgggccgacccacacgtcagcacatccatcggttaggagttaatggtgttagcttaggagctcagcaccacaggtcttaacaacttcgttcgtatctaagtcatatactcctattcgaagaggatataacatgaaaatggtgtgatcattaaatatgaatgacacatattcattagcttaagcaaactcctttttttaatgaatgacttgatataaattaaatatctttttttttgatatttttgcagtcgtttcatttacccctaatccatatcgactacatcctgtcggtgttaaaattctaagatcatgagttgtaaggagggacatatgtcacgacatgcagaaactaatccaaatgttggatttaaagctggtgtcaacga

SEQ ID NO: 19199 - DNA, 354 bp, Zea mays
  Clone ID: LIB189-018-Q1-E1-E11
gtttttgtttattattctttttttctgttcttatctttttctttcttatctatttctatattttttctcttataggatatattttgaacaaggtgagataatggagtaagtatcaatcaaattgatcaactcaagcaaacaccgcatcctacagaaaacattgaggagatctacgtaactttggttttgaaaatcctgcaaccgattcaataattcctaatccaggtcgactagcagctgacagagtttagacatccaacatcaagaattgtcaggacggacataagtcatgacaagcagaaaggaatccaaagggacgactcaaaaattgggtcaacgattaggggctgaagt

SEQ ID NO: 19200 - DNA, 283 bp, Zea mays
  Clone ID: LIB189-018-Q1-E1-E2
cacgcgtcaagccaagcgtcagggcgcgctccgtctgatctctcaccgcaggaatctcgaacctctctcacccatcaacatctacccccaaacctcaaccggcctagctccagcacttgtgcactaactatctccgtgcggttagccacgagcatcgatcctcattaatccatacatccgacgtctcacatctccaacttgcccacttatgatgtaatgtctgtccatgatgatgccatataggaatcgccattgggaacctctcagcgaatttacacgacat

SEQ ID NO: 19201 - DNA, 331 bp, Zea mays
  Clone ID: LIB189-018-Q1-E1-E3
cgggccgagccacgcgtccgattattggagaggcaattggagcagaagaacagcttgagcctcgtagaagtgcaagagtgagagagctctatgaaggagaagagtttgagtctgaagaagaagagtatgaagatgaagatttgtgctacagtgaagatgaaatatgatctggaccatctccatctagtagtgaagccttttgtgatgccctggtcttatgaactgcagctgtgtcactttgtgtctgtgtgtcttcttttgtgtgagacctgaactaagaactatgtgcttgtgttgtcctttatttataaattgtgttctgcactaaaaa

SEQ ID NO: 19202 - DNA, 382 bp, Zea mays
  Clone ID: LIB189-018-Q1-E1-E4
cacgcgtcaatccaaatcagcagagcggcagtgcgtagagaggatcgtccaacagaacagcatgaaaatggtcaacgttcacgtcgtgtgcctggctctgtcagctgccaacgcctctgcaatgcaaatgctctgcccctgcgcggagctgcaaggcttgtacggagctggcgccagtctgacgaccattattggcgccctgggcctgtaacccgaagctgagtaactgaggcaccctcagtgcaccccgctggcagaggtgccctactacgcagggtgtgtggcatcctagcgcaatgttccatccgctccggcaacagtgctgccagcagcagatgaggatcacggacgtatagtccgtcacgtagcagttgcagataat

SEQ ID NO: 19203 - DNA, 382 bp, Zea mays
  Clone ID: LIB189-018-Q1-E1-E6
ccgggccgacccacacgtcagggaacattttatgccaggtataatgacattgccaagcatgcattggatgttgtgaaaagtaagagcctagttttgactcaatcactggatgctcacaacataactgaaacaaaagagcagcctgaaggatttgacagtgattggttacataccttactttggcaaggcaatgaacttcctgctcctgtcattgatgtatgcctactactgctttgagtacaagtggaacttctttgcagtgagtctgcatgagaggcttgatttctttgaatcaaactgggcgttctttgctggatttggtgcaccatgcgtccttcgaattttcttcttctctcctcttataagctatgggtttctggct

SEQ ID NO: 19204 - DNA, 414 bp, Zea mays
  Clone ID: LIB189-018-Q1-E1-E8
ccgggccgacccacgcgtcagcccacgcgtccgagattctcaaaatgggtctcaagagtgatatgatgttcgataagtccggttttttgtcctgtcctgtcgtgaaaagttctgaactgctagtctggcgcaatgccttggctgctactgttgcgtcaaagtgatattctggctgaccgcattctcttgtgctaattggcacaggtccgattgcatcattgagtccctcaagcatcggatgtgtatattcccaaagatgtaattatgccctagtcgtagttttccccccttcaataaatcagttccatagtaaaaaaaaaaaaaaaaaaaaaaaaaaaaaaaaaaaaaaaaaaaaaagggaggaagcacaagaagaatcaagctttaagtatccgtgcaagcaaagtcaaaacc

SEQ ID NO: 19205 - DNA, 325 bp, Zea mays
  Clone ID: LIB189-018-Q1-E1-F1
gggtcgagccacgcgtccggcgcaggacttcaagacagacctccggttccagagccacgccgtgctggcgctccaggaggccgccgaggcctacctcgtcggtctcttcgaggacaccaacctctgcgccatccacgctaagcgcgtcaccatcatgcccaaggacatccagctcgcccgccgcatccgtggcgagcgcgcgtagccatcatctccggggatctgatgaatgtctagttaccaaacaaataggctgtattagcgtcgttgttctgtattcgttattttggattcggttgcagtgaaaaacagctttactaatctt

SEQ ID NO: 19206 - DNA, 422 bp, Zea mays
  Clone ID: LIB189-018-Q1-E1-F12
aattcccgggccgacccacgcgtcagaatgtaagtgctcttattgatatgaaactggagaaatacaaaaacatacgcgaagaatcagctttcttctatggagagatttctgaaggaaccctcaaatttgatagaaaagaagcagaggttgctgcactgagggagctcaagaaggaagagttggtaggcttcttcaatgatcatgtcaaggtcaatgcaccacaaaagaagattcttagtatacaagtgtacggtggtctccattctgccgagtacgaaaccatagtgcaaaatgctccgccaccgccgtcgtgtgagataactgatatttatggcttcaggaggtcgaggcctttatatggattattcaggggaggcgttggtcagatgaagctatagttcaacattttctcatcattctgt

SEQ ID NO: 19207 - DNA, 338 bp, Zea mays
  Clone ID: LIB189-018-Q1-E1-F3
ccggtctagaattcacgggtcgacgcacgcgtccgacggaatactctattcccagtagtgataaacaaaacaaagaatcttctctgtcttcgtgcgggtgtgcctgccatttccaggcccagctgttcattctcgaggctccttctcttgtagttcgtcgaccttgcgcagcagatcgagaggctgaggggagagggatccatggagctgggaaagcccctttcggcgcacagatgtagctacaccgctacctacacccactgttccataggcttctcccctcgggtcgtccgtaccagctggatccgcgcggcggctgagggcggcgacggcggggc

SEQ ID NO: 19208 - DNA, 323 bp, Zea mays
  Clone ID: LIB189-018-Q1-E1-F5
ccgggccgacccaagcgtcagcccacgcgtccgcggacgcgtgggtgagagtattttgaatatttgttctgtagacattctgttcctggcttgatgttggcgctgcacaatgacaatggtatatgcagtaggtttgatttttctttttcttttaaaaaaaaaaaaaaaaaaaaaaaaaaaaaaaaaaaaaaaaaaaaaaaaaaaaaaaaaaaaaaaaaataaaaaacaacaaaaacataaaaataaacacagcaaaaaaaaaaatcacaagaagacacaaaaaaaaaacaaataagataaaaaataaaaagggggggctccac

SEQ ID NO: 19209 - DNA, 380 bp, Zea mays
  Clone ID: LIB189-018-Q1-E1-F6
ggtaccggtcaggaattcccgggccgacccacgcgtcagcggacgcgtgggcggacgcgtgggcggagcaggtgcagagagggtcggaaaacgtggcaaggttggaactggagctccagaagatccagtacgtcttgctgaagcttgaggaggagcacgagtacagaaggctcaaagtctctgataagcgcacccgtgtgcttttgagggactacctgtatggaaggaaggaccgtggtggcgggcagaagggaaagaagaagcgggtcccgttctgtggttgtgttcgttcgaaatcaagaacagagccgtagcctttttgttctcgcacccctgcgcgttggaagaggtgaaggtgtcctttaggatggatccccttt

SEQ ID NO: 19210 - DNA, 353 bp, Zea mays
  Clone ID: LIB189-018-Q1-E1-F7
aggtacaggtcaggaattcccgggccgacccacgcgtcagcccacgcgtccgcccacgcgtccgggaattgcactcagcttaggggacaagatcactctcaagcagaaaggtggcagttaactgtgacaagtaatcgcagttgtatcatcatttttcgcatttaggaaatccacgtgccagagagagaccagtgccgtggcattgaactgagtataaatgcttttttgtacaaaaggatcgatcaaggagagagataagaggacagttatgaggaagtcacgaagttgtcggtcgaagatatatgttgctgtagtaacgaagctgttccaaacttccttgaaatagttgtgaa

SEQ ID NO: 19211 - DNA, 428 bp, Zea mays
  Clone ID: LIB189-018-Q1-E1-G10
ttcccgggccgacccacagcgtccgcccacgcgtccgcgacaaagtatattccattctatggaggagcagaataccatgactatcatcattatgtaggaggccagagccaaagcaattttgcttctgttttcacttactgtgattacttagatggcactgacaaaggttacagattccacaaaacatacctagcaaagctgaaggatctggggcataatgatggccataaaggagacggcagcggacccagctatgtgaaactggattagattgcaagatatagtgcatcttgagtgtttctatggtcatcgacttcactgtggcatttcgaaatgggatattgctgagttgggctggtcacgtgtgttctcatttctgtagcaagcatacagctttcagctctgccttcctccttcctttttttttt

SEQ ID NO: 19212 - DNA, 386 bp, Zea mays
  Clone ID: LIB189-018-Q1-E1-G11
aattcccgggccgacccacgcgtcagagctgtttgattgtgtggtcacaggaagaaaggtggacaagtgaggaaaagcttgaccatttctttccatgggagggcttgtgacgcttatagaaaggggagagcatgtcattagcttctgatgggcctctgctgccaatcggggaagcgggcaattgctgctgacgagtccattgttagctgaaaacatcatcaactttggtgatcgtaactcacagcaaaacaaaattatctactgtgccttgctgcttctggggtttgttgtagattcgccgaagtgccatatcctttattgtttgttgtccagataagtattagctgctgactgacggtgcggtgtggttgaacataagattgtgt

SEQ ID NO: 19213 - DNA, 401 bp, Zea mays
  Clone ID: LIB189-018-Q1-E1-G2
gggtcgagccacgcgtcagaaattacttcatgcaaggtgatgcgtgatcaaaatggtcttagcaaaggctctggatttgttgctttctcaactcgtgaggaagcatctcaggctttaactgaaatgaatggcaaaatgatatctggaaaaccattgtatgttgcatttgcgcagcgcaaagaagatagaaaagcgatgttgcaggcacagttttctcagatgcgccctgctgtaccaatgacacccactctagccccgcgccttccaatgtaccctcctatggctcctcagcaactcttctatggacaagcgccacctgctatgataccccctcagccaggatttggtttccagcaacaacttgttccaggcatgaggcctgggggtcctcatatgccaaa

SEQ ID NO: 19214 - DNA, 409 bp, Zea mays
  Clone ID: LIB189-018-Q1-E1-G6
tcccgggccgacccacgcgtcagcacgatcatgttctggacggtgtacgcgcagatgaccaccttctcggtgtcgcaggccaccaccatggaccgccgcgtcgggggctcgttccagatccccgcgggctccctcaccgtcttcttcgtcggctccatcctgctcaccgtgcccgtctacgaccgcctcgtggtgcccgtcgcgcgccgcgtcagcggcaacccgcacggcctcaccccgctgcagcggatcgccgtcggcctcgcgctctccgtcgtcgccatggctggcgccgcgctcacggaggtccgccgcctccgcgtctcgcgcgagtcctccgagtccgcctccggaggcgtcgtgcccaggtccgtgttctgggtcatcccgcatttcttccccccttggg

SEQ ID NO: 19215 - DNA, 364 bp, Zea mays
  Clone ID: LIB189-018-Q1-E1-H12
gtccgggaggatggtcgcacccttgcagactacaatatccagaaggagagcaccctccacctggtgctccgtcttcgcggtggttattaagccatcagtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctcgttacccaaaactatcgtgcgatcgcatatggcttaatcatgaataaatgttgtttgaatttaaactaaaaaaaaaaaaaaataaaaaaaaaaaaaaaaaaaaaaaaaaaaaaaaaaaaaaaaaacaaaa

SEQ ID NO: 19216 - DNA, 430 bp, Zea mays
  Clone ID: LIB189-018-Q1-E1-H5
aagtcccgggccgacccacacgtcagcccacgcgtccgaataaattaactggtgataaatattctgtaacagagatagtaacacgttattgcctagcaatatctaagattacttttttcacaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaagggttcaaacttaaattccgggggaaggcaatttaaaaccccttcaaaagggccccaaaattcaatttcaggggggtccttttaaaaacttcgggatgggaaaaacccgggggttaccaaatttaaaccccttgaaaaaaaacccccttttccc

SEQ ID NO: 19217 - DNA, 219 bp, Zea mays
  Clone ID: LIB189-018-Q1-E1-H9
gacccacacgtccgcggacgcgtgggccgggctcacactcgtaggcacggagtgccgttccgtggtgggtggaatcaccaaaaatgccctccgtccaccaccacctcctcctcctgacgctcgccgccttggccgtggcggcagccaccgctagcgccggcggggacccgctggcaatctatgcgcatttcgacgcctgatgcgcgggccaggggaagg

SEQ ID NO: 19218 - DNA, 468 bp, Zea mays
  Clone ID: LIB189-019-Q1-E1-A2
ggtccagaattaccgggtcgaggcacgcgtccgtagtgttcttggttggtggaatggaagctcagcagctccatttgtgttccagagatcttcgtcgttctcgttcccctcgtgtgtagcctttggtaggttggtggaagggcgaggcacacaagaaaattgatagaggggggatccccattttcagctcttcgtgtttttttgtaggaggaattcccgttcacatgatccgtgcctggacgtgacggttttgccgcgctctgctgcttccctttcggggagaagaggactcgactcaaatcatttggtatcgcagacgtcgcccttcccagttcagttgagagagatttctggcatgtccggcgcaagtaactatggatccctcatcgatgaatggttgccgccccctacacctagcccaagaactctcatgtctagctttctgaatgaagaattcagctctgcgcc

SEQ ID NO: 19219 - DNA, 75 bp, Zea mays
  Clone ID: LIB189-019-Q1-E1-A5
acccacgcgtccgcggacgcgtgggttatatacaaaatgtgtcttatattgttataagaaaatatttcataaaaa

SEQ ID NO: 19220 - DNA, 432 bp, Zea mays
  Clone ID: LIB189-019-Q1-E1-A8
ccgggtcgacccacgagtccgaccacgcgtccgcgcacgcgtccgcaaggacaacggagccgatgcgccggtgcccgggaggtacctcatcaatgatcctaacgccgaggaggtcgtagccactggcgacagcgcctgcacgattccggtcatcgatttccgcagcctgctcgatccggggtcgtccgacgaggagtgcgccaggctggcatccgcgtgccaccactggggattcttccagctcatcaaccatggcgttccggccgaggtgactgggaacctgatgaaggacgtagctgggttcttcaggcagccgctggcagccacgaaggagtgcgcgcagcaggccggcagcatctaaggctacagccaggccttcgtcgcgtcggaggaccagaagctggactgcgcggacatgctcttcctcatcgt

SEQ ID NO: 19221 - DNA, 249 bp, Zea mays
  Clone ID: LIB189-019-Q1-E1-B12
cgtcaagttcaccggcaaggccaccttcgactaatcagacctcacgtacgccgcacgccccagccgggatccaaattaaagaacttcttcttctattagttacagtacattgtcatttggctgctggtacggtggtggcatgatttgacatgtgcatgatgatccctgtgtaattttatataccaagtctcgtcatatagttacatgttcatttgcttgcttctaaagaaagtgacatccagtcaagtt

SEQ ID NO: 19222 - DNA, 416 bp, Zea mays
  Clone ID: LIB189-019-Q1-E1-B3
ggtcaagaattaccgggtcgacgcacgcgtccggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtttccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggaatttttttcctccaattaattaacggtacgcgaatggaagcgac

SEQ ID NO: 19223 - DNA, 87 bp, Zea mays
  Clone ID: LIB189-019-Q1-E1-B5
aaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 19224 - DNA, 377 bp, Zea mays
  Clone ID: LIB189-019-Q1-E1-B7
ccacgagtccaaaagacggcaatgcagacccccgcgcgcctctccgctccatcctcgccgctcgtctcctccgcgccaccgatacctgtacggccacaacgcgtcgctttcccctcccgccgccgccgtgatctcctcctcctgccggcggcgctgaccctcccgacggcgcccgccccgttgcctgcctcggcgcgagggctgttccgcatgcccccggcgaggctggtgaaccgttactttctggtgcgcccgggcgagtccgtttacgacgggcagggcctcctccgcaggacgcccgtcgctaaagacctccgtcgacagcggcctcccccccgtggggctccgtcagactgggcgcgccgcgcttcgacccc

SEQ ID NO: 19225 - DNA, 399 bp, Zea mays
  unsure at all n locations
  Clone ID: LIB189-019-Q1-E1-C10
ggtaccggtcaggaattcncgggccgacccacgcgtcagcggacgcgtgggcgtcggcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaaagaacaccggcgccctcgaccagatcatcggctagatccctacgtcgtcgttgttaagatcagactcagcagcctcgatcgcgccgccggccggcaggtgcctgcaggtggtgactttgtaacgtgtgtgcgtgcgtacgtgtacattgcatccatcttggttccaatggacatatagctcctgttgctcctct

SEQ ID NO: 19226 - DNA, 426 bp, Zea mays
  Clone ID: LIB189-019-Q1-E1-C2
gggtcgagccacgcgtccggcgacatgcacccggcgacgtggggcgcggcctacggcaacagctggaggaccaccaacgacatcgccgacacctgggacaggtcagtctgtttgttccttgcgttgcggcctcgccgctgtcctgtccagactccagaccgtttgctagcttcactgagacggtacctgccgccgttccagcatgatcgccacggcggaccagaacgaggtgtggtcggagtacgcgcgtcccggcggatggaacggtctgtactgtactgtacacatgatcagttgaacggcctgtacatatgatcagatggattcgcgccttaacgctccggtccggtggtctggcgtgtgcagatccggacatgctggaggtgggcaacgggggcatgaccaacagcgagtacgtcgtgcact

SEQ ID NO: 19227 - DNA, 464 bp, Zea mays
  Clone ID: LIB189-019-Q1-E1-C3
gggtcgacgcacgcgtccgaccacgcgtccgcccacgcgtccgaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttc

SEQ ID NO: 19228 - DNA, 280 bp, Zea mays
  Clone ID: LIB189-019-Q1-E1-C7
cccgggtcgacccacgagtccgaccacgcgtccgcaattaaggttcagatacatccttggactcttcgatcgtctcgcttaaggtaatgttgggagcagttgttcgtgatgagcgtgaatagattggacgagagttcaaaggtggtatctgtcattgtcctgtgaaatagttatgataattgttttcctcttcaagaaactatcaacatcaacggactactgaccgtgatccttcaagtcttatgctggaggccgtgctgagggttttctctctgtccag

SEQ ID NO: 19229 - DNA, 418 bp, Zea mays
  Clone ID: LIB189-019-Q1-E1-D10
ccggtctaggattcccgggccgacccacgcgtcagacagaaggcacttctagatcatgggaagaatatagaccctgtgaaattgcaattggaaaaggagaggctggaaaagaggcagcaagaagagaaagcaaggatcgaggcccaggtgaaggctgctgaagcagctgcacaacaaaagtttgaggaagaaatgaggatgaagagaaagcaggaaagggaggcagcacgcctggcactacgcatgatgaagaagactgttgatattgacaacagtgacttcctaaaggagctggagaacttcagcaaaacatggcaggcaaatccacctggcaaattaatcgtggattttatcagtggggacttgccaccggggttagggagtccgctggagaggctcggcctcttcatgaaggaag

SEQ ID NO: 19230 - DNA, 389 bp, Zea mays
  Clone ID: LIB189-019-Q1-E1-D12
ccggtcaggtattcccgggtgcccccacgcgtccgtattttttgatcataataagttcaataacacaaggcatcaacacaaacaacgtcacgttacaacagttggagacagtactacgtcctccagtccgctccagagatcaatgttcaccacgctaataacgagttacactttgaaccgggtacacacatttgtccctgccaacataaaagaaacggaaagataactacgtgctgggcagcctaatgctgcacagcgctgtcatgtcaggttaaccacgattataagtctcaaagcaaatgcgaggtattgccctagacacacaagcaacagtctcccatcggagaccaagctcccttatgtgcacctgacagcagatgcaccaggtt

SEQ ID NO: 19231 - DNA, 321 bp, Zea mays
  Clone ID: LIB189-019-Q1-E1-D2
ggcacaaaaacaataaccccagaagaaaacaaaatgtctgcttgaatttcaacaaaaacaacaacagcgtgacctcttaactacacacaaaaatgtttctcaagactcaggattcccatgcactggacggggggttgaatcttcaattttcggggggccccttttaaataattgcggccgaaggggtatcaccgcatataggccatcggtttggacacgggtggcccaaataaatttaggtaacaagggaatccataaacgttggccccccccaaatttgggattaatggccacgatccaaaattcccccgtttaacccta

SEQ ID NO: 19232 - DNA, 478 bp, Zea mays
  unsure at all n locations
  Clone ID: LIB189-019-Q1-E1-D3
ggtcaagaattaccgggtcgagccacgcgtccggatcggagtctgtctctgtcccagaactgtccgtcttggatgaatctgacgataaaatgcaatgtggtgtttctggcaaggatgaggaagcacatgtggaggagaaaactgtaactattgctgttgacaaggtaacaggaggttctgcaaatttcgaggatcctctttgtgaggcatcgaggaaggaacctgacattgagaagagtcacccaagcctcggagaagaggaagacgatacaataggtggaacagtcttccctggttcaggtagctgtgaattatcatgtccacaggatggtggcatcgcagtctacgaggggcctgagatggtgtcaccagagagccaaactgatgctcggaaagaaaacatccattcagatgtcgctgagacagatgaatgcaccaagactcagaaggccgctctagcangcacaganggagaaaa

SEQ ID NO: 19233 - DNA, 461 bp, Zea mays
  Clone ID: LIB189-019-Q1-E1-E1
gggtcgagcacgcgtccgaccacgacgtccggtgctggtggtggtggcgctgctggcttcgtccgcgtcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtacacgtacgtcccgcgcgctgcacgagtgatgaagccaggggagaaataaaataaagccgctgtattgcca

SEQ ID NO: 19234 - DNA, 290 bp, Zea mays
  Clone ID: LIB189-019-Q1-E1-E2
ggtctagaattaccgggtcgacgcccgcgtccggacagacatctggtctctaggatgcactctttttgctatcatgtacaatgtttcaccatttgagtatgctcttggtgaatctggaggaagtctgcaacttgccattgtaaacgggcagttgaaatggccaccaggacccaaacctccttatcctgatgagcttcgccattttgttaactggatgcttcaacctgaagctgcaatgcgccctcaaaattctgatgtgggtcctcaagttgacaagctcaatgccaaat

SEQ ID NO: 19235 - DNA, 477 bp, Zea mays
  Clone ID: LIB189-019-Q1-E1-E3
cggtccagaattaccgggtcgagccacgcgtccgcgagacgaaggctggcagcaccgtgactgaaggaccagcagtggtcaattctgcacctatagcagacgctagcacgggatcatctcctgccactactaggcccagacctcagtcaccataccctaattatccagatttcaagccaccatcctcgccttcgccgtcagcaccttaatttggcaagagtacaagaaaccgggtctagaggatattaaagaagttgagttgttcatatggagccggcatctcaccagaggtgcatgttgtactatgatcgtgacagtgtggctaagtcactgtggcgagttttctgcagcagtaaatatatgatgtaatgttcattaattatcaatgtgctatgattttctttttgttgtcttattttcgatacatgtaaatgtcgaattactagccgtgagaattgagagttcaagcctatagag

SEQ ID NO: 19236 - DNA, 421 bp, Zea mays
  Clone ID: LIB189-019-Q1-E1-E4
ggtcgacgcacgcgtccgaggacacgtgggtttttttttttaatataataacgaattgcataaatataaataattcgtcatcaccataaagtattactgttgtgcccaatgtccactgatcacaattttcctccccgtgcgtgagaagttagaataggcacaagctgccaggaagagattcgaaagctccgaatgagaccatatcacattggtgaatgtctaacgaggagctgcagaatgcttggagaagagcagaaatgcaactgccaaagaagacacaatggaaaaggcaccggaacatgtggtgcagagaaaacgtcatcaactaccgctctctaagacatgctcgcgatgttcacagacaaattcaggggcacgtccaacatctgggggtgatcatgtcgtcaagtggagatgacat

SEQ ID NO: 19237 - DNA, 313 bp, Zea mays
  Clone ID: LIB189-019-Q1-E1-E9
gacccacgcgtcagggagtaggcgttgaggcatcactctgagacgtcttgtgcgggattattccaaagtatgaatgcccgaagtcagacgacatattttgtagataatttgctatgctttgtgcacttatgtttttagggctttctagttgaaccggtgcccctgttctgtttttaaaattgcctctatgtaagaggctgtgcagtataagtactagcccctttgttttctgtcgaccgcattgcatggtttggttcgaacctttcgatgtcgtagttctatatgataatacattcagttgattttgataaaa

SEQ ID NO: 19238 - DNA, 423 bp, Zea mays
  Clone ID: LIB189-019-Q1-E1-F11
acggtcaggaattcccgggccgacccacgcgtcagattcttttgtttaaaaaaatctgactagatatatagaaaatactatcaatattttcattgctgagcaattttattatggaagtatattccatgatcaatctagtgatacctaatatacgctataaatattagtacttctttgtatatatttagtcattttagaagaagagacttaattccttaaaatgagttgtaaacgaaatatcaagtttcatatggaaataatggccaccctttttttaaagggtatggccacctaaagtgctggcctggattacatttgccacgtccggattcattcagtttgtatggcatacagtcatagaacgcggctaaccatcttcttacattacactgcagaactttggaattgatgggaagctagtgg

SEQ ID NO: 19239 - DNA, 210 bp, Zea mays
  Clone ID: LIB189-019-Q1-E1-F12
cagataacactttctatatttccattggcagccagtttcatcacgcaggtatattcgatgatcagtctaattagagccggaatctgctagggatacaactaactccatgaatatctttagtcaattttgacgattctacttacatccttaaaactagttgtaaactaactatcatgtttcataggaaaataatgactatccttttttaaa

SEQ ID NO: 19240 - DNA, 395 bp, Zea mays
  Clone ID: LIB189-019-Q1-E1-F4
ggtccagaattaccgggtcgagcccgcgtccgacctcaagaagccctcgctccagcttacccctacacgttccttggtgcaagtcgctgcatcagaagcccgccgctctccggttaccacgctgaaaacgccgattctcttcttcacgcctacaactttcagactcggcaggcgaagtacgccaaccgtctcaaacatacgtgatcgcctcctcgcaaatatgcccgagactagcgttcaacgcgtagaccctcagaagttggggaggatcacgttccagaagtcggaagacttgatcgatgaatgggacatacaatacgacgacgcagagggtgatgctgatgctggaacgctgaaacaggcagcccatgagcttatgagcacgaatacccccg

SEQ ID NO: 19241 - DNA, 425 bp, Zea mays
  Clone ID: LIB189-019-Q1-E1-G11
ggtctagaattcccgggccgacccacgcgtcaaattcgtgaaagtgacaaggacaaaattatatgtaatgtggatgagaaagatatagcggagcatcttcggattagattagaaaatgaccgtgaagagaaggaacgtcggaagaaggaaaaagcggaggcacacctctatactataatcaaggttgcaagggatgatgacttaaaagctcagatagggaaagacatatattttgatcttgttgatcatgataaagtcccaagcttccgtatccagaaacagatgacctttgctcaattcaaggaggaggtagcaaaagagtttggtattcctacacagtttcaacgattttggctgtgggccaagcgacaaaaccatacctaccgacctaacaggccattgtgtcctcaagacgaagcacatac

SEQ ID NO: 19242 - DNA, 392 bp, Zea mays
  unsure at all n locations
  Clone ID: LIB189-019-Q1-E1-G2
ggtcaagaattaccgggtcgacgcacgcgtccgaccacgagtccggtccgttctagaatctagacacggcaatgaagcccaggcctctcggttgcggttgcggttgcgtcncggcggcggtagggtgcgtcggctgggcatggaggccgactccgaggccgcgcgggggagggagggcagcaggggtgtcgcccaagtgctcgcactcggcggcggcggcgggagcggtacagtcggaggaccgccgccgcgaggtgctgtaccgcccggtggagctgcccgggacggggtacgggtcggagctggaggcgcggatcgagaaggtcatctacgcctgccgcttcatgaccttcttcggaatttgtggcttgctcctcggctctgtcccatgc

SEQ ID NO: 19243 - DNA, 146 bp, Zea mays
  Clone ID: LIB189-019-Q1-E1-G3
cgggtcgacgcacgcgtccgacaaaaaatcaggtccaattaaaaaatcaaaacacagaaaataaaccatcaacctcacagttgcggttgggggttccatcccggtggatgtatggtacgttggctgggcaataagagggggcgccc

SEQ ID NO: 19244 - DNA, 84 bp, Zea mays
  Clone ID: LIB189-019-Q1-E1-G6
cccacgcgtccgcccacgcgtccggtcatcgtgtgtggaaccatgacactataaagtccggaaaaacaaaaaaaaagaagaaag

SEQ ID NO: 19245 - DNA, 436 bp, Zea mays
  Clone ID: LIB189-019-Q1-E1-H1
gggtcgacgcccgcgtccgcccacacgtccgatcccagctctcatttccaatttttctgctaccaaatccaagaaacgttccaagaagaaaagcaagcacaagcaggctaagtctgctattcatgaggactctggtagacatgaaagcagttaccatctatcatcggactttgacaatgagaagagaaacataacatcaagaagcaagagaaagaaagcaaactgttctgattcatcatattctgattccgagatagatgctagaaaaggcaagaacaagtcaaagcataagcatacgaagaaataccagttagagtcttctgattcagaatttgatgtccgtgaagatacaaggcggcgtctgaagagagaccacatgaaggagaaaagagatgagtcaccattgccgttctctaaggatcaaggagacacagaa

SEQ ID NO: 19246 - DNA, 458 bp, Zea mays
  unsure at all n locations
  Clone ID: LIB189-019-Q1-E1-H2
gggtcgacgcacgcgtccgcggacacgtgggcggacgcgtgggcgaggggcaccgtgcgaagaaggacccggcgaacgcgcagaggcacaagatcgaggccggcgtggcaacggcggcggcgctgggcgccggcggctacgcgtaccacgagcaccgcgagcagaaggaggcccactacgagagcaggcagcaggagcacagggtgccgcacgggcacgggcacgggcacggctactcctactactgcgactgaaacgactgatcatcccatcgatcgagatatgcatgcagaactcgatatatatacggcccctagcgccgtacacgtgcgtgcgtgtaagtaaataagagcaaacgtcgtcacgtgtgtgttgctcgatcactactccatcgatctacttantatcgtctgcaaataacgactaagcgcatgcttctgcagccgtgtacgaatcag

SEQ ID NO: 19247 - DNA, 98 bp, Zea mays
  Clone ID: LIB189-019-Q1-E1-H7
gacccacgagtccgacagatggtatcccgaaggggttctgcattgatgtatttgaggaagttatcagtcatccgacttcccacgttcccaacccctat

SEQ ID NO: 19248 - DNA, 241 bp, Zea mays
  Clone ID: LIB189-020-Q1-E1-A7
gaagtcccggctcgacccacacgtacgcccacgcgtccggcagaggacactactcctcagaactctcccttccctcttgtaggggccaaaagggtcagagatctaggaagaagagaactagtccccaaggctagcaagagagcaagctcttctgcaactgttggcattcgccctaatttgtatccatcccaccggcaggcctatctctcgagcacccctgggcattcacttttcggccccc

SEQ ID NO: 19249 - DNA, 73 bp, Zea mays
  Clone ID: LIB189-020-Q1-E1-B6
attcccggctcgactcacgcgtccgcgctatgaaagaacttgatgccgttggtgaccagatactggagaggct

SEQ ID NO: 19250 - DNA, 367 bp, Zea mays
  Clone ID: LIB189-020-Q1-E1-C10
agcccacgcgtccgcggacgcgtgggtgaattcacccctatgttgtacccactcctcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctg

SEQ ID NO: 19251 - DNA, 300 bp, Zea mays
  Clone ID: LIB189-020-Q1-E1-C8
ggtaccagttaggaattcccggctcgacccacgacgtccgcccacgcgtccggtacgacccttcgacagtgatgttcttcttccggaacaagcacatcatgattgatctcgggactggaaacaacaacaagatcaactgggccctgaaggacaagcaagagttcatcgacattgtggagaccgtaaacaggggcccccgaaaaggccttgtccggttaatgccccaaaagaataatccaacaagttccgttaccaagaaagcaagcaatccccctaagcaatccaatggggaagtttaaa

SEQ ID NO: 19252 - DNA, 284 bp, Zea mays
  Clone ID: LIB189-020-Q1-E1-C9
agccaatgcgtactgaactcggtatagggcctcacaaagttccaggccctattcgagcatctcgttctgtgaacgatctactgatagtcatcggactatgccttttatgcggcccatcaggtcaggtatccccacggccacttcgatgagacctgcgatggcaactgctgaaccatcaacatccagtcttgttcacgctgcctgaacatcagtgacatgagattcggcagcgtcaccagtgtcaacaatagcaagggcgccggtatccgatgctgacacgaaag

SEQ ID NO: 19253 - DNA, 442 bp, Zea mays
  Clone ID: LIB189-020-Q1-E1-D1
gaattcccggctcgacccacgcgtacggctttgccttcctgcgatatgcaactgtagagcaagcaaggcgtgctgtttcagagctaaagaatccactggtgcggggtaaacaatgtggtgttgctccaagtcatgacaatgatacactctttgtcggcaatatctgcaaaacatggacaaaagaacatttgaaggataaactgaagagttatggagttgaaagttttgacgacttactactggttgaggatacaaacaatcctgggatgaatcgtggctatgccttgcttgagttttctactcgacctgaggcaatggatgctttcaggatattgcagaagagggatgtagtctttggagttgatcgtagtgcaaaggtttcctttgctgattcctaccctcaagttgatgacgaaataatggcacacgtcagaacagtatt

SEQ ID NO: 19254 - DNA, 313 bp, Zea mays
  Clone ID: LIB189-020-Q1-E1-D8
ggtactagttcggaatttcgggctcgacccacgacgtcagcccacgcgtccgcccacgcgtccggggatcatcaggatacggtggtgcctatggtggcggtggcagcggcggcggcggctatggtggtggtcagagtacgagttcttgggactgaactgaactctgattagaagtgaaaaatgggccaaccttttgggcgtgaaaaatgggtcaaccgttatcgattagtccctgttggatggagcgaatgcctgaaatttgttgcttgacatacgattaatcttgcgttgtgttgtgctaagggattggcct

SEQ ID NO: 19255 - DNA, 378 bp, Zea mays
  Clone ID: LIB189-020-Q1-E1-E1
ggtcgacccacgacgtccgggcaccgacgatgtctacaggaccgcggaggcggcgaagctgtccggaggccaggtggtgcgggagccggggcccttgccagggatcaacaccaacatcacagccatcctggaccctgatggctggaaattggtcttcttcgacaacatggacttcgccaaggaactggagtacccacgccaacgacctcggacgccctgcaacatgattaactcgcactgctgttggtccgtaattaagatgaaagctatcctagtgaaatcccaaattttcatcatgcatagaacacaggaccaccattatatttgcgacagaccctgaatcaacgatcccaatcgaataacaccagggcggccgct

SEQ ID NO: 19256 - DNA, 285 bp, Zea mays
  Clone ID: LIB189-020-Q1-E1-E4
agcggacgcgtgggatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgcatgtttcgagatggctctcccttaattaaaaa

SEQ ID NO: 19257 - DNA, 462 bp, Zea mays
  Clone ID: LIB189-020-Q1-E1-E8
aggtacctagttaggaattcccggctcgacccacgcgtacgcaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttccgtccttttcaagactaatgctgatgggaacacaacatgtgccaaggaaatgacaaagctctctggcatctctgaaatcatccccgagatggagatctgcgattttgactttgaaccctgtggcta

SEQ ID NO: 19258 - DNA, 206 bp, Zea mays
  Clone ID: LIB189-020-Q1-E1-F2
agcggacgcgtgggcggacgcgtggggcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgtggacgcggcggcgc

SEQ ID NO: 19259 - DNA, 453 bp, Zea mays
  Clone ID: LIB189-020-Q1-E1-F6
ggaatgcccgggtcgacccacgacgtccgctcaccgcgaccgggcggtgagaggtagaacggccaccagacatcaaccgtgaaggggtggcgtcaaggcagcgctgaagcggcggcgacgtcgaggctcgagctcccgtgccgcgctccgagctaacctagatgaacatactcgaaaggatacgtggaggtggcgacagggcggctgccacggagcgccccccgcggccggagtgctgggtggagatttcggagtccgtctcacggctctgcagcttcgacgccgccggcagcggttaccgcagcatctctgtaaaagttattcaggattctagacctatacatgacaaacttggttgattctttcttgaacaaatttttcccatcaggttatccatacagtgtgaatgaaggttacttaacttataccaaattccgtgtgctacagcatttc

SEQ ID NO: 19260 - DNA, 442 bp, Zea mays
  Clone ID: LIB189-020-Q1-E1-F8
aattcccggctcgacccacgcgtacgcagagggagaggagaaaataaataatagctaccagagcatttataagcaattcatcgagattttgaattcattgggcgttgaagatgttgaaacggtcggcaaaccatttgatcccatgcttcatgaggctattatgagagaagaatcatcagagtttgaagaggggattattctccaggaattccgaaaaggtttcaaactcggggaaagactgcttcgcccagcaatggtcaaagtgtctgcaggaccaggcccctgaaaagtttggagatgatgacccaacagctgtcgaaggtagtgtggcacctcaaaaggttgacgaagtcgaagacgacggttttggtgccggcgatgcagaataggtggctggagcttgatctgtgaatcaacaagaacaggtccagaaattttgatg

SEQ ID NO: 19261 - DNA, 346 bp, Zea mays
  Clone ID: LIB189-020-Q1-E1-G1
ttttaaaagtgaccgaaaatttattccgaagataaccaaacaataatagtaggtacgtacgtgacgtagatagatagatagctagctagctactggaggagggcttcctccggcgccggacatgggggaggtgaagcacctgtgcctggccaagttcaaggacggcgtcgtggtggacgacgtgctcaagggcatgaccgacctcgccgccgggatggacacggtcaagtctttcgagtggggccaggacgtgctgaaccagaagatgctgacgcagggcttcacgcaggtcgtctcgctcaccttcgcctccgccgccgagctcgccgcctacatggccgaggac

SEQ ID NO: 19262 - DNA, 412 bp, Zea mays
  Clone ID: LIB189-020-Q1-E1-G10
cccggctcgacccacgcgtacgagtacggctagtgaagtcagccacctgcagaacacacataaggcccgtgttaaaaaaaaaaaaaaaaaaaaaaaaaagctcggcagacctgactcagcgcctccattactcctttcagccggcgggtcgccgcgtccgcctcgtctctgaccaacgcgagggcagtcacctcgcctccagcgccaagggtctctacccccgccttcggcgctggcgcagccgtcgcaaccgccgcgccaggcacaactagagcgagcgggccctcgtccaatcctgcaacgcatcaacagattaaaaaaaaaaaaaaaaaagaaaaagaaaaaaagaaaaatcctagttagaaaacaaggttgaaatgaaagaaaaaaaaaaaagggggggccccccaaa

SEQ ID NO: 19263 - DNA, 393 bp, Zea mays
  Clone ID: LIB189-020-Q1-E1-G8
aggtacaggtcacggaatgtccgggtcgacccacgacgtccgagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctcggcctacgccgatgagctcgtgaagaccgcgaaaacgatcgcgtcgccggggcggggcatc

SEQ ID NO: 19264 - DNA, 78 bp, Zea mays
  Clone ID: LIB189-020-Q1-E1-H1
acaaaaaggataaaaacttacatacacatgcatgcaaacgtcataactctgggaggctgtcccctaggatcaattcaa

SEQ ID NO: 19265 - DNA, 351 bp, Zea mays
  Clone ID: LIB189-020-Q1-E1-H10
cccggctcgacccacgcgtacggttgctgggagggttatcatgggtgttactgatgaagagctccagcttcttgacgcgtttgaagacgtggagtacacgaggacaagagttgagatatcattggctgactcttccgagaacatgctggctgacacttacgtgtggagtgatgcagaggatctcaatctttatggagaatgggactttgaggagtggaagaaactgcacatgaaggatttccttgcgatgacgaacggtttcatgcacgagctcgagcagcctgaatcgaagacccgggtggagacctaccaggaattcatgcaacaacaggaacagcctgcgccggggac

SEQ ID NO: 19266 - DNA, 372 bp, Zea mays
  Clone ID: LIB189-020-Q1-E1-H12
gtaacggtcaggaattcccggctcgacccacgcgtaagggtccgggcctgtcggttgtcgaggccaccagcttcgtctccccaaagtgggtgccgcagctagccgacgcagaggaggtgctgaagggtataaagcaggagccaggcgtgcggtacccggtgctaacacctaacctcagagggttcgaggctgccatcgcagccggcgcgaaggaaatcgcggtcttcgcgtccgcgtctgaatccttctccaggtccaacatcaactgcaccatcgaggagagccttgctcggtaccgcggcgtcacagcggctgccaagaaacacgggctaagcatccgggggtacgtgtcatgtgtgattgcttgccccg

SEQ ID NO: 19267 - DNA, 343 bp, Zea mays
  Clone ID: LIB189-020-Q1-E1-H6
cgggtcgacccacgcgtacgcggacgcgtgggcacgcgcgcagtcactcacgcacgcccccagctctctccttctccctgctcgctcgctcgccatggacgctccgagcagctggaagagtcctgcgcgcgccaagtgaccggagaagctgcgagatcagagtagttgcttgccgctcccgtgccaccaaattagattggacgtagctagcagctagctgagccgtagtgcgtagcggcagctaggctgctagctcgatcgttatagctgcgtactagtggtgtcgcagcagaagcagtagccagcttcagtagccgatccggtggtaaaagcaacttttttt

SEQ ID NO: 19268 - DNA, 162 bp, Zea mays
  Clone ID: LIB189-020-Q1-E1-H8
gaagtcccgggtcgacccacacgtccggctcctcctagttttaggaacagggtcaagatatccgagtcatcaaatgaagtttcaaacagaaacagcagggctcgcgtgctgtctgctccaacaacccttaatgtggtcgatcagtttggctttccatattcg

SEQ ID NO: 19269 - DNA, 466 bp, Zea mays
  Clone ID: LIB189-021-Q1-E1-A11
ttcgcgggtccacccacgcgtccgaagaggaatccttggacaaccttaatctcttctctatcattacagtgatgtcatttttccttttggcccctgttaccttctttacagaaggtgtcaaaattactcctacatttttgcaatctgctggtctgaatgtaaaccaagtccttacaaggtgtcttttcgctggactgtgtttccatgcataccaacaggtgtcttacatgattttggcgatggtgtctcctgtcactcattctgtgggcaactgtgttaaacgtgttgtggtcattgtaacatcagtgctgttcttcaggacacctgtttctcctatcaactctctcggtactgcgattgcacttgccggagttttcctgtactcacagctcaagcgacttaagcccaagccgaagacggcttaaatagggattgtattttccatctctttgtgttaatggagtta

SEQ ID NO: 19270 - DNA, 446 bp, Zea mays
  Clone ID: LIB189-021-Q1-E1-A2
cggtccagaatttacgggtcgacgcacgcgtccgaccacgagtccgcccacgcgtccgatatgcagtcgaagatactgttatggcgagactgaaagttttgaagtctcgtcctgacaatataacctctttgagtcaaggaagcactaaacaccagctagatggaagcacaaacagtgcagataatgttgatgacactgttattgctaggctgggaattttggagtcccatcctaataatgaagccctattgggacaggaaagcagcaagcgacaactggatgcgagaacaaatagagaagatgggattgatgctgctgttatggctaggctgagaattttgaagtctcgacctgataatgaaacctcaatgggcgaatccaacaaggaacagcaagacccatgtggtgaacaattaaatggggatgaccttggtaatgtgtccaat

SEQ ID NO: 19271 - DNA, 449 bp, Zea mays
  Clone ID: LIB189-021-Q1-E1-A3
gtcgacctcacgcgtccgaggacgcgtggggttcgatctatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaacatttcgcaggaggagtaactcaacgcgccaggcgagacctactcc

SEQ ID NO: 19272 - DNA, 389 bp, Zea mays
  unsure at all n locations
  Clone ID: LIB189-021-Q1-E1-A4
gtgccggtcctaaattcacgggtcgacgcacgcgtccgaatcctcacctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtcnctgccggctccgggaacgccggcggcgggacctacgcgaaggacaagctgggcaacgacatca

SEQ ID NO: 19273 - DNA, 439 bp, Zea mays
  Clone ID: LIB189-021-Q1-E1-A9
ttcccggggccacccacgcgtccggacaccacctactgctcccctatcccctgcctgctgtgttcactaacccacctccgccccccgttccgggtccccctccccgtcagaaggttccccagatttatagcccggagtagcggcggcgacggggcatgcgctcggagcccaaaccaggttacaacgagagcaaggccatccctgattccctgatgccttcttccttgagaaggcctccgcggaggcgttcatggagcgagtcgagtcggtattgggcgaggtattcaacatcgtcaggcagtggcaaactcagcagcagaagcaggtccaggagttccaggcactacacgacacacacttggctccagatgagcattcatagtatttcgtcttccatgtcaattaacctataaactccttaagaattgacgtctccaag

SEQ ID NO: 19274 - DNA, 387 bp, Zea mays
  unsure at all n locations
  Clone ID: LIB189-021-Q1-E1-B1
attcacgggtcgacgacgcgtccgacggacagccactgccagtcaccaaacactgcacatcagggttcaccaagctgcggcggtagcagcagcagcagcagcacggggtctctagtcacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctattagcgggcatttgacatggattccggccgccggttctcagaaaaaaggacggagtantcggatgccatgtcaaatgcttagctagaggacgacatgctgtgacggcgcagatgctaaacaagggt

SEQ ID NO: 19275 - DNA, 421 bp, Zea mays
  Clone ID: LIB189-021-Q1-E1-B10
taccggacgtacattcccggggccacccacgcgtccgcacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccaaggctaactgagccgcccggcggccggcatccacgcccgttcctgcttgcctg

SEQ ID NO: 19276 - DNA, 364 bp, Zea mays
  Clone ID: LIB189-021-Q1-E1-B11
ttcgcgggtccacccacgcgtccgcaaacgcgtccgcccacgcgtccggaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatacatatgtctgttttcaaagcacaaagagttctagatgagattcgctggcgttacta

SEQ ID NO: 19277 - DNA, 462 bp, Zea mays
  Clone ID: LIB189-021-Q1-E1-B3
attcacgggtcgacgcacgcgtccgaccacgcagtccgagcatacatcaatgagccgatcactccaaggtttgtctatctgctagttttcaggttcgttcatgtgagttctgcgggagttacaagacctgaaagaccggggttagatttaagcaagcagccacctgctgttcgattgaacaaagagcttggctccattttaacttttaagttgaagggagaggatttaattcgggaaagcggtattccgtacactattgtaaggccatgtgcattaactgaggaaccagctggagccgatctcatgtttgaccagggggacaacatcacaggaaagatatcaagggaagaagttgcccgtatttgtgtagcagctctggcaagcccagatgctgtgggcaaaactttcgaagtcaagagcactgttccattcagcgaaccgtatgtgattgaccctgcaaat

SEQ ID NO: 19278 - DNA, 310 bp, Zea mays
  Clone ID: LIB189-021-Q1-E1-B4
attcacgggtccacgcacgcgtccgaattggagaatgtacttatttgcaaagacgccaatgctaagtttaattttggagataaaggttatttggcatttgaacatataacatgggctccataccagaccaagctgatagacaccgagcttctgacccctgttgagatcgactgggtgaacacgtaccactcagactgccggaagatcttggagcctcatctgaacgagcaggagaagcaatggctgatgaaagctactgagcccgtagctgcaagaggctgagccttttcgtcaacgttgcaatgcaccg

SEQ ID NO: 19279 - DNA, 359 bp, Zea mays
  Clone ID: LIB189-021-Q1-E1-B5
cgggtcgacccacacgtccaaatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgcctgcagcagcagatgaggatgatggacgtgc

SEQ ID NO: 19280 - DNA, 438 bp, Zea mays
  Clone ID: LIB189-021-Q1-E1-C11
ttcgcgggtccacccacgcgtacgcaaaaatgaatggcacaggccatcgatagattgattcatccactgatgacgatacatgcgtctgtgcttagtttacatcgaccgcttacagcaggcagccattgacattgattgatgagcacacatcgatcatgagcatacgccggctggtgcaactactacacgcctacgatctgaacaagtagagtacagagaagaccacactgttcactcgacggacggacgaacgaatggatggatctgatggtagtacacatgtacggcgttgctcagtcagttagttgccggggacgaagttcgtggcgtatgcccaggcgttgttggcgacggggtcggcgacgtggtcgaagaggttctcgatggggcccttgccggtgacgatggcctgcacgaagaagccgaacatggagaaca

SEQ ID NO: 19281 - DNA, 361 bp, Zea mays
  unsure at all n locations
  Clone ID: LIB189-021-Q1-E1-C2
ggtccacgcacgcgtccgaccttgattgcggccctgcctccctcctctccggctctcccaccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcctctcctccttcncccgggcgctcncgccgccgccgccctgggcgcgcacaactccgcaagcttcaacttcgggggcctaactaactccgaaaatgaagacccggtcccccgggtgcccgttgttcgcgctcgccaacgccgcccaag

SEQ ID NO: 19282 - DNA, 441 bp, Zea mays
  Clone ID: LIB189-021-Q1-E1-C3
ccggtccagcattcacgggtccacgcacgcgtccgaccacgcatccgcggacgcgtggggccccctgtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaagaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcaaacgggtgaccccg

SEQ ID NO: 19283 - DNA, 417 bp, Zea mays
  unsure at all n locations
  Clone ID: LIB189-021-Q1-E1-C4
gtacggtccacaattcacgggtccacgcacgcgtccgaaataatcgccaccgctctccgcaccgaatcgaagaaagcggcgatggcggcggagaagccggctccggtgcgcgtgctgtactgcggcgtctgcggcctcccggccgagtactgcgagttcggccccgacttccagcgctgcaagccctggctgcgggcgcacgcgcccggcgtctacnccgacgacctcgtcgccggtccctcctcgtcgggcggtgcgggtggcacaaggaacttgacagggtcgggaacccctccaaggcctccggaatcccgaacggtccagcagccccccaggggaagcttccgcctccaagcccgaagaggtcaaacgcctgcctggtggtaagctcaagaaaaaggaaaagcaagaggttgt

SEQ ID NO: 19284 - DNA, 458 bp, Zea mays
  Clone ID: LIB189-021-Q1-E1-C5
ggtataggtccagaagtcccgggtcgacccacgagtccgaccacgcgtccgccaaatctggtgctcgtattcagttaataccccaacatcctccagagggtgttacattgactgaaagaattgtacgtgttactgggaataagaagcagattgaagctgcaaaggatttgatcaagcaagctatgaatcagacattttcaaagcatacaaatcagtctggcggatatggtccacaaggttaccgacctcagggtcatggtgccgcttctcagttggggccacgctctcagaatcatggctatggatacccacctagaggtatgcctccacctcaaaactacaacgcaccctacggtggctacccaccgcaaggaccgtcaagaggtggcatgggctgggaacagaggccgggcccaacaacccatccttcgtaacaaggtggtggtttcgactactac

SEQ ID NO: 19285 - DNA, 428 bp, Zea mays
  Clone ID: LIB189-021-Q1-E1-C6
cgggtcgacccacgagtccgatcggtgtcgtgcgcatgtgagatctagggagaggaagaggaggaagggttgtggggaccgggggtgcaagatggcggattcacctgcaactacaagaaaagaaagagcgagagatttacagaaaccttcagagccgcggaggaggagaaggagattaggaggatctctacggcgctgacggattagttaaggaacgaaatatcacatcgtgtccggtaaccagattcagatgtgggcaccatgcgtgggtgcagggccaggccgaggtgaaagagatgaagagcgtgaccaagaatttcccgattttccatcatttattccattcttacctcctctgagtgcagctaacctaaaggtctactatgccacacgtttcaccatcatagttgggataatggtgttcggtg

SEQ ID NO: 19286 - DNA, 462 bp, Zea mays
  unsure at all n locations
  Clone ID: LIB189-021-Q1-E1-C7
tcccgggtcgacccacgagtccgaattcagtggtaatggttcatctgcaatatatcagaacaagagctccaccacgcagcagatgggtatgcagaatagaagacctacaactacatcagcagctcctacctatcccaataggatgtaccctagcccccgaccgtacacccagtatgggaattcagtaaaaactggtcttccctacgggagtaacggttatgattccaggatatatggtcgatgtggtcttggtaatggtatggataacaggtacaggcccagggcatgtagtggatactatggttatggcaatgagagtcaggatggaacaattgagttaaacagaggtcctagatctggccggttcangaaccagaaattgtacggtcatactgtcactattgctgtgaaagggcagtctctcccttctagtgaaagcaagaatgatagtgctgtgcctga

SEQ ID NO: 19287 - DNA, 365 bp, Zea mays
  Clone ID: LIB189-021-Q1-E1-D1
ggtccacgcacgcgtccgatggctactccgccccctcttaccaagtcctcctcgggttagggttccttacggttttgtggaggggcgatggcggcggctgatgtggagtaccgttgcttcgtcggcgggcttgcctgcgccaccagcaacgagtcgctggagaatgccttcgcctcctacggcgagatcctcgactccaaggtcatcaccgaccgggagactgggaggtcacgcggcttcggcttcgttaccttctcctccgagaactccatgctcgacgctatcgagaacatgaacggcaaggagctcgacggccgtaacatcaccgtttaccaggcccagtcccgtggcggtggcggtggcgg

SEQ ID NO: 19288 - DNA, 458 bp, Zea mays
  Clone ID: LIB189-021-Q1-E1-D11
ttcgcgcgtccacccacgcgtacggaagctcctccgcggggcggcgaactgctactcatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgacctttccccagaactatcccaacagcccgccatcagtaagatttacttctgggatgtggcatccgaatgtttatccggatgggcgtgtttgcatttctattcttcatccacctggtgaagattccagtggttatgagcttgcaagcgaacggtggacaccagtgcaca

SEQ ID NO: 19289 - DNA, 447 bp, Zea mays
  Clone ID: LIB189-021-Q1-E1-D12
ttcccgggtccacccacgcgtccgcaccattcgaagcactgtatggacggaaatgccagacccctctcatgtggtccaacgtgggcgaaaaagcactagaaggacctgcctttgtcaaagaggcggaagagaaggttgcactgatccgcagaaggttactcgaagctcagagtcggcagaagagttatgcaggcaacaggcggagggaactccgatttgaggaaggagacttcgtctacctcaaggtttctccaatgcttggtgtcaggaggttccaggtaaaagggaagctagccccgcgtttcgtagattcctatcccatcattggcagggtaggacccgcagcataccgtctggaattaccggaatccatgtccgacatccacaatgtgtttcacgtatcccagctccgcaaatgcctgcaagcaccagaaagtcacatcgaag

SEQ ID NO: 19290 - DNA, 135 bp, Zea mays
  Clone ID: LIB189-021-Q1-E1-D2
gggcatttcttcaaaaagaattcatgcacataagaactggataacttgtcgtcgtcacaaatggcatgagctgctcctgagacatcgcgtaggctctcgactcgcaatataccttctgatgttcgacgacgtcta

SEQ ID NO: 19291 - DNA, 327 bp, Zea mays
  Clone ID: LIB189-021-Q1-E1-D3
ccggtcgtaaattctcgggtcgacgcacgcgtccgattgcgattcgctcgctcgatcctagcttctcttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtcaaccgaggaggcggtggaggcgcctaaggggttcgtggccccgcagctggaccccagcacgccgtccccgatcttcggcggcagcacgggcgggctg

SEQ ID NO: 19292 - DNA, 402 bp, Zea mays
  unsure at all n locations
  Clone ID: LIB189-021-Q1-E1-D4
ggtccagaattcacgggtcgacgcacgcgtccgatttgagcaatgcttagcagttcatgataaactggaggcctcattgcgggatttgtctaggacaggagacattcagtcttgcaaggcagctcgtaaagctgctgacacgcagtttaaggagctatcgaaagatctgaagccactgttggcgactctacagtcatctccccagtcttatcagatattgccaaaggtanaggacttgatcgtaaaggaaaaaaaaatgcaggaaaacccaagaacagggaatccaaccttggccaaaactttgaaaaaaaactgccccggcaagatgttnagaacaagattgctttgcaacagcaaaaaattgccgccctgaaggaagaaggtgaatcccctttaaagtac

SEQ ID NO: 19293 - DNA, 350 bp, Zea mays
  Clone ID: LIB189-021-Q1-E1-D6
aggacgcgtgggcggacgcgtgggcaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatataaaaaaaaaaaaccaaaaaaaaaaaaacaaaaaacaaaaacaacccacaaaaacaacacaaacacaagaaaaagaaaaccaaaacaaaaaaaaaaaagggggggccccccaaagggttcaaacctaagttacgcttgcatgcaacgtcaaagcccttcaaaagggtccccaaaattcaatt

SEQ ID NO: 19294 - DNA, 383 bp, Zea mays
  Clone ID: LIB189-021-Q1-E1-D8
ccgggtcgacccacaagtccgaccacgcgtccgctctcctcttgcgattcgctcgctcgatcctaacttcccttccaagaagcgcagcgcccatggccatggccacgcaagcctccgccgccacgcgccatctgctggccgccgcctgtgcgccggcggcgaagccgccgcagctgacctcgcagctcgcgctgccgtcgtcgtcctcccgcgggccggccccgctccgcgcgtccaccgaggaggcggtggacgcgcccaaggggttcgtggccccgcagctggaccccagcacgccgtccccgatcttctgcggcagcacgggtgggctgctccgcaaggcgcacgtggacgagttctacgtcatcacgtggacgtccccc

SEQ ID NO: 19295 - DNA, 399 bp, Zea mays
  Clone ID: LIB189-021-Q1-E1-D9
ttcgcgggtccacccacgcgtccgcacacgcgtccgcccacgcgtccggatcgtgcccatcttttgtttgatcttcatcaagttgttgatggtcttagggaggcagagcttgggaattcctttataggaacaacaaagagaggaattggaccatgctattcgaacaaggttacaaggaatggacttagagttggtgacctgcgacatatggatatctttggtgcaaaactcaacaccctattaagagatgcagctctacgcttcaaagattttgaatatgataacaagattctgaaagaggaagttgagaagtataaaaagtttgctgaacgattggaacctttcatcaccgataccgtgcatttcgtgaatcagtcgattttgcagaagaagaaaata

SEQ ID NO: 19296 - DNA, 292 bp, Zea mays
  Clone ID: LIB189-021-Q1-E1-E1
cacgcgtccgataaaaaaacaacaaaaacaaaaaaaaatcatcatcaggttaaaggttccttaaggttttgtaaaaagggcaatggcagaagactgatatgaaatagggttgccgtcctagaaggtcttaccttagttaccattaaatagtcgctgaagaatcttctagcctcctaccgaaatttacttcattggaaggtcattaaaaacctggagactgggaagactcgggggttacgcatcttaaccgtcttgcccaaaaaccccatttcccaagctggcgaaaaaatga

SEQ ID NO: 19297 - DNA, 454 bp, Zea mays
  Clone ID: LIB189-021-Q1-E1-E10
taccggacgtacattcccggggtcacccacgcgtccgcagacgcgtgggcggacgcgtgggcggacgcgtgggcgcgcgctctttgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcaggcaagtgcgctgtacggctagctagtttttccttcagagagattgatcgagatgtgacgatgccgctg

SEQ ID NO: 19298 - DNA, 452 bp, Zea mays
  unsure at all n locations
  Clone ID: LIB189-021-Q1-E1-E11
ggtccacccacgcgtccgcacggcagcagtgcccgtcccggaggcccccgccccgatcaccgtcgtcgtcccgccgctgccgccagtcgaggtcggccgcgagccggccacgtcatccaccgccgcgtcctccgacggggcggcctcgagcagagtccaccggtgctccatctgccacaaggagttcccgaccggccaggcgctcggcgggcacaagaggaagcactatgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgangaggtgcagagccncctcgccttcaagaagccccgcctcctcatgaccgcgt

SEQ ID NO: 19299 - DNA, 402 bp, Zea mays
  Clone ID: LIB189-021-Q1-E1-E2
attcacgggtccacgcacgcgtccgaggacgcgtgggcaaagcaacacctgctttggtacggttatgatcgcaagaatggtgtccattcactctgtccagctatatggtcaaaacataggagatggttgatgatgtcaatgatgtgtctcaatccaatagcttgttcgtttatggatttgcaattccctaatgggcaactaacatatgttgctggtgaggggatatcagccagtggttttcttccgttatttggtgggttgcttcaagctcaaggaaaatatcctggagaaacaagaattagcttttcttgcaagccttggcatggaaaagatctggtcttatggtgagacccagtatacaagtcagtgtgtgccctacgtttggaggaagtgatcctgggg

SEQ ID NO: 19300 - DNA, 388 bp, Zea mays
  Clone ID: LIB189-021-Q1-E1-E4
attcacgggtcgacgcacgcgtccgaccacgcgtccgccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgccgctgcatcgaccttggcttccgcttccaaccggggcccgccgccgccttcgcctgcgcctgccccgggaagaaacgcctcct

SEQ ID NO: 19301 - DNA, 407 bp, Zea mays
  unsure at all n locations
  Clone ID: LIB189-021-Q1-E1-F10
ttcgcggggccacccacgcgtccgaatccttcacaacctctgccgagcgagaaattgtgagggacatcaaggagaagcttgcatatatagctcttgactatgagcaagagttggagactgccaagaacagctcctcagttgaaaagagctatgagctgcctgatggccaagtaatcaccatcggcgcagagagattcaggtgccccgaggtcctcttccagccatccatgattggtatggaggctgctggaatccatgagacaacatacaattcantcatgaagtgtgatgtggatatcaggaaggacctctacggcaacattgtgctcagtggaggttcgactatgttcccggtatcgctgatcggatgagcaaggagatcacttcccttgcaccaagcaacatga

SEQ ID NO: 19302 - DNA, 415 bp, Zea mays
  Clone ID: LIB189-021-Q1-E1-F2
cgacgcgtccgaggacgcagtggggcgcccagcaggccattcttctcgccttactccctcacagaacccagtaaaatattgctagtcccgccgtcgagatggccccacgccgcctgctcgtcctcgccgtcgtcgccctcgcggccaccgccgccgcggccaactccggcttcgcggactccaaccccgatccgccccgtcacggaacgccccggcttcggccctccagtccaagggcctccccgcgctcgggcggaaccgcgaagcgctccgcttcgcaagccttgctgttaggttcgggaagagctacgaaagcgcggcggaggtccacaagcggtttaggatcttccccgagagtctccagctcgtccgctccaccaatcggaaaggcctctcctaccgcctcggcatcaac

SEQ ID NO: 19303 - DNA, 456 bp, Zea mays
  unsure at all n locations
  Clone ID: LIB189-021-Q1-E1-F3
cggtcctaaattaacgggtccacgcacgcgtccgaactgaatgccccaaaagacgttgctgctaatagtttgcactaaactgacatcccattttgaggtgagactgatgaggatttctctgagactgttaacctcgtaaagcaatatcaactccctcaatacacaacgttccgtaaatctacaagttttggttgttgacattcttttcctacatgtacatcgacaacgtggtttttctaaggacgccctgctgctaagatgaagaaggtatcgagcaatgaagtgaaaaaagcggagtcgtgaactgacttcagttttcgaatcattgtcaccgtaccaaggaatggtaggcaaagtagagaggatctggatcactgagatcgcgaccggtggtgttcgcttggttgggcaatacaagggatacatccangtgctggtaattgccctgatagcatg

SEQ ID NO: 19304 - DNA, 412 bp, Zea mays
  Clone ID: LIB189-021-Q1-E1-F6
tcccgggtcgacccacacgtccgaggacgcgtgggcggacgcgtgggcggacgcgtgggggtctggggagcgtgactttgaccgtgatcgtcagtatgagcgaagcagaggaagagatagggtttatgattacagggacagaggatcagaacaccgaagcaatcgctacagaaatgggagggattctgaaagaggtggacacagatacaggagtggtggtatgacaaatgaccgagggagaatgaggagcagatcacgttctccaaccaggcatggctatggaagatctagaagtccagatcattagctgcctagctggacatttagatagttttattcacagttgggactcatgaggtagacagttcccttctgctatttattactgtacaatgggttttattgaagtgtc

SEQ ID NO: 19305 - DNA, 295 bp, Zea mays
  Clone ID: LIB189-021-Q1-E1-F8
cccgggtcgacccacacgtccgaacgcgcacgcgcacgcgcacggcgccgtgctcagccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatggatccatccatccatccatctaaagcagtattatgtatgcatccacatgggtataaatctggctgaccgcat

SEQ ID NO: 19306 - DNA, 493 bp, Zea mays
  Clone ID: LIB189-021-Q1-E1-G1
acgctgcagtgcggtcctaaattcacgggtccacgcacgcgtccgaccacgcgtccgggacaaggagggcatcccacccgaccagcagcgcctcatcttcgccggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagattcttgtaaagaccctgactggaaaaaccataaccctggaggtttagagctcgggacacatcgac

SEQ ID NO: 19307 - DNA, 237 bp, Zea mays
  unsure at all n locations
  Clone ID: LIB189-021-Q1-E1-G10
attcgncggtccacccacgcgtccgatccttgcaagccctagtataattcaaggtcttgagttcccgggcctggacctgccagattctgctggtgaagttgtagtttgtggagttcttgttctacaaggacagcgtgtgctaaatatgattgcacgatttatccaggcgaaaaggcagagaggtgatcatggagtcaaagcacaaggggatggctggttgctgactgttgctctgat

SEQ ID NO: 19308 - DNA, 366 bp, Zea mays
  Clone ID: LIB189-021-Q1-E1-G12
attcgccggtccacccacgcgtacgcacaagtttgattgattgctatttgctaccaacaaaaaatagctacacacaggttctgcgttgccttgcattcaaagcattttttattttattgtaaagaatttgttgttatttaaacttgataagtcttgacaagaaagttccaatggacttcaaaattgtaaaaaagattaacaaccccaagttcaattagcctggaaataaccttaaaggtgaattaccaaggttggaaaaagttaattcaattttaaatttttttcccggacaaaaaatggttggatccgaaattaatttaaaatggaattaaaaggaaaagttgcccttgggcaatttcaaattat

SEQ ID NO: 19309 - DNA, 497 bp, Zea mays
  Clone ID: LIB189-021-Q1-E1-G3
cgctgccggtgccggtccacaattcacgggtccacgcacgcgtccgaccacgcgtccgcccacgcgtccgggcgacccagtgaccgagatgctgttcatcatccgcggcaagctggaaagctccacgacagacggtggccggacgggtttctttaactcgatcaccctgaagcccggcgacttctgtggcgaggagctcctcggatgggcgctcgtccccaagcccaccgtcaacctgccactgtccacccggacggtgaaggcggttctcgaggtcgaggcgttcgctctccaggccgacgacctgaggttcgtcgccagccagttcaggcgcctccacagtaggaagctgcagcacacgttccggtactactcccaccactggaggacctgggccgcgtgcttcatccagcacgcctggcgccgcctgaggaggaggaagatggccaaggacctgagtctgagggagtccgtctcgtccacgggaccgtacgaag

SEQ ID NO: 19310 - DNA, 423 bp, Zea mays
  Clone ID: LIB189-021-Q1-E1-G4
attcacgggtcgacgcacgcgtccgaggacgcgtgggcggacgcgtgggctggcaggaaccagaaaaattttggaattcatggactggggtgactatggggcgaagggcaccttcattaatattggagcagtaggtgcgcagggcgtgcagatcgtgacgacggggagcgcaggggcgccagcgttgcttgggaagatgggtctgccgtgggggagtccaggcatgctacagatgagcacaggcgcgccgtggggtagagcaaaccaccgtcgtcgttgctgaatgggaaggccgttggccccaataacgcaaggcccgttctggggaaggcaagggcaaaacggggcctgttggtccgaccaaaaaaggctactggggaacttggtaccggtgaatccccccgttccccaagccaagccaca

SEQ ID NO: 19311 - DNA, 449 bp, Zea mays
  Clone ID: LIB189-021-Q1-E1-G6
tcccgggtcgacccacacgtccgaccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattca

SEQ ID NO: 19312 - DNA, 386 bp, Zea mays
  Clone ID: LIB189-021-Q1-E1-G8
cccgggtcgacccacgacgtccggcattgtgaagcccgggtgctcgcaggatgtccttaaagcagcggtaagcgccatggcttctgtgacggagatgttgaccatcatgtcttccctttcatttagtggacaggcgaccatctgaaggccaagctgaagatgtcatatgctgttgcgctgtcatgtcccgaacatatttgtgtttttttgggaaagaaacatacaattttttgttctcattctagtatcgtctacctatgtcaaactacaatatgataggacccttgcgaaataattgtttcgtttgctggtatttctcatctttgatgctaaaaaaaaaggacatattgtgtaagaaagttcaagggtgcacatcacaccaatat

SEQ ID NO: 19313 - DNA, 416 bp, Zea mays
  Clone ID: LIB189-021-Q1-E1-G9
ttcccgcgtccacccacgcgtccgcagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctg

SEQ ID NO: 19314 - DNA, 443 bp, Zea mays
  Clone ID: LIB189-021-Q1-E1-H1
ggtccacgacgcgtccgaccacgagtccggttttcctggcagcaagcagctcactgaaggggcaaagtgacaaagagaagtatgagaagtccagaaaattgaagggtcatatacaaagaattcgtgagaattatacaaaagatttcaaaaacaaagatgtgacgaggaggcaaatagctgtggcaacataccttatcgataaactagcccttagggctggcaatgaaaaggacgacgatgaagctgatactgttggttgctgtacgctgaaggttgataatgttacatgtatgcctccaaatcagattcagtttgactttctgggtaaagattcaataagatactttaacaccgtagaggttgaagagcttgtgtacaacgcaattgacggtttccgtgctggaaagaagccaggacaagatcatttgacaagattgatacat

SEQ ID NO: 19315 - DNA, 386 bp, Zea mays
  Clone ID: LIB189-021-Q1-E1-H11
ggggccacccacgcgtccgcacacgcgtccgcccacgcgtccgcccacgcgtccggccaacaactaaaggcaggcgcggcacaccgcgacaccgtaccggcctagacacttggagaaaggagaagcagcgcagcggcatgggcaccagtcccgtcatccctgcgacgatgctcgtcgtcgctctccttgtcgctagtagtactgtctgcttcggcgccaccgccaccgacaccgacaccgacggcgccattcgtctccccagcagctctggtgctgttggtcgaccgtgggagtgctgtgactatgtcaccaaggagccgtttatcaagccgccccggtggcgctgcaacgacgtggtggacaagtgctccgccgactgccaagag

SEQ ID NO: 19316 - DNA, 350 bp, Zea mays
  Clone ID: LIB189-021-Q1-E1-H2
ggtcgacgcacgcgtccaacggtgacttcgccagggcctctggggactacgccattgtgatcagccacaaccctgacaacggcacatcgaggattaagctgccctctggcgccaagaagattgtccccagcagctgccgtgccatgattgggcaggttgctggtggaggcaggactgagaagccgatgctcaaggctggtaacgcgtaccacaagtaccgtgtgaagaggaacagctggcccaaggtgcgtggtttggccatgaaccctgtggagcatcccaacggaggaggtacccaccacaaaatgggtcagcctccaacggtcgcccaaaaccttcccctggccaaa

SEQ ID NO: 19317 - DNA, 406 bp, Zea mays
  Clone ID: LIB189-021-Q1-E1-H4
cgcgtccgaggacgagtgggttttttttttttattccatgccattatgccaagtagatggtcacagttgctaaagggtaattagccttctttttaccgtggccttacaagtataggtaggagcactatatcacaacactcttacatctacgttactacgtatggtccggatctgactcagggacgatccctcctccttaccacttcacttgctcatgaaagcgatgcccttctgaatgctctcgcccagttccttctttgccgcttcaagacaagctccctcgaatcaatcaaggggcaaaccggaaggtttcctccggtccaacaagggcaaacctcaatttccttggaaagaacgggaattccggcaactccgatgcaacatatgagcaatccacgaatccaac

SEQ ID NO: 19318 - DNA, 427 bp, Zea mays
  Clone ID: LIB189-021-Q1-E1-H6
gtcccgggtcgacccacacgtccgcggacgcgtgggcaaaaccagagccaaagccagagcctaagcccgaaccaaaaccagagccaaagcctgagcctaaacccgaaccaaggccagaacctaagccagagccaaagcctgagccgaaaccgaaaccagatccaaagccagagccacaaccaaagccagagcctaagccagaaccaaaaccagagccaaagccagagcctaagcccgaaccaaaaccagagccaaagcctgagcctaaacccgaaccaagaccagaaccagaaccaaagccagagcctaaacctgaaccaaaaccgataccagaaccggagccacaaccaaagccagagcctacgcctgattcaaaaccagagcctaaacccgaaacataaccagacccccaaccaaaccagaacct

SEQ ID NO: 19319 - DNA, 462 bp, Zea mays
  Clone ID: LIB189-021-Q1-E1-H8
ggtctagaagtcccgggtcgacccaaacgtccgcggacgcgtgggcggacgcgtgggccggctcccctttcccattggcctccacgatggcgctccgcctcaacgacgtcgcgctctgcctctccccgccgctcgccgcccgccgctgccgcagccgcagccgcagcagcggcaggttcgtcgccgtcgcctccatgacgtgcgccgtctccaccaaggtcgagaataagaagccatttgctcctccaagggaggtacatgtccaggttacacattcaatgccacctcacaagattgaaattttcaagtcacttgatgattgggctagaaataatatcttgacacatctcaagccagtcgagaagtgttggcagccacaggatttcctccctgaaccagcatctgaaggatttcatgatgaagttaacgagctcagagaacgtgccaaggaaatccctgatg

SEQ ID NO: 19320 - DNA, 411 bp, Zea mays
  Clone ID: LIB189-021-Q1-E1-H9
ttcccgggtccacccacgcgtcagcagacgcgtgggctcggaatcagactgacaataccgtcctcaggacaaggcacctcagaagcccttctcgtccgcgccgcctccttgaccccgctggccggcgagctgctcagcgcggcttttttttgcatccacaatgccgcagcttggcacatgttcattgcctggagctgcaatctatggcacttcaactaggagatttggaggtttggagtttcagcagcataaagttaatcacatctcatttggtcggaaagcgtctgttaaagcaacattgaaaactgtgagatgcaatgccactcaaacaaaaagcgtccaaaagaaatcttcaagtgcaactattcagcgtgataagaaaggaaatgtacaagggccaaaactggatga

SEQ ID NO: 19321 - DNA, 327 bp, Zea mays
  Clone ID: LIB189-022-Q1-E1-A1
taccggtctaggaattcccggctcgacccacgcgtaagcggacgcgtgggtgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctgttaaatttcgtgtaagttggtcctgccgatggagaatcgagcagccccctttttttgttctatcaactatgctgtaatgctggctatgtttcggcaaaaaaaaaaaaacaaaaaaaagggggggcgct

SEQ ID NO: 19322 - DNA, 452 bp, Zea mays
  Clone ID: LIB189-022-Q1-E1-A6
gaattcccggctcgacccacgcgtacgcccacgcgtccgcccacgcgtccgctctgtcactgacgatggttgaacgtcggatcgtttttttgagaagaacctatttggagctggaacagagacgacctcgaccaccgtcgaatgggccatgtcgctgctgctgaacaatccagggacactcgagaaggcacgagaagagatcgacgccgccgtggggcactcccgcttgctcaacgcgggcgacctgccgcgtctcggctacctcaggtgcatcatcgccgagacgctgcgcctgtaccccgccgcgccgctgctgctcccgcacgagtcgtcggcagactgcaaggtcggcggctacgacgtccccgccggcacggcgctgctggtgaacgtgtacgcgattcacaaggaacccggctgtttggaaggagccgggcaggttcgtgccggag

SEQ ID NO: 19323 - DNA, 354 bp, Zea mays
  Clone ID: LIB189-022-Q1-E1-A7
ttcccggctcgacccacgcgtacgcccacgcgtccgcccacgcgtccgcccacgcgtccgcttatctgctaatgcatggagtagttggtctcatcatgggtactgtttggagattggagaccaactggattgtctccatcatcctctgctccattgtccgtgccctgggagcttgtggttacgtgctagtgtcatcgtttctgataagagaaaatattctcgcgctgataactgttaacattcatgcttcgttgacatacatcctgacggcagctggcgtgaacacaattccttccatgggcacaatatatctactctttgggacactgcttctacttaattgtgggttcctcg

SEQ ID NO: 19324 - DNA, 245 bp, Zea mays
  Clone ID: LIB189-022-Q1-E1-A8
ggtactagttaggaattcccggctcgacccacgcgtacgcggacgcgtgggcggacgcgtgggatcagcatacctgctgctgccgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggt

SEQ ID NO: 19325 - DNA, 481 bp, Zea mays
  Clone ID: LIB189-022-Q1-E1-A9
ccggtccgaaattaccggggccacccacgcgtccggagtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggggaagaatctggaatctggtctgca

SEQ ID NO: 19326 - DNA, 391 bp, Zea mays
  Clone ID: LIB189-022-Q1-E1-B10
gggtccagccacgcgtccgcattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactccgaaatactccaaggcacgttatgatgagattgtgaaggaagtctcatcctaactcaagaaaattgggtaaaacccctataagaatgcctttgttcccatttccggttt

SEQ ID NO: 19327 - DNA, 383 bp, Zea mays
  Clone ID: LIB189-022-Q1-E1-B12
ggtccgaaattaccgggtccacccacgcgtccgcacacgcgtccgcacacacacgcacacacactatcgtccagcaagctcgctgttgcttgccacccaccgcctcagctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgtccgtcgccgccgccgacttcgcgccaccgagcagcaaggccaggttcaggagcaagatgacgaggtggtggacaggaacatcctcccctactgcagcatcgacag

SEQ ID NO: 19328 - DNA, 395 bp, Zea mays
  Clone ID: LIB189-022-Q1-E1-B5
aattcccggctcgacccacgcgtacgcccacgcgtccgcccacgcgtccgggcaatatgccatttgttccagcaatgaactctactgcttctgttgatgatcttatcatgaatctgcactctgaccagggaagtaactcctttggctgctcagacttgggctgggagaatgataccaagacaccagacatcacttccattgctcccatttccactattgcggaaggcgacgagtctgcatttgtcgacagcaattcaaacagctcatttgtgcttcctgccctggagaacagtgctgttgatctcactgatgggctgacagatttagaatcctatatgaggtttcttctggatggtggtccaagtgattcagttgatagccttctgaaccttgat

SEQ ID NO: 19329 - DNA, 404 bp, Zea mays
  Clone ID: LIB189-022-Q1-E1-B6
aattcccggctcgacccacacgtacgcccacgcgtccgcccacgcgtccggtataaaaatgattgtacagagagtttacctgtggaccatctgagaggagatgtggccttgtttacaaatgtatgtttttccttcatatcttgttgatgtattgcattttgtgcatccttgatagaaccagggctcattgtcagcaattcttgttacaatcatggtgcattcgaaacgtttgctctgtaaatgtaatgattattaagtaattatataagttctgtaacaataattttaaatatacattttattggtgtagtatgtcttaccatttcatcaaatgggtcgactaatttcatttctaaaaatgtcttttgctcaatcttgttctgcatctcgttcaatgtccgaat

SEQ ID NO: 19330 - DNA, 362 bp, Zea mays
  Clone ID: LIB189-022-Q1-E1-B7
aattcccggctcgacccacgcgtacgcaaagaaagctacaaggatatttgttccttgtgatttcatttcttcctttggagtagctatcttcacttctaatgtacggctcccaaggaagaaatgaaatcacaaggaacaaagaaagctacaaggatatttgttgctcgaattccacagtcagtggacgagtcgatgtttcgtaggcattttgaagcttttggagaaattcttgatctttacatgccaaagagtctgtggacagcatcatgcaagagtcacatgagcttgatggcacaacagtagttgttgatcgcgcgactccgaatgaggaagatgtaagataccccccgagtagaccatct

SEQ ID NO: 19331 - DNA, 375 bp, Zea mays
  Clone ID: LIB189-022-Q1-E1-B8
ggtactagttacgaattcccggctcgacccacgcgtacggatcacacattggccttgcagttgcactggtgcttgctcataattagttcatcagcaaacaccacacattggcaccgaggctagcgtgcctcctagctctggccatggcagccatcgtcgtcgcgccgtgcacggcccagaactcgccgcaggactacgtggacccgcataacgcggcgcgcgccgacgtcggcgtcgggccggtgtcctgggacgacaccgtggccgcgtacgcgcagaactacgcggcgcagcgccagggcgactgcaagctgatccactccggcgggccctacggcgagaagctcttctggggctccgccggcgccgactggt

SEQ ID NO: 19332 - DNA, 359 bp, Zea mays
  unsure at all n locations
  Clone ID: LIB189-022-Q1-E1-C10
ccacgcgtccgcgaaagacacgatactcgnctggcggcctcgtacggcagcgatgcccaaggctcgtcattacggtcccgttcgtgcgttcgaagatgcactaccacagaacgttgctcttatatatacacacttcactatgttcactgcgtcagacaacatttctatagctcttgtaaccccatcgccagcgatggagctggctaatattcaatatcatgcaaatcaggcgcctgcgtctgtatgacaacagcggatatcgagcctgaaggcaccaatgctgctacgtacacgtcaccagactgcgatctacggcatgtgattcaatcctgcgggaactgtgatagcatcaggttccc

SEQ ID NO: 19333 - DNA, 417 bp, Zea mays
  unsure at all n locations
  Clone ID: LIB189-022-Q1-E1-C12
gggtccagcacgcgtccgggcttatcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcncgtggcggtggcggtggcggcggtggctacggcggcggtcgcggcggcggcggctatggtggcgggcgccgtga

SEQ ID NO: 19334 - DNA, 374 bp, Zea mays
  Clone ID: LIB189-022-Q1-E1-C4
cccggctcgccccacgcgtacgaagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttg

SEQ ID NO: 19335 - DNA, 453 bp, Zea mays
  Clone ID: LIB189-022-Q1-E1-C5
gaattcccggctcgacccacgcgtacggaaaaaagaagcaggccaaggacgagctggaccgccagaagcaggcggagaagaagcggcgccgacttgagaaagcgctggcaaactcggctgccataatctcggagctggaaaagaagaagcagcagaagaaggaagaacagcaaaggctggacgaggaaggtgctgccatagcagaagcagtcgctcttcatgtcctcataggcgaggactccgatgaaccctgccatttgatgctgaacaagcaccatataaggtgcaaccattgggccccctcggctgcttttgaattcaccgtggacgcacagcccgccgaggtgtacccgtctgaggatggactggtatgcggcagccatgcgtatgctccaagagcccccaaggggaagcgggctgattgggggattggacaggcactgccatgctggg

SEQ ID NO: 19336 - DNA, 329 bp, Zea mays
  Clone ID: LIB189-022-Q1-E1-C6
aattcccggctcgacccacgcgtacgacccagtcccggccttgtgctagtaagtagcaagcagtgttaccttttggtattttaaccagcagctaagttcgcggcattttagtccctgtaagcggtaagcagctctgtagcgtgagatagatggccaagcgccggtacgtacgtgtagtgtctggtcttctcactgagtgtactataaagagttaatataggagctgaccctgtgaacccgcgtgatggatgcatatgcttagtgcaaaaaaaaaaaaaagatgaaaaaaaaaaataacaaaagaaaacaaaaaaaatcaaagactacaa

SEQ ID NO: 19337 - DNA, 369 bp, Zea mays
  Clone ID: LIB189-022-Q1-E1-C7
ggtacaggccacgaattcccggctcgacccacgacgtacgctagcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaac

SEQ ID NO: 19338 - DNA, 464 bp, Zea mays
  Clone ID: LIB189-022-Q1-E1-C8
ggtacaggttaggaattcccggctcgacccacgcgtacgagccgaagaagatgcaaacttgaataggcaatcaaaaccagccattaacaaacttatgaagcttcctctgctcatagatgttctctccaagaagaatcttcagcaggaatttcttgaccacggagttctcactcttctaaaaaattggcttgagccattacctgatggaagcatgccaaacatgaatattcgatctgctgtactgaaattattaactgattttccaattgacttggaacagtatgaccgaagagagcagcttaagaaaagtggtctgggaaaggtcattatgtttttgtccaaatctgacgaggagactactgcaaataggaaattggctaaggagctggttgaataattgaatccaacaattattcaacaggagcacgagatttgaggacatgaagagatatgatgatgaaaga

SEQ ID NO: 19339 - DNA, 434 bp, Zea mays
  Clone ID: LIB189-022-Q1-E1-C9
gcgtccggagagctccttgctgcggctgcttgctcccctcatctctagcctgtacactggttggagtggttgccagtgttctccccacctgctcctctcgatccactccatcccctttggccatgggtgtgcaagcatacatctacggtaattgcatgcttctcctgccttgaagcggaagccttagccttagcctgccgcctgggggaaaccttctgtttcgccgctgccgctgctgtggtataaaggtggaaggctgatccgtcgacggacggagtcccggcggagggaagattgctccgtcgccgcggtttcgcggccaagaaggtggcctacgcggtggaaaggggccgggccgggccgttaaggaatcttgctccgacgccaatccctcctctgcccctcgattttcgggcggttgtcggtgctgcctt

SEQ ID NO: 19340 - DNA, 342 bp, Zea mays
  Clone ID: LIB189-022-Q1-E1-D10
ggggccagcacgcgtccgcatgtatccaagctttagatattgaatccactgaaggacaaatatatgagattaactcagttaagggtgaagggcccggaactgacccagagaaatgggaggagctattcagatctgctcggtcagactagtggcattctgcaaagcgtagtaacgtaatgtaggaatatgcatcgtaatacaatgtaatccatagagtgcagccctaattcaatagtcactgaacagtagcgatcatgtagagaatatttggtttgtgtacatagtatgagcattcatatatgacgattatacctcctaaaagtgatagtttttgttggaaaa

SEQ ID NO: 19341 - DNA, 403 bp, Zea mays
  Clone ID: LIB189-022-Q1-E1-D12
gggtccagccacgcgtccgcccacgcgtccgactagtgattcactgaacaaaaaaaaattacaagaaggaatcgagagcaaatgctatcttcaaccacactccgaccgccggcgccggcgccggcgccggcacacctcaccatctgctcctcgcccgcagcgtggcggcgtgcgccggcggtgcgcgcggtgcggaactacgactccatcccgaagcgggagcccttcagctccagccgcagcatcctccacgagttcctcaggcaggacaagcccctcatccagcgcaccaaggaccagatcacagattattgcacggccatcgaaggcgatgagtgctgcagctgttgggacgcttactttgaactgaataaacttgagcaagagctgcccaaagacgaaa

SEQ ID NO: 19342 - DNA, 372 bp, Zea mays
  Clone ID: LIB189-022-Q1-E1-D2
ttcccggctcgccccacgcgtcagcagacgcgtgggcaagaaccaggcggacccgccgccggccgaaggcctgcccctggaccgctgggccggggccaggtacgccgccgtgcgccgcttcgggggcttcgtggcggacgtcgacgttcgggagcaggccgcgcgcctcgaggccaacctccagggcacccggtgggccgccgccgtcaacgacgcgcgcagggccgacccggcctcgccctacaccgtcgcgcagtacaactcgcccttcgagttcaccggcagggtcaacgagatctggatgctcttcgacgccgacgacgacgccagtacttcgtgatgcgattccaagcgtgctctgggggcacccac

SEQ ID NO: 19343 - DNA, 423 bp, Zea mays
  Clone ID: LIB189-022-Q1-E1-D4
tcccggctcgccccacgcgtcagcacacgcgtccggcgcgatgtccaccatcagcagcggcgtgaactccgccgtggcgcagcaggctcgtgtgggggcgtcgctgctccggctccacttccacgactgcttcgtccaaggctgcgacgcgtccattctgctgaacgacacgtccggggagcagacccagccgccgaacctaactctgaacccgagggccttcgacgtcgtcaacagcatcaaggcgcaggtggaggcggcgtgcccgggcgtcgtctcctgcgccgacatcctcgccgtcgccgcccgcgacggagttgtcgcgctcggcgggccttcgtggaccgtgcttctgggcagaagggactccaccggttcgttccctaaccaagaaagccaactccaacttcggacttcaaccct

SEQ ID NO: 19344 - DNA, 363 bp, Zea mays
  Clone ID: LIB189-022-Q1-E1-D5
aattcccggctcgacccacacgtacgcggacgcgtgggcggacgcgtgggcggacgcgtgggctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgattcaaggtggacgtgtgctgt

SEQ ID NO: 19345 - DNA, 382 bp, Zea mays
  Clone ID: LIB189-022-Q1-E1-D6
aattcccggctcgacccacacgtacgaagcaaccacgcccccacgcccagtccaaccccaacccgcgaagctggcgcgcgaggcggccgacgcgagcgcccgcaagcgcaaggcgggggacggcggcgaggtccccgacgccaccgcctcggcagaggtggccgcagcgccgacccccggagaggacgcggccatgggcgacgttccacaggcgccgcacgctgcgggaggtggagaagagtgggcggggccggaccctaaccctagcccgagcctcggcggctgctcggaccccgtgtcggtggagctctccatgggcggggactactaccgcgcctgctgcggcgagcccgatcccgacatccccgaagggcccaagctg

SEQ ID NO: 19346 - DNA, 374 bp, Zea mays
  Clone ID: LIB189-022-Q1-E1-D7
ggtactagctacgaatgcccggctcgacccacgacgtacggcaaataagtgatctttctgctaatgggactgccattgaaagtaatgataatacccagccacctgtgcaagtgcccaaagaggatccaaagaaggccctacttgttgctcctccccctccaactcagatggatgttactaagaaatcttatgcatccattgtcaaggtcatgaaggagggcccaccaactccagttgtcaaaacaacatcgtcagtttccaaacagaagccagctcctaaaccagtgtccacggctgtcgaaggcctagagaaaccatctgagaaacctacccaggctattggaaccggtgatgggattgtttgccataacaac

SEQ ID NO: 19347 - DNA, 462 bp, Zea mays
  Clone ID: LIB189-022-Q1-E1-D8
ggtactagctacgaattcccggctcgacccacgacgtacgctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggccgccgtggctaacgggggcgtccccggcgccggcggttatggtggcggttgccgtgacggcggttatggcggcggtggcggcta

SEQ ID NO: 19348 - DNA, 81 bp, Zea mays
  Clone ID: LIB189-022-Q1-E1-E3
ccacgcgtaagccaatgcaaccataatacatgattcaaaacaactggaaaaaacaagtccagcaattttcaccttgtaatg

SEQ ID NO: 19349 - DNA, 388 bp, Zea mays
  Clone ID: LIB189-022-Q1-E1-E6
ggtactagctacgaattcccggctcgacccacgacgtacgcaaggatttaggtggcgttaatcttttggctgttgacatgtagtgaacaagtcaagtacaagtagcaattgacaagatcacaagaaccttttggctctcatgaacacttgatatggatcttttggttctcatgtttttactcaatggtgaacttgtaatgaacttgtaacagatgtgcttttgggagcggtttgcacatctgttgatgcgcacctatgttgtaagcacattgtatgtgttaatttggaaatttggatgtttaatgtggtgaactagtggcgccatgctaggggtggtggacactaactggatattaatctagctgtgaacatctgatgtctgatgtga

SEQ ID NO: 19350 - DNA, 407 bp, Zea mays
  unsure at all n locations
  Clone ID: LIB189-022-Q1-E1-E7
cccggctcgacccacgagtacggggaagagcggaatggtcagaagctagcagcttcaatggtagagtaccagggccagtgggtgataagagaggcagtggccctctgaagagttctgctggagtgcggatgcgagaggcacagcctaccaatgttctctgggttggttttccaggttcttatagagtcattgatgaggaggcacttaagcatgccatgtcagtattcggtgtcgttacgaagataaaagttttccagacaaggcagtatgcttttgttgagtttgcaaatgttgcggaagcttgtaatgctaagatgaatctanatggtcatcttttcaatgattccaggattcagattcttttctcaaacagtgggcttgcaacaaacaaattgggccaaccaaca

SEQ ID NO: 19351 - DNA, 394 bp, Zea mays
  Clone ID: LIB189-022-Q1-E1-E8
aggtactagtcaggaattcccggctcgacccacacgtacgattcattctaggaagtctcactctggccctaatcatgctttcatgtataagggtgagacatctagctctaggcaatcaacccatgctaagttgcctagaaagaaagctcctagtgcatcaaatgatcataatatttcatttaaaacttttgatgcatcttatgttttgactaacaaatccggcaaggtagttgccaaatatgttgggggcaaacacaaggggtcaaagacttgtgtttgggtacccaaagttcttgtatctaatgccaaaggacccaaaaccatttgggtacctaaaatcaagaactaaacttgttttgtaggtttatgcatccgggggctcaagttggatact

SEQ ID NO: 19352 - DNA, 383 bp, Zea mays
  Clone ID: LIB189-022-Q1-E1-F1
tcccggctcgacccacgcgtacgaaaaatcactacgtccattttgagaatggtgggtcaggagccctgcaatgtggttcctccaacgtatttgatcccccacttgaaggccaagctaccaataactatggtggtgtgaaagccgggagcaactcaggcagcaacaaggggcagaacaatgggagtacggctgctgcaaatgctggactggcagaaacggagatacaggccatggacaaaagtggagttggaggtggcaatggcaatgggagtggcagtggcagtggcaatgacacatatgtcagacggcttgctgcgaacatgacaccgcgacaagcacagctaaagaaatatagagagaaaaagaaagaccggaactttggg

SEQ ID NO: 19353 - DNA, 426 bp, Zea mays
  Clone ID: LIB189-022-Q1-E1-F5
aattcccggctcgacccacgcgtacggtggttgcttcagggcagcgggcaacatggtggaattgctgtggcctttttgatgcttttactggttcagggagatagatgaagcgttagaacttgaagtcaagaagacagaaaatgcggtgacgttcagttcaaagctgatgagcagctgtaactagactttgtcacatgaatgatgaagcagaaggattccggataacatcgagctgatgttttcacttccttcctccctgtgtctctgcatctgtgcaaagttacatcccctggtcgcggttaatattcttaatttccttagcacccccaacgcctagtcgtgtcgtctaggtactggtcttgtagcatagtaagtgttgaagtgggttcaccgttaaagatgttttgggggttccggctttttttt

SEQ ID NO: 19354 - DNA, 427 bp, Zea mays
  Clone ID: LIB189-022-Q1-E1-F6
aattcccggctcgacccacacgtacgcggacgcgtgggcgcgcacgcaacgcaaaaacaagcacaaacacgcgcgatccgatctgggccggccaagcagccacccatccatggcgactagggtttggctcaccgccctcctgcttggtttcctcgtcgccgcctcccccttcaccggccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgtcttcccaaaaaatgctggcaaaattgtactatcaggtgaagaaactgaattactagttggtccgcaaaatgaccgtgaatccattttggatggtggtggcggtcca

SEQ ID NO: 19355 - DNA, 352 bp, Zea mays
  Clone ID: LIB189-022-Q1-E1-F7
aattcccggctcgacccacgacgtacgccatgcgctccgccgggacggccacggcgatctcctcgctgatgctgccggacactatcgtcgtgctaggctgctgctacgtactgtaagactgttatgtttgtgctcactgcacgatcactatcacgacctacttactatatacatgtggctgctcggttggaccggagcttggtgacgtggaaatcttggtccactagatcacgtggtttgaccgcgagaaaatttcacagaattcgttcggacaggtacaggatagtacaggtgctgaccagaaatagacacagtagttgtcttcccacataaatgctggcaaaattgtact

SEQ ID NO: 19356 - DNA, 71 bp, Zea mays
  Clone ID: LIB189-022-Q1-E1-F9
aaaaggatcaaagcttacttacacgtgaatgcaacgtcaaacctcttcaaaagtgtcaccaaaattcaatt

SEQ ID NO: 19357 - DNA, 307 bp, Zea mays
  Clone ID: LIB189-022-Q1-E1-G2
ttttgaattctgaaaaaaaataagtatggaccaccataatgatgtacacaaaccgaaggcctctagcctctaggagtgctgctgttgttacacgttagaacagggcgctccgattaggagcgaaaacacatggggagagaggcataccacccaccacctgtggggtgggggtatcctttcatgggagtagtagagatctgctggagacaccgttccactatgttctcttgaggatgtagccgacgacgatgcccaggaggcccacgacaaacaagaacgtgatggagaaaccgctgccggttttgct

SEQ ID NO: 19358 - DNA, 447 bp, Zea mays
  Clone ID: LIB189-022-Q1-E1-G6
aagtcccggctcgacccacacgtacgcctcgccgctgctcaactgcgggcgcgcgccggctgcggcggcgtcggtcgagcacctcgcggtggtttcgccgttgttgtcaccggcagtggcggcgcctaggcatgggccggtgctgtgccgcgccatgtccgagggggacctcgccgcgccgctcgtgcccaagaaggacgatggacacgggagggcgccgaggctgtccctgtccgcgtccttgtcctcgtccgcctccatcttcgtcgaggaggaggacggcgagggcgaggaggaggaggacctggtcgcggtcgcgggggccggcgtggacgtgccgctgccgctgcgtcggctgctgacgaacacggggctggacgtgtccgccgccgccgggctggggttccttgaaccagggcgtcgggggcagcggcgggggcgggaagg

SEQ ID NO: 19359 - DNA, 428 bp, Zea mays
  Clone ID: LIB189-022-Q1-E1-G7
ggtaccaggtaacgaattcccggctcgacccacgacgtacgcccacgcgtccgcccacgcgtccgtgaggatggagtcatccgctacctgaaatctggtggtctactaattggcaggacaattgcagtattcttgacactgacactagctacatccctggctgcaagggaagggcctgttccaatggcgggctatgagatatgcttgcaagtgtggttaacaatttctctgctcaatgatgctctagcccttgctggccaggctctacttgccagcgaatatgcaaaagggaattacaagcaagcccgcacggttttatacagagtcctgcatgttggtggtgtgactggttttgtccttgctgcttccttaattgttggatttgggatcttggccttgctgtttacagatgattcaaccattttaaa

SEQ ID NO: 19360 - DNA, 452 bp, Zea mays
  Clone ID: LIB189-022-Q1-E1-G8
aattcccggctcgacccacgcgtacgcccacgcgtccgcccacgcgtccgcccacgcgtccgagagccgaaagaagttgaagaggcaacgaagggtgagaaaaagaagaagactattacagagaaatattgggattgggaactagccaatgagacaaaacccatatggatgagaaatccaaaggaaattgagaacaccgaatacaatgagttctataagaagacattcaatgagtttttggaccctcttgcccacactcacttcacaactgagggtgaggtggaattcaggagtgttctttatgttccaggcatggcgcctcttagtaatgaggagataatgaaccccaagaccaaaaatatccggctatatgttaaaagaatcctcatcccctaagaacttggatggtgaacggttcccaagatacttgagctttgtgaaaggtgtggtgg

SEQ ID NO: 19361 - DNA, 78 bp, Zea mays
  Clone ID: LIB189-022-Q1-E1-G9
ccaaggggttccaacgcttacgtccgcgttcaggtcagttcacagctcttctatagggtcccccaaattcaattcccg

SEQ ID NO: 19362 - DNA, 417 bp, Zea mays
  Clone ID: LIB189-022-Q1-E1-H5
aattcccggctcgacccacgacgtacgcggggccgagatgctcgtcgtcggcagccatggctacggagccattaaaagggctgttcttggaagtgtgagcgactactgtgcccatcacgcgcactgcaccgtgatgatagtaaagaagcccaagcagcacaagcactgatcaatgccgactgatcactacgtgtactgcaaataatatgtactactgcaaagttatgtgtgcgtccgtccgtttgtgaataattgggtcatcaaccatcacatcttcggttgcttctacaagtatccgatccaatccttctacgtgtggattgggatttacaaataattgattgttctctgaacctgaaaacaatgtatttgtattaatgtgttggaacaattaaatgttgttgcaacttcctttcc

SEQ ID NO: 19363 - DNA, 339 bp, Zea mays
  Clone ID: LIB189-022-Q1-E1-H6
gacccacgcgtacgcccacgcgtcagcctactcgtcggcagccatggctgcggatgcattagtcgggctgttcttggaagtgtgagcgatgactgtgcccatcacgcccactgcaacgtgatgatagtatatatgcccattcatgacagtcactgatcactgccgactgatcactacgtgtactgcaaatattatgctgtagtgctaagttatgtgtgcgtccgtccgtttgtcaacacttgggtcatcagtcatcacatcttcggttgcttctagacatgtccgatataatccttccacgtgtggattgggattcactaaattttcattgttcgtaga

SEQ ID NO: 19364 - DNA, 380 bp, Zea mays
  Clone ID: LIB189-022-Q1-E1-H7
ggtaccagcaaacgaattcccggctcgacccacgcgtacgcccacgcgtccggcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccggggg

SEQ ID NO: 19365 - DNA, 378 bp, Zea mays
  Clone ID: LIB189-022-Q1-E1-H8
aattcccggctcgacccacgcgtacgaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggct

SEQ ID NO: 19366 - DNA, 399 bp, Zea mays
  Clone ID: LIB189-023-Q1-E1-A12
ggtcgacccacgcgtacggaattctcgcaatgacagtatacagatagacacgacagagattctttttatatgtggtggtgcttttgtggacttggaaaagactatttctgaaaggcgccaagattcatccataggatttggggcagccattcgtacgaacatgagaagttctggagctagctgtccaatggttacctcatctttattagaatctgttgaaagtggtgatcttgtaagatatggtctaattccggagttcattggtcgtttgcccattctagtaagtttgggagctctgaatgaatgtcagctcgttcaggttctgacagaaccaaagaattcactttccatacagtacaggaaaatgtttaacctgaacaaagtttagctgcactttac

SEQ ID NO: 19367 - DNA, 379 bp, Zea mays
  Clone ID: LIB189-023-Q1-E1-A8
caggtacctatctagaattcgcgggccgacccacgcatcagcattgattcttgacgagatcgagcttcttttgcaccacaaggtccaagatgtcttgcaactgcgggtcaagctgcggttgcggctcaagctgcaagtgcggcaagaagtaccctgacctggaggagacgagcaccgccgcgcaagccaacgtcgacctcggcgtggccccggataacaaggccgccccctacttcctccaaggcgccgttgactccggcaaggccttccagggctgcagctgcggtggcaactgcaactgcgacccctgcatctgctgatgacatcgattcagtaccatggatagtggtactatccatctacacttctggggtggtct

SEQ ID NO: 19368 - DNA, 99 bp, Zea mays
  Clone ID: LIB189-023-Q1-E1-B10
aaaaggatccaagtttacttacccttcaattcaaattcacaccccttcaaaaatgccaccaaaatccaattcactggccttcctttaaaaccccctttc

SEQ ID NO: 19369 - DNA, 402 bp, Zea mays
  Clone ID: LIB189-023-Q1-E1-B11
tcgacccacgcgtacgcccacgcgtccgggaagagaggcgcgcaagcggtccggtctcatggcgcccttccccgccctccgctcatcgtcgccggtggccgccgccgcggcgccgtcgctcggtcgcgtgtccggccacgcatctgcggcgcccagcaagaggcgcgtcgtctcctgcagggccgtcagcagcaggtcgctgtccatcatcaggtgcgagcagagcgcgaagaagggcggcgggccggacacatggctgggccgcgcggccatggtcggcttcgcctccgcgatcgccgtcgaggtggccaccggcaagggcttcctccaggtagggaccgtcgtagagtatgagtatcaacgtaacatcgacagcagcgagggacgccgaaacgcgtgcgt

SEQ ID NO: 19370 - DNA, 300 bp, Zea mays
  Clone ID: LIB189-023-Q1-E1-C10
tcgacccacgcgtacggcacgccatggcctccctcgcctctgccgccgtcactgccccttccttcgccgaaccattcccagcccgcgccgtggtcataaggatgtcattcaacgtgagcgcctcacttggcatcgccattggtaccatcaccgttccaacgcgcgacacatcactattagccagcagtgacacggcctacgacgttctgcttgtctcacattatagacgtctcgtcgtcaaacacagcatgacaatttccaggtttgttacactatcacattcagtcccatggctcgcat

SEQ ID NO: 19371 - DNA, 351 bp, Zea mays
  Clone ID: LIB189-023-Q1-E1-C2
gggccgacccacgcgtccacccacgcgtccgaggccccctggtccgacttctgcgagaccatgaacgccacccatctggagctgcccaagaacctgcacgggtcacccgtgaatgtggccaatttccgccaggcatgacaccacaacccgttctcacatgccgagctgcaactgcagaactttctgatcgtgctcttgttcccaggtcgcaccgacagtcccatcaactagtcgtctgagaatatggacgtctactcgcgcctcgctctcgtcaacagtctccggtgacacacgattacgacctccagtgagcgagaatcatcgttctctgacagtctgtatgctcttatg

SEQ ID NO: 19372 - DNA, 150 bp, Zea mays
  Clone ID: LIB189-023-Q1-E1-C3
cccacgcgtccgaaaaaaaaaaaaaaaaaaaaaaaaaaaaaaaaaaaaaaaaaaaaaaaaaaaaaggaaaaaaaacaaaaagataaaaaaataaattaaacataaaaacaaaagtaaaaaatcttcaaaaatgtaaccaaagggtcactt

SEQ ID NO: 19373 - DNA, 436 bp, Zea mays
  Clone ID: LIB189-023-Q1-E1-C5
aattccgggccgacccacgcgtcagaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaataaggccgcgcccgagttcgtcaaggccgcggcggagtccggcgaggccgcccacggctgcagctgcggtggcaactgcaagtgcgacccctgcaactgctgatcacatcgaatgacgaccatggatatgattattatctatcgatcttgtggtggtggttgaacaataataatcgacgccgagctggatgccatacataggtactgtgtggtgtgtg

SEQ ID NO: 19374 - DNA, 444 bp, Zea mays
  Clone ID: LIB189-023-Q1-E1-C9
tacggaccgtaattcgcggggcgacccacgcgtacgcggacgcgtgggcgccaaggtgaagagcaagatgctttatgcaagctcaaaccaaaaattcaagagtgggctcaatggcattcaggtggaactgcaggctactgatgcaagtgaaatcagccttgatgagatcaaggatcgggctcgctaggcatcatgatcatgcatcatggactcggcctactactgtggatttgtatgccattatagacttggtgctgtgaaagactgcttgatgatttgcgggtttgttgctgtgtaaaaaaaggtcccatggctcccagaagaccatgaaggttcggatctatcatgtaattccttgttatctgccaattatgtatggactatggacatgtgttgcgctgttcagcttaatactaccaataagtaatccataatgtcccttcc

SEQ ID NO: 19375 - DNA, 452 bp, Zea mays
  Clone ID: LIB189-023-Q1-E1-D5
ggtaccagtcaggaattcccgggccgacccacgcgtcagggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcaggga

SEQ ID NO: 19376 - DNA, 301 bp, Zea mays
  Clone ID: LIB189-023-Q1-E1-E1
gacccacgcgtccaataggttgtgccaacaaacagaggctggcatatgtttcttccttggttgctgactgtgactaaactgccagtataggttatcgtgatgttacaagtccctgttttaactaaaatacatagggaatgtgcagcttgtacttcatcgttttatttttggtagttgaaatatggacttatgaatcatctttagttaagttgtacagtgctgttaactatttatactagtttttgagcggctatttgtacttgttgaaggagtaatacatagtggtgatattggtggaaaa

SEQ ID NO: 19377 - DNA, 366 bp, Zea mays
  Clone ID: LIB189-023-Q1-E1-E11
attcgcgggtcgacccacgcgtacgcggacgcgtgggaaaactcagtggctgcccgatacacaaaaggtgcatcagggaatgtgacaacagaagatgatggggtgcatccccaacggattgagccttaagacggccttcatgctacgtcatgtctcttccacagggtcaattcatcttcaggtaactggcactgcattcagagtctaatgcatggaaaaccctgagcattatcaacgttaacccctttacactctaaccccttttcaccatcagctgttgcagataattgcgctacacttatcgcatttcaaaaaatttgctgacgctaatctggtagatagaccctccctgtacctggtcattaa

SEQ ID NO: 19378 - DNA, 435 bp, Zea mays
  Clone ID: LIB189-023-Q1-E1-E2
tccgggccgacccacgcgtcagtgaagcacagcggaggcttgactttcagcttggatggcacctagatccactatatgttggtgattacccagaaagcatgcgtcaacgattgggcattgatgttccaaccttctcagagaaggataaagagttcatgaggaacacaattgattttgttggagtaaatcattagacttcaagactcattgcacatctctagaatccagacgatgtttatttctaccaagtgcagcagatggagcgaatagatgaatggagtattggtgaaaaaattggtgaaagggctgcatctgaatggcttttcagacttccttggggccttcataagtcacttacttatatagcgaagaagtacaatactccagcaatttatgttactgagaatggcatggatgaagaggacgatcaatccg

SEQ ID NO: 19379 - DNA, 420 bp, Zea mays
  Clone ID: LIB189-023-Q1-E1-E4
gggccgacccacgcgtcagcccacgcgtccgcccacgcgtccgcccttacaaaactggtgcttgcaattcggttgtatttgcatgtctctttggcacgatatggacaaaggaaaatagagaaggatgacgctgctgtgttgcagcaagctgtggttatctacaccaaggagtttttgaagttcactgaattcattggtgaggtctttgtgaatgcaccattctttatatctgctgaggatgcaggtgccgtggatgcaaggaaaagtgatgagtacaaagaaactattattccagctggaaagacacatgaggtcattttgagtgttgaagctgtaaactcatacatcgcatgggacttttccttgcaacaaggggccctcaacatggacattggctttcatgtggagtacattagccct

SEQ ID NO: 19380 - DNA, 364 bp, Zea mays
  Clone ID: LIB189-023-Q1-E1-E5
attcacgggtcgacccacgcatcagcatttatccagcctgatctctacagatctgattgataccatgagcgacgaattctcgaaaaggttttttgactatgttgatgagaggaagaacctagacatcgatcgtctcgctgaggctgtcgcgattccatccgtttcctcggatttggaaaatcatctggtcgacatcaacacattgatcgcttggactaagggtcatatagagcgcctcggtggattgacggagctcgtcaccatccccgcatgcaccgaatatcgccctttgcctccaattctgtgcggttctttcgtttcgaacccccatacaaagactgtatgtgtgtatggtcacttggac

SEQ ID NO: 19381 - DNA, 418 bp, Zea mays
  Clone ID: LIB189-023-Q1-E1-E7
ggtaccggtctaggaattcccgggccgacccacgcgtcaggagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattagtagcagcgctcataaaagctacagttccatctattttctcagctatgtaaaacttccaaactgttcatgcttaaaactgagggttttcgtggtgtg

SEQ ID NO: 19382 - DNA, 327 bp, Zea mays
  Clone ID: LIB189-023-Q1-E1-F1
cgggtcgaccacgcgtccgcggactcgtgggcgacgccaaggccgggatcgctctgaacgaccacttcgtcaagctcgtctcgtggtacgacaacgagtggggcgacagcacacgcgtcgtcgacctgatccgccacatgttcaagacccactagacgggttttttccccctgcttctcatggatggttgcagcttgtgtacgccgacaataaatctggatcgcgcgtgcctctgggtcgccaggttcatgctgagtcaggacatgttttgcactttagcatcccttcctgctaccatctgtgaaagaaccgctcgctaatacggga

SEQ ID NO: 19383 - DNA, 460 bp, Zea mays
  Clone ID: LIB189-023-Q1-E1-F10
ttcgcgcgtcgacccacgcgtacgcccacgcgtccgcccacgcgtccgtgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccaggaggccgagatgcttataaacatcaaggaacatgtccttgttcctgagcatcaggtgctcacaaacgaggagaagaagacgcttctggagcggtacaccttgaaggaaactcagcttccaagaatacagatcacggatcctattgctaggtactacggcctgaggcgaggccaggtcgtgaagatatcaggcccagcgagacggcgggcagatacgttacataccggtacgttgtatgacagaacggtcagacac

SEQ ID NO: 19384 - DNA, 359 bp, Zea mays
  Clone ID: LIB189-023-Q1-E1-F11
taccgtatcggaattcgggcgtcgacccacgcgtacgcccacgcgtccggcatgtcgtcgttgaccacaaaagtgtttggagtgccccagccagggtggtacagggtttattacatcattaataatattcaagagttagtaaccgctctgacccaagagcatccggtggtgctgatgttctgggcggactggaaccagccaagcaaggccacgtactgggatctggccatcgctaaaaaggatgaggccgtattctgccagctggactttgataagtttaaagatgtcgtagagaagttcagagtgaaggctctgccgacgttcctcctgatcaaggagggcgaggatcagcgcaaggt

SEQ ID NO: 19385 - DNA, 401 bp, Zea mays
  Clone ID: LIB189-023-Q1-E1-F12
caggctacgacaagaccaagtacaccggcatcgggtccgccatcgagtacgctgtgtgcgctctcaaggtggaggtcctcgtggtcattggccatagctgctgcggtggcatcagggcgctcctctccctccaggacggcgcacctgacaccttccacttcgtcgaggactgggttaagatcggcttcattgccaagatgaaggtaaagaaagagcacgcctcggtgccgttcgatgaccagtgctccattctcgagaaggaggccgtgaacgtgtccctggagaacctcaagacctaccccttcgtcaaggaagggcttgcaaatgggaccctcaagctgatcggcgcccactacgactttgtctcaggagagttcctcacatggaaaaagtgaaaaact

SEQ ID NO: 19386 - DNA, 366 bp, Zea mays
  Clone ID: LIB189-023-Q1-E1-F3
gggccgacccacgcgtccacccacgcgtccgcatgccaggtgttataccggttggctttctggggggttattcaaggtttgtggcaaaatgccaagctctggaaccgaaatcctttggagaatgatttccgtattacaatttgggggagggaactttaggacatcctgggggaaatgcacctggggcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatat

SEQ ID NO: 19387 - DNA, 427 bp, Zea mays
  Clone ID: LIB189-023-Q1-E1-F5
ggtaccagtcaggaattcccgggccgacccacgcgtcaggcacgtgcaaccacggcggcacgggaatctccgcggagaggcgcctgcatacgctgatgctggacagcgtcggcggcggcggtgccgaggaggctggtggcggcggtgacgagaggggtggatgtggcgtggcgaagcccaaggtcgtggtgatggactgcgcggagaggcggtacacggtggtgatcctgcggtgcagggaccggccgaagctgctgttcgacacgctgtgcgcgctcgccgacctgcaatacgtcgtgttccacggcacggtcgacgccgagggagccatcaaggacaaggaggcctaccaagagtactacatccggcacgtcgacggccacccggtgcgctccgacgccgaacgggcccgcctcgtccggtgcct

SEQ ID NO: 19388 - DNA, 320 bp, Zea mays
  Clone ID: LIB189-023-Q1-E1-F9
tcgacccacgcgtacggcaaaggcaagcgctctcaggccatggagtccatcagcgccagcaccacgctcgtcaagttcacctacgacgatatcaaggctgccaccgacggattcgccaggaagagtattattggccacggtggctttgggaatgtctacaagggggtgctgcgcgacggtgctgaggtggcggtgaagcggttcaagaactgctccgcggctggggacgccgcctttgcccatgaggtggaagtggtggccagcgtgcgccatgtcaacttggttgcgctgcgtgggtactgcattgccaccacacagag

SEQ ID NO: 19389 - DNA, 437 bp, Zea mays
  Clone ID: LIB189-023-Q1-E1-G3
gggccgacccacgcgtcaggtccagttgaatcaagaaaaggcgacggtgcaatgactgcatgtgaggtgctcttattccaccatgaagatatggggatcccatgggagattgcgaagctcggtgtccggcaagggatgtggggctgcgtcaagaggatagagcctggccttcgggcataccaggttgcgaggaccgctggagagcctatctcaaaacatgccgccatggcgcatgttaccaccaggttcgatgctgacgagctcgtcacggaagacagcgtggaggccagttcatccactgacaacaacaagaccaccgaggttgagaagccaaagcactggacaaacaacatacccaaggttctcatgatcggtggcgccgtcgccctggcttgcacctttgacggtggattgctgaccaaggccgccatattcgg

SEQ ID NO: 19390 - DNA, 450 bp, Zea mays
  Clone ID: LIB189-023-Q1-E1-G5
gtaccaatctgcgaattcccgggccgacccacgcgtcagggggcgagcaggtgagcgtgacggtcacgggccacagcctgggcagcgcgctggcgatgctgtgcgccttcgacatcgcggagacgcgcgcgaacgtgtcgccgggcgacagggtggcgccggtgtgcgtgttctccttcgccggcccgcgcgtcgggaacgtcgccttccggaggcggttcgagcgggagctgggcgtgcgggcgctgcgcgtcgtgaacgtgcacgacagcgtgcccaaggtgcccggcgtgttcttcaacgagtcggcgttcccggagctcgtcctgcgggcggcggacaggctgggcctcggcggcgtgtacacgcacctgggcgtgctgctgcagctggaccacaaggtgtcgccgttcctcaaggagaccctggacctctcgtgctaccacaacc

SEQ ID NO: 19391 - DNA, 390 bp, Zea mays
  Clone ID: LIB189-023-Q1-E1-G9
ccgggtcgccccacgcgtccgcccacgcgtccggtgtgcaggtgctccgcggcggcctgccggctgagatcacctcccggggcgccacctccgacgatccactcgtcattgtggactagatccaactgcggggagagtagtacgtagtagactagtagtggtgcagtgcagtctgtagaggagacgagacgctcaggagctaggtagcatcgtcgttgtattttgttgttgcccctgctctagctagctcgctggtcctcgtggatcttgtagccagtttctttctttcagctgcagaccttcctcttcctgtggacacggttgctccatcaccaagtggtgctgatgctaccagctttctgctgtgacagttcatagtagacgctatca

SEQ ID NO: 19392 - DNA, 432 bp, Zea mays
  Clone ID: LIB189-023-Q1-E1-H1
gggccgacccacgcgtccacccacgcgtccgggatcggcagccctgccaagaacaaggtgaagaaagagcacgcatcggtgccgttcgatgaccagtgctccatcctggagaaggaggccgtgaacgtgtcgctccagaacctcaagagctaccccttcgtcaaggaagggctggccggcgggacgctcaagctggttggcgcccactacgacttcgtcaaagggcagttcgtcacatgggagcctccccaggacgccatcgagcgcttgacgagcgggttccagcagttcaaggtcaatgtctatgacaagaagccggagcttttcgggcctctcaagtccggccaggcccccaagtacatggtgttcgcttgctccgactcccgtgtgtgcccatcggtgaccctgggcctgcagcccggcgaggccttc

SEQ ID NO: 19393 - DNA, 390 bp, Zea mays
  Clone ID: LIB189-023-Q1-E1-H8
cgggccgacccacgcgtcagcccacgcgtccgggtcatcatgggcacgcagtacgccggcgagatgaagaaggggctcttcggcgtcatgcactaactcatgcccaagcgcggcatcctctcgctgcactccggctgcaatatgggcaaggacggcgacgtcgccctcttctttggcctcccaaggaacgggaagaccaagctgtccaacgattaaaacaagcttctgatcggcgacgacgagcactgctggagcgacaatggcgtgtccaacatcgagggaggctgctacgccaagtgcatcgacctggcgcaggagaaagagcctgatatttggaacgccatcaagtttggaactgtgctggagaacgtggtctttgatgagcatact

SEQ ID NO: 19394 - DNA, 478 bp, Zea mays
  unsure at all n locations
  Clone ID: LIB189-024-Q1-E1-A4
cgctgccaggtcccggtctagaatacccgggccgacccacgcgtcagggctcttacattggctgttggtgatgaagatactgacatgcttgctgatgtgaaacagatggcagctgcagcagctgcagcaggacaagcgagttcatcatttgagaaccagctccggccaattgatagatatgcaatgcgctttatggaactctgggatccagtaattgacaaagctgctttaaatcatcaagtaaatgttgaggaggaagaatgggagcttgatcgtattgaaaaattcaaagaggatttagaagcagaaattgatgaggaccaagaaccactttcttatgaatcatgggatgttgattttgctacgacagcctatcggcaacatgttgaggctttaactcanaagcagttgttagaagaacaggaaaagcaagctcaggaagcatcacaagagttggaggacaagaatgataatatga

SEQ ID NO: 19395 - DNA, 443 bp, Zea mays
  Clone ID: LIB189-024-Q1-E1-B3
cgggtcgagccacgcgtccgtgttcttatgcatgcagcagccataagcattgctactagcgtctcctgcacgtgctgtgtcgtttccagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgccgaggatgccaaaccctcctcaggtacatacgcggcgcgacgagcgtgc

SEQ ID NO: 19396 - DNA, 461 bp, Zea mays
  Clone ID: LIB189-024-Q1-E1-B8
gtcaggaagtcccgggtcgacccacaacgtccgcggacgcgtgggctatcatgaatctgcactctgaccagggaagtaactcccttggctgctcagacttgggttgggagaatgatactaagacaccagacatcacatccattgctcccattcccactattgctgaaggcgatgagtctgtatttgtcaactccaattcaaacagctcgatggtgcctcctgtccttgagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcctctgaggaatttgaagcttggccataggactatgtacatagggactacggaat

SEQ ID NO: 19397 - DNA, 375 bp, Zea mays
  Clone ID: LIB189-024-Q1-E1-C1
ggtcaggaattaccgggtcgagccacgcgtcaggtttacatgcataccaacaggtgtcttacatgattttggcgatggtgtctcctgtcactcattctgtgggcaactgtgttaaacgtgttgtggtcattgtaacatcagtgctgttcttcaggacacctgtttctcctatcaactctctcggtactgcgattgcacttgccggagttttcctgtactcacagctcaagcgacttaagcccaagccgaagacggcttaaatagggattgtattttccatctctttgtgttaatggagttaaacacttctatgtttcaggtgactgcattttaaaagatttgtgcttataacaacaaatgaaaaaccgcaaacgg

SEQ ID NO: 19398 - DNA, 458 bp, Zea mays
  Clone ID: LIB189-024-Q1-E1-C6
attcccgggccgacccacgcgtcagcccacgcgtccgcaacgagtccgacagcgtcaccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggttagttttatactctagctacgttttgaattcgatggatcataaaactgtttttttttacttagtaactagtggcaagctaaggccggcggtaacatgtgtgcgtgcgcacacagctggtcacctgtcaagcttcgattcgcagcttgtcggtagtatacactacactagtactagcagggtatctgtctagccagcccagctgcc

SEQ ID NO: 19399 - DNA, 124 bp, Zea mays
  Clone ID: LIB189-024-Q1-E1-C8
gctccaagctggtaaattcgatatgctgtagaaatccggctttctattgaacggggcacgacatatgggctctctcatattttagcctactgtaccatttcccccactatttttcttttcgacg

SEQ ID NO: 19400 - DNA, 403 bp, Zea mays
  Clone ID: LIB189-024-Q1-E1-D1
cggtcaggaattcccgggccgacccacgcgtcagcttttccccaaggcaaccaaaccatctcgactcgtggggaagattcgctctcgccggcgtcgacggcctagggttcgaggaacgtccgtccgtccgtccggtgaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctct

SEQ ID NO: 19401 - DNA, 348 bp, Zea mays
  Clone ID: LIB189-024-Q1-E1-D10
gtctgaagcaaaagcaatggccatgagagcgcttccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccagaggtggagggaggatgacgagggagcagtacggagcacttaggcggaagattggtggcacctaccaggatttcttcaagtcatatgttgaagtcgacgggcaata

SEQ ID NO: 19402 - DNA, 425 bp, Zea mays
  Clone ID: LIB189-024-Q1-E1-D2
gggccgacccacgcgtcagctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcccacttcgacccgctcggcctggcggccgaccctgagaagaaggagcggctgcagccggcggagatcaagcacgcgcggctcgccatggtc

SEQ ID NO: 19403 - DNA, 448 bp, Zea mays
  Clone ID: LIB189-024-Q1-E1-E1
gggccgagccacgcgtcagcccacgcgtccgcccacgcgtccgcgaacagtccagaacccactgctcgaaaccgcagccactggccagtcgatgcccatgactgcggtgcccaggaccggccccggttgcctggggtcgccgccggctcaggctctgtcgagctcactagccggggttcaaggcgccccgaagcgactgggcgtatcgaagccgtcgtggatcgttcgcactgagtcaaacgtgaggatggagagagcaaaacgacctgatcctccttgcaccatctgcaaaggcacagggagaatagactgccgcaactgctttggtcgaggaagaacaaaccatgccgatgtggccatgcttccgaacggcgaatggccacaatggtgtcgaatttgtgggtggaagtggactggattactgcctccggtgccatggaactggtga

SEQ ID NO: 19404 - DNA, 394 bp, Zea mays
  Clone ID: LIB189-024-Q1-E1-E11
ggtacgagtctaggaatccgggccgacccacgcgtcagcgataatgactttgctgggaaggatcaggagaagaaaaagcatacagtggcattccttcctctcacgcatggggacgcatgggcaattccaaaatccttgtgctacctccgcccgttgtcgacagcgaccagaggacgcccacgcagatgcgccgtccgatcccatgccgcgggagcggatgcctccaatgataagtcactgggcgtcatgcacaagttctccgagcagtacgcccgccgctccaacactttcctctgcgccgacacaacagtcactgtcgtcatcatcaacggacttgctgatcagaaggatactcgtgaaccccctccatgaccttgtaggcattacgatgaca

SEQ ID NO: 19405 - DNA, 387 bp, Zea mays
  Clone ID: LIB189-024-Q1-E1-E3
cgggccgacccacgcgtcagacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagt

SEQ ID NO: 19406 - DNA, 279 bp, Zea mays
  Clone ID: LIB189-024-Q1-E1-E8
caggttacggtcaggagttcccgggccgacccacgcgtcagagcacaacaagtagtcaaagcatctagctcgttacaagtggctcttgtcgcctacaattttgccttcttccaagtcttgtttgaagttgctctctgcgaagagccggtagagaagttaataccgtctagcaatggaccgggtgacgacactggcttctcagcgcgcggtggtcatcttcagcacgagctcctgctgtatctgccacaccgtgacgcgcctgttccgcgagctcggggt

SEQ ID NO: 19407 - DNA, 291 bp, Zea mays
  Clone ID: LIB189-024-Q1-E1-F1
agcccacgcgtccgcccacgcgtccggaaggagaaacatatggggagttgaacgagtgctgcaacttcacaaccagttacctagccagcattcttttgcttttcccctgtatattttccattcagtgtcattcgtatggtggtgttgggtctctttagacaaactggggactgttgcttatcctaaaaattcgattgtattgtgtggcatgaaatgatcgatgtcaaagaatattttgaacatgctgccacctaattatacttttcatatgaacatcataaagaaagactg

SEQ ID NO: 19408 - DNA, 172 bp, Zea mays
  Clone ID: LIB189-024-Q1-E1-F10
aattcccgggtcgacccacgcgatccggagttaatgagaatactgatggatgttaagggattaagctggagtgaggcatggagtattacagaaagaaccgtggcatacactaaccatacagtgcttcctgaagctccaaagaaatggggcttgggcaaaatgcaaaaacttt

SEQ ID NO: 19409 - DNA, 301 bp, Zea mays
  Clone ID: LIB189-024-Q1-E1-F11
cgcggacgccgcggctggccgcgtgggaggaccggttccgcgccgccgacgtggccaagggcgtcgtgcccgacgacctccacaagatgcgcgcgttcctgcagaccctgcgcgctatgaactacgccaagtgagagtgtttcgtcgcatgaacgtgtgccgtgccgtgcacgacctatgatcagttcatgtcgatacgtctatcactcagttttgcttcttccgtcaataatcggtgtgctgaatacatgtacaccagctgcctataattttgcttctttcttccaatacctccgttttt

SEQ ID NO: 19410 - DNA, 447 bp, Zea mays
  Clone ID: LIB189-024-Q1-E1-F6
aggtaacggtcaggaattcccgggccgacccacgcgtcagcgacaaagatggcatccatcaggaagtcttccttcatggtcccatctgctgacacctatgctcgtgctgccgttcgtcacattggatacgagcctaggtgcacaccatactggccacactctgtcgtgtggttcttgatctccattcttcccgagtcccttatcgacagcgtgcgcctgggcatgtgcattaagatccgcaagaaggggctggccaaggacgccaagaagaaggcgctgtgattgatgtttcagaatgcatgttcagattcgcacatttcctcatcacctgtagtagacacgtgccttgctgtagtcactttattagctaccattgcctcctgagtctgttaagaatcgagaatgtcattgtttcatccgcggttatgatgatgaaaaatacgattc

SEQ ID NO: 19411 - DNA, 454 bp, Zea mays
  Clone ID: LIB189-024-Q1-E1-G2
gggtcgagccacgcgtccgcccaagcgtccggcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaacgtggccggggctacggcaactccgacgggaactggaggaactgagcggtggggcccgcgcgggcaagttatcctgttcgctgccgtgatgtttaccctagtccagagggtttatcttcgttcgtctcgtgtttg

SEQ ID NO: 19412 - DNA, 468 bp, Zea mays
  unsure at all n locations
  Clone ID: LIB189-024-Q1-E1-G4
ggtcaggaattaccgggtcgagccacgcgtcaggggagccaatggagtcggtgggtcggagtccgagcggaagccgctgtcagaggtggtcggcgactgcgtccagcgctggttccaggacgcgtacaaggaggcgcgcaaaggagacatcgccaaccaggtgcttgtagcgcagatgttcttctcgggttatgggacccccaagaacgagtacaagggaaaacaatggatggatagagcatcaaggttcaggtcttccgctttgaaggttggcatgaaacgtccaggatacaatgcaagtgactcagactctgatgacgatgcanatgatgacgccaaccaataacactcaattacaaattgagttattagttaggagattcacagggaattttccttggtgctgggacttcagggtcgaattacttggtggtttatgcatttattaacactgtgtttgaattgtga

SEQ ID NO: 19413 - DNA, 365 bp, Zea mays
  unsure at all n locations
  Clone ID: LIB189-024-Q1-E1-G8
aaaaaatatcacaccgttcatcagcatacttttaagatcacacatcagtacaacacattcacatgaagctatatatatgtaacaggcatgcttaatactaactaactagtactgtatgagacaacgatgtatacacgcatgttgatcactacggggacagtagagagacagtgtcaggtcgtcggttctctgcagttcaggattccacgtagcaggatcttaacttgattaactggcacttggcagttagcttaatccgttgcatcgtcgtacgtgtccacgttaggcaattgcgccatctcatcccaattgcacctgagccttgccctgnagaggcgcttccactcgacgagccgcagcaagaa

SEQ ID NO: 19414 - DNA, 332 bp, Zea mays
  unsure at all n locations
  Clone ID: LIB189-024-Q1-E1-H11
ggctcaaaccttttcctaaatgattttggtggttgaaatgcccaacacanataattggactaactagtttgccctagattatatgtcctacaggtgccaaaggttcatcttgtcggcgtttcgaccccgggggtccctggaccgacgagtaaattgtcgctgcgtgtcccagcccagatgggtcngcgcgagacggaacacaacgggggaaaacagtaaggggaaaccgcggtgagccccgtgtcgaccgggagtacgacatggtcatcgtcccgtccgacggcggtgggtgcctctccggctctgactcggacgactccgactggtccatc

SEQ ID NO: 19415 - DNA, 427 bp, Zea mays
  Clone ID: LIB189-024-Q1-E1-H12
aattcccggctcgacccacgagtcagcccacgcgtccgcccacgcgtccggtctcactttaaaagctctaaaaggaaacttggcatctggaggagagtcaaatgagcaggctgggatcaacgtggagaactttagatcttctgtatttccttcccggcagttgtctggtgaggtaaaaccattttatccaaatcctggaatgcacagtgagaatgtttggattcaaacaactcagacaaacgagacaatgaagctgggcaacgcaacttactacagacagcttccaggacatagcactgagtcaataaaccaaagaagtacaggaagtttccagagttcggtgagacgtcaatctttcccaccttcgagttacaagaaatgagattcataccagtagccgtcctgatgtataaaggaaaggaagaaa

SEQ ID NO: 19416 - DNA, 469 bp, Zea mays
  Clone ID: LIB189-024-Q1-E1-H2
cggtcaggaattaccgggtcgagccacgcgtccgcggaacgggacgaatattatctcaaaaaaaagtcttgagtcccccctctccttccccttcccaacgctctcgctgcagaggaaaggcgaagatggcgatgaccgtcgaagtgcttgctgcactcgcgttcatgttttccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaaaccttgctattccagcaattctgaggcacgctggcttaatcgagaccggggccatgttcatcgagttcacgtccttcttcatccttgtatgcacagtgct

SEQ ID NO: 19417 - DNA, 401 bp, Zea mays
  Clone ID: LIB189-024-Q1-E1-H7
aggtactggtatagaattcccgggccgacccacgcgtcagcccacgcgtccgcaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcatgccgtccccgatcttccggcggcagcacgggcgggctgctccgcaaggcgcacgtggaggagttctacgtcatcacgttgacgtcgcccaaggagcaggtgttcgagatgcccaccggcggcgccgcca

SEQ ID NO: 19418 - DNA, 364 bp, Zea mays
  Clone ID: LIB189-025-Q1-E1-A12
cacgcgtcagctcattccccgttgaatttcaatttctggccaactttgaagggtggtccaatgggcaacttgttcggcaactctggcaaagttcggtaatggaaaggaacaaacctgaacttgaaaggaaaccgggttacaagcccggttttgggccccaagttcaacaacccaaaaaggctcctccccctaaaaacaacattccctccggttccccttcaagccggcaaaggcggaaacgttaacaaaggtaatggcatcgtgaacaacaactggccctggcggcggacgtggggctgacggcggagaccaagttcacggacctcggcgccgactcgctggacacggtggagatcgtcatgac

SEQ ID NO: 19419 - DNA, 338 bp, Zea mays
  Clone ID: LIB189-025-Q1-E1-A3
cgatccagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaggtgacgaggaggag

SEQ ID NO: 19420 - DNA, 380 bp, Zea mays
  Clone ID: LIB189-025-Q1-E1-A5
ccggctcgacccaagcgtcagcaagaaaacaacgcagagctcaccagggaggctgttgatgttttcatttggtgcttaactcaaaatgcagagtcttacaagcagtgggaaagaatttatcttgaaaatattgaagccagtgttgctgtcctgagcaaagttgtgattgattggagggatgtgtctcctaagctcagttctgaagctctcaaggcaacagtgaagaactttaaggctaagaatgaggctgcgctggagtccacaacagatgctggaaagcaggcatctatcaaagaagcagacaagcactgcaaggcgatctttggaaagctgacccgtggcgccacctgcctgaagagcagcctggtggtcatcgcgct

SEQ ID NO: 19421 - DNA, 350 bp, Zea mays
  unsure at all n locations
  Clone ID: LIB189-025-Q1-E1-A6
ggtacaggttaggaattcccggctcgacccacgcgtacgggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctgnggacccagatcaatatatctgttatg

SEQ ID NO: 19422 - DNA, 327 bp, Zea mays
  Clone ID: LIB189-025-Q1-E1-A7
aattcccggctcgacccacacgtacgcttgaaaggcaaccaagtgatgatgaaccattttctgggttagctttcaagatcatgactgatccgttcgtggggtcactaacatttgttcgcatatactccgggaagctgatagctggttcatatgttctcaatgcaaataaagacaagaaagagagaatcggaaggcttcttgagatgcacgcaaacagtaaggaagatataccagttgctgtgacaggtgacatagtagcgcttgctggtctgaaagacacaattactggtgaaacactctgtgacccaaacaagcctgtagtgcttg

SEQ ID NO: 19423 - DNA, 395 bp, Zea mays
  Clone ID: LIB189-025-Q1-E1-B5
aggtataggttaggaattcccggctcgacccacgcgtacgaccaagggatactactgtcctgccatgtaggcatatgtgcatgtgcagtgagtgcgccaaggtcctgaggtaccaaaccactcggtgccccatctgcaggcagcctgtggagcgtctcctggagatcaaagtgaacaacaaatctgaagatcagcagcagacgccccaatcgccaccgcgcccagacctggctccgcagcaggaaggggtgtagccgtgatcaaagtcagttctgaagtatttggcttgaatttgcggaccttcctgaaggtttgttctctcatttgggcaacggggaatgcaactggtacttttacctttagcatatgtaagcttctggcatcgcatggctttg

SEQ ID NO: 19424 - DNA, 371 bp, Zea mays
  unsure at all n locations
  Clone ID: LIB189-025-Q1-E1-B7
ttcccggctcgacccaaacgtccgcccacgcgtccggaagatgggacagtgattgaaagtgaaactgcgaaagatgatgccagaacatatggagttaatttgtcagaatcagatgctgcagttcgtattcagtctgcctacagagggtatgatgttcgaaaatggcaacctttggataaactctggaagatcaagcatgtgcatgaacagatgcaagttgtgaggaagcattcaatgccttttagattcttgcagtaagccaacacaaaaagagcaagtggccataggtgaaactattatgaatttactcctgaagcttgacgcaatccagggcttgcatccaagtgtaagggaagctangaagtctgttg

SEQ ID NO: 19425 - DNA, 344 bp, Zea mays
  Clone ID: LIB189-025-Q1-E1-B8
aattcccgggtcgacccacacgtccgcccacgcgtccgctcgctcgcctacgtacgtctctctctctccgccgcgaccccccacaagcggcgccggcgccggcgctgcagctaaaccaaaccctaagccacgggcaccgccctacgccgcgggctctccgcgatgcgccggtgcgcggaggcgatcgcgagggccgtggtcgagttcctcgaagccgtcatcctggcctgtctccgctcgtgcttcggcgcgcgcccccgccgcggctccggccgccgagatgcgctcgtgcgcggggatcgggccgcggaggtcatctgggatgaggaaagcttggtaaggga

SEQ ID NO: 19426 - DNA, 113 bp, Zea mays
  Clone ID: LIB189-025-Q1-E1-C2
aggtaatctatgatggcaatgtttgcctggtcatgaagtattattactttcgttgaaaccgtgatgctattaagacttaattttttttatggaacatcgaatgtaaggcaaaa

SEQ ID NO: 19427 - DNA, 365 bp, Zea mays
  Clone ID: LIB189-025-Q1-E1-C6
cccgggtcgacccacagcgtacgcggacgcgtgggcggacgcgtggggccgcgggttaaccttcccttctcgctgccgtgctcctgctcgtgcgcgcgttcgcaatcgtagcgctggggttgagccgcgagtggataaaccctagccggtggtgtagctgggttggtggctttgatgccggcgacggcccgcttgtccccggaatggagtgaggtgacgaaggctgccatgggctctaactatgccacgattggattataggatagtagctggcagctaccagtttcctagaaccaatttgtggatagcgagaggagtgactgttgttcagtactttcacctcgatcatgggtggtgtctgctca

SEQ ID NO: 19428 - DNA, 380 bp, Zea mays
  Clone ID: LIB189-025-Q1-E1-C7
gaattcccggctcgacccaagcgtacgcccacgcgtccgcccacgcgtccgacaacagcaagggaaggttaggtttcttcggcaccatggtgcatcattcacttgctggggagaacgttcatgagatttagaggcatgtgctacaaatgcagttctggacataataactgaatttgagcatcgcattcttgtgctgctgaatcttatcttgattatggcttcggcaacatcctggaagaggaatttatggtcaactgagatcatctccaagaccgagagggctaacagaaaacatcagatttcagcatccaattactcttgactaacgttccactctttgcaaaaccattgtgccggcaaggagggctactattttaggt

SEQ ID NO: 19429 - DNA, 357 bp, Zea mays
  Clone ID: LIB189-025-Q1-E1-C8
cccgggtcgacccacacgtcacgcggacgcgtgggcgccgatcacacattggacttgcactggtgcttgctcataattactagttcatcagcaaacaacaaacaatggcaccgaggctagcgtgcctcctagctctggccatggcagccatcgtcgtggcgccgtgcacggcccagaactcgccgcaggactacgtggacccgcacaacgcggcgcgcgccgacgtgggcgtcgggccggtgtcctgggacgacaccgtcgccgcgtacgcgcagagctacgcggcgcagcgccagggcgactgccagctgattcactccggcgggccctacggcgagaacctcttctggggctccg

SEQ ID NO: 19430 - DNA, 334 bp, Zea mays
  Clone ID: LIB189-025-Q1-E1-C9
cgacccacgcgtaagcggacgcgtgggaaaaaaaaatgagcaaaaagaataagtctaggagattgacgatcaatgggaatgatggttcattccacatgaatgtaaagggcagatgccctctaggctgtgggctaatttcacttgactggtcggctggatcccttccgtgacttagaaatctgcgaagtgggggctcttgttctacgtgctacagattggtatatcactagctggcctctgtcttaactggttggcacgaattacccttctcaacagtggcgctaacccgaatgtggaatgggacgttccatctaccagttcattgatctccctg

SEQ ID NO: 19431 - DNA, 230 bp, Zea mays
  Clone ID: LIB189-025-Q1-E1-D11
agcactagtaaatttggggaaactaaggttcaacaatggcaaacccggatcaaaccaatggtagccggaccgccatggatggcaattcggtaaccaacggtcaagaacctaaacctcccggaattgtacaaaacatccataattacaatggtagaaaccaacttggaggaaacctaataaaaacttccccgtaaatggaaaaccaatcggttaatgaaaaaaaaaataaa

SEQ ID NO: 19432 - DNA, 372 bp, Zea mays
  Clone ID: LIB189-025-Q1-E1-D3
tcccggctcgacccacgcgtaagcggacgcgtgggcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaagggggca

SEQ ID NO: 19433 - DNA, 394 bp, Zea mays
  Clone ID: LIB189-025-Q1-E1-D4
ccggctcgacccacgcgtaagctcagtatagtgttcgtcacaatactgtgcacaccacaactaacagttatcaggtggtctccgaacccaccggtgtcagccgacgtcttgcatcagtggaaaggattctgtgctctaatcgcgaacgcttactatgtcaaaggaatggcatggttgccagtgaaaaccttgcagctggaacagatggctgtcacaggaagttcagagaaaccatcagtagttgctagccgcatgcagttagttttcagcacattagaggtagtcagcccacagtggccaagagtgtgattagatgaaagcaataccatcaaacaaaggtctgcagttttattctgaccaaaagatatgcatgtccaagttagcaagttcaaac

SEQ ID NO: 19434 - DNA, 449 bp, Zea mays
  Clone ID: LIB189-025-Q1-E1-D5
aattcccggctcgacccacgcgtacgcccacgcgtccgcccacgcgtccggaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaacccggctgcctaatttgcaccaccaattactactaccaatttagccagcta

SEQ ID NO: 19435 - DNA, 417 bp, Zea mays
  unsure at all n locations
  Clone ID: LIB189-025-Q1-E1-D6
ggtacaggtcaggaattcccggctcgacccacgcgtacgtgaagctgtaaaattaacaggggacaacctcatgccagctggtcaggttgttttccgtgcaaaagttggtgaacactatcggctccctcataagggaattatccctagagaacttggagtgattgctaggtacaaggggcaaaggaaaattgcagatcctggtttccaaaaccctcaatgggttgacggggagcttttgatactagatggaaagttcatcagagatggtcctgtgatagctttcttttactggacatctaatgttcatcttttcgaattctttagacagttgaagcttcctgactagttcccttctaaaagtagttaaaggccattataatttcagcatagctgcgtttggaaccaanccgaatttcc

SEQ ID NO: 19436 - DNA, 382 bp, Zea mays
  Clone ID: LIB189-025-Q1-E1-D7
gaattcccggctcgacccacgcgtacgggagcagatcaggatccattaacacccctacgtacgcctttcctctggaaacccttctctcgcctgcctctcccccgccgcgccgccacttcccctctcccgtcaactccggcttccgcgcgaggtcgagctagcgtttggagttctcgagacctgctgtgatggcgacagagcaagcggcggagaactacacggtggaggacctcgtggccctgaaaccctacaaccccgacatcctcaacgacctcgagaagttcgtcaatgagcaggtctcatctcagacatataacttggatgcaaatctcagccttcttcgcttgtaccagtttgagccagaaaggatgagcatacagat

SEQ ID NO: 19437 - DNA, 382 bp, Zea mays
  Clone ID: LIB189-025-Q1-E1-D8
gaattcccggctcgacccacgcgtacggtcttcagacaccatcgacaacgtcaaggccaagatccaggacaaggagggcattcccccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcacccttgaggtggagtcttcagacaccatcgacaacgtcaaggccaagatccaggacaaggagggcatcccaccggaccagcagcgtttgatcttcgctggcaagcagctggaggatggccgcacccttgcggattacaac

SEQ ID NO: 19438 - DNA, 427 bp, Zea mays
  Clone ID: LIB189-025-Q1-E1-E1
aagcaaaggaggatttgagttttgcacaagtgatgaggatgaaccagagaatctgtttcgtaatgtttttcgagaccagcacacatattattggtctttttcatctgataattttcagaggaactccaaacgtgctcgctcacaaaaatccagaaactggagttttgaaacagacgaggaggatgaagtatcagctccatcagaggtatctttggcacgacaagctcttgggttgagcacttctggtccgcttaaacttgaagatgttaaaagcgcataccgagcatgtgcacttagatggcatccagatcgccacaatggatcatctaagtctacagcggaggagaaattcaagcattgcaatgcaacatacaagaccttaaggtgaaatttgggccgctgcatagataattttgaatgaagatgg

SEQ ID NO: 19439 - DNA, 388 bp, Zea mays
  Clone ID: LIB189-025-Q1-E1-E5
gaattcccggctcgacccacgcgtacgaaatctctaatactagatgggtgccggcgctggcgctgctcctgggacgacgagaacacgacgatcagccgcgcgcgtctatatactgcagtacaagaacacgacggaggcggcggtggacgcggcgcgcatcatcctccggcagtgcgcgctgtccggcacggtgaagcgcgtcatccacacggcctcggtcacggccgcgtcgccgctcaaggaggacggcagcgggtacaaggacttcgccgacgagtccaattggacgccgctcaacctctcctacgaattcaccaacgcttacctggacgtacgtaatacagtgctatataggactaatctatatattgactactcatgtgcatgc

SEQ ID NO: 19440 - DNA, 468 bp, Zea mays
  Clone ID: LIB189-025-Q1-E1-E6
ggtaaaggttaggaattcccggctcgacccacgcgtacgggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggcctcggcaagacggccaaggtgatgcacctgctgctctggggacccaagtgaagcggcgagaggccaccgtaccgccgggctctcccgctggcgttgctcgttttgctctgcctggaatccgcccgcaacgggacggtacggtacctatatattcacctacatactacgacgtgcacctgtactacg

SEQ ID NO: 19441 - DNA, 382 bp, Zea mays
  Clone ID: LIB189-025-Q1-E1-E7
gaattcccggctcgacccaaacgtacgcccacgcgtccgcccgaagcactggtcattggagtagtcgccttgttggtattcggccccaagggtctagcagaggtagccaggaatttggggaagactttgcgtgctttccaaccaaccattagagagctacaggatgtatcaagggagttcaggagcactcttgaacgagaaatcggaattgatgaggtttcccaatcaacgaactataggcccacaaccatgaataacaaccaacaacctgctgccgacccaaatgtcaagcctgaaccagcaccttatactagcgaggaactaatgaaagtaactgaagaacaaattgctgcatcagctgctgctgcttggaatccacaac

SEQ ID NO: 19442 - DNA, 441 bp, Zea mays
  Clone ID: LIB189-025-Q1-E1-E8
gaattcccggctcgacccacgcgtacgatgtacgcctagctagctcggagcttgtccaagcagagctctgcacgtactgaacctgaacacacagtagagtagcgcaacggatctcgaaatggctgcgaggcttgcgctcctcatccttgccacgaccttcctcctctccgccgccgcggacgggggcagcaccaactgcccgtcgccgccaatgaccccgaccccgacgacgccacagcctcctccgtccgacgggggcgggggcgggggtggtaacggctccgccggcagctgcccgatcgacgcgctgaagctcgaggtgtgcgcgaacgtgctgaacctgctgaggctgaacatcggcgtgccagacgacgagcagtgctgccgtttccggaggggttccccaacttcgacgccgccgtctgcctctgcctcgccatc

SEQ ID NO: 19443 - DNA, 400 bp, Zea mays
  Clone ID: LIB189-025-Q1-E1-F10
gtcaggaattaccggctcgagccacgcgtcagcccaagcgtccgcccacgcgtccggtatcctctcagttgctgccattgataagggcactggaaagaaacaggacatcaccatcactggtgctagtacgctacctaaggatgaggttgagagaatggtagaagaagccgataagtttgccaaggaggacaaagagaagagagatgcaatcgacaccaaaaaccaggcggactcagtggtctaccagactgagaagcaactgaaggagcttggcgacaaagtccccgctcctgtgaaagagaaggtggatgtgaagctccaggagctcaaagacgccatttctggtggatcaacacagagtatgaaagatgccatggctgctctgaaccaggaggtgatg

SEQ ID NO: 19444 - DNA, 438 bp, Zea mays
  Clone ID: LIB189-025-Q1-E1-F4
cccggctcgacccacgcgtacgggaatataatcaagatgcttctggttttcctcggccaacggaggatgaaaatgccgcgtctgctacaggagataattctggcttccaagaaaacaacacgggttctcatatggatctggatatgatgaatgactatgaagtgaaggaatgcaacgattttgggagtgcgattcatggcgttgatacagattttctgaactatggtgacgacgacaacgacgacgacttcgacgacgacttcgagccaaatcccagcgagttccagtctctcgacaacagcggctggtcttctcgcaccaggggtgtcgcgagatatctcaagactctgttcgacgaggactccggtctggggaagaagaacgtccccaaccaacaaccgggtgcccgggaagacgcggaaggaagcgtcgaggatg

SEQ ID NO: 19445 - DNA, 387 bp, Zea mays
  Clone ID: LIB189-025-Q1-E1-F5
aattcccggctcgacccacgcgtacgcccacgcgtccgcggacgcgtgggggcgcgccgctggccgccaccgcggcctccgtcgcgtcgccgctcccgcgcaagccggccacctccaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaactgagagctacgtggtcttc

SEQ ID NO: 19446 - DNA, 394 bp, Zea mays
  Clone ID: LIB189-025-Q1-E1-F6
ggtataggttaggaattcccggctcgacccacacgtacgtaatttctcatgcttcaaatctctatttttcttgatatatttggactcacatttttttgtgaataattttataatgctattttgtcattactgtctaaattctaaaatgttcttgtgagacttcattggttgtgcacctgattacactttatctggcttcttttgtcatgcatagttaaatttcaaactgtattgtattagtttgtatttcatataccgtacacatgaagtttgagtatgaactggcatttccatcagcattacagttgcttacttgtgctatctgtttgctggtgcaggaagctgaaactgctataactgaaatgactggaaaatggcttggaagcagacaaat

SEQ ID NO: 19447 - DNA, 271 bp, Zea mays
  Clone ID: LIB189-025-Q1-E1-F7
ggtataggtcaggaagtcccgggtcgacccaagcgtacgcccatgcgtccgcccacgcgtccgcccatgcgtcagcggacgcgtgggaaaaaatatttgtgaaaaaattaaaaaatgtaattttgtcattaaaagtataaattataaaaagtgaaatgatgaaaattcaatggaatgtgaaaatgaaaaaaaaataaaaaggcatcatttggggggggatatttaaatggttcaatgctaatgtagtagtttgtaaaacataaaacgtttt

SEQ ID NO: 19448 - DNA, 382 bp, Zea mays
  Clone ID: LIB189-025-Q1-E1-F8
gtaaggtcaggaattcccggctcgacccacgcgtacgcgatcgtattcgtatccgcggaacaagcagcgaaggatcggagcctatccaatggccgagggcaagagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacctgaaggagttcagcgcgggacacgccaccgagcaggagcagcctgcggcggcagcaggcgacgacgcggcgcccaag

SEQ ID NO: 19449 - DNA, 406 bp, Zea mays
  Clone ID: LIB189-025-Q1-E1-F9
agttttatttttttttttttttttttttttttcttttttttttcatccactgatgacgatacatgcgtctgtgcttagtttacatcgaccgcttaaagcaagcagccattgacattgattgatgagcacacacatcgatcatgagcataccccggctggtgcaactactaaacgcctacgatttgaacaagtagagtacagggaagaccaaactgttcactccacggacggacggacggacggaccaatggatgggtctgaaggtagtacacatgtacggcgttgctcagtcagttaattgccggggaacaagttcgtggcgtatgcccaggcgttgttggcgacggggtcggcgacgtggtcgaagaggttctccatggggcccttgccggtgacgatggcctgc

SEQ ID NO: 19450 - DNA, 364 bp, Zea mays
  Clone ID: LIB189-025-Q1-E1-G5
attcccgggtcgacccacgcgtacggtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctccaagactggacg

SEQ ID NO: 19451 - DNA, 380 bp, Zea mays
  Clone ID: LIB189-025-Q1-E1-G6
tcccggctcgacccacgcgtacgcatcgtcccacgggctggcctccacgcctggcgccaatctccacgacgacttgccggccggccgtcttggcgactgccgcggcccataagaggagcctgctgctggcgacggcctccgagacgaggggagtcgcgccggtgaggtccagcgggatcgagaccagcacggtgggtctgggatgtgaggccgtcaccgggcaggtcacggaggtcaacattgacactttctggcccatcgtctaggccgccggcgacaaggtcgtcgtcctcgacatgtacatcgaatgctgcgggccttgctatgtgatggctccgaaattccaggagatgtctgataagaatctggatgttgtgttc

SEQ ID NO: 19452 - DNA, 429 bp, Zea mays
  Clone ID: LIB189-025-Q1-E1-G8
aattcccggctcgacccaagcgtacgggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggatcactggtattattaagaggccaaagatttctggagcacaacttgtagccatcctacctctggctattgttcatactatgggcaatctcttcaccaacatgagccttgggaaagttgcagtgtcatttacgcacaccatcaaggctatggagcctttcttttccgttactctttctgcaaatttccctgtgcaactacctaacaatttgggtagtaccttcccttcttcca

SEQ ID NO: 19453 - DNA, 349 bp, Zea mays
  Clone ID: LIB189-025-Q1-E1-H2
ccggctcgacccacgcgtacgagatcgtactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttcccgatggaggcctgcgacctgcttggtggcgacgcgtgcaacgggcccatgttcccggaggccaagcccgcctcggcggcggcggcgg

SEQ ID NO: 19454 - DNA, 62 bp, Zea mays
  unsure at all n locations
  Clone ID: LIB189-025-Q1-E1-H5
agcccacgcgtccgcccacgcgtccgcccacgcgtccgcncacgcgtccgcggacgcgtggg

SEQ ID NO: 19455 - DNA, 428 bp, Zea mays
  Clone ID: LIB189-025-Q1-E1-H7
aattcccgggtcgacccacgcgtacgaacaacttttaagtttacctttcatcagggccaactgttcatgattcatattattgtttaatctttacctccttcctataagatccacatcactaacatccataattctgagaatggaactatcgctatcgtgatctgtaagtgacatgggaagtagcatccaagagtctaatgaaattctgaatttttatcacctgagctagcagcactgtgatctgtcagaaacattaggggtaatacccagcaatggtgaccgagttatgaattttacgggtctgagtgagcagatgctgtaatctgatctagcaacatcattgcacgccaaaaaagtttttgtcgcattaacaaaatttctttgcacatcgtttaaggtggccaaggacccacctggcaaggatatca

SEQ ID NO: 19456 - DNA, 416 bp, Zea mays
  Clone ID: LIB189-025-Q1-E1-H9
acgcgtcaggcaacccagggcgcaaccatgggtcaacaacaacaaaggccggcggccaagccgatgggcacgctcgcctcccaactgggccatccctccgtctctcaacctcaaatggaagatgttcccctcctgaggggattcaattgcccgtcaaaaggttcggggccaagcttcaaagtcccgattttgggtgcagcaggtgggattgggcagccacttgcgctattgatgaagatgaaccctcttgtttcggtgctccatctatacgatgtcgtcaacgcacctggtgtcacagccgacatcagccacatgaacactggtgctgtggtacgtggcttcttgggccagccacagttggaaaatgccctggctggaatggatcttgtaataattcctgctggtgtccctcggaa

SEQ ID NO: 19457 - DNA, 331 bp, Zea mays
  Clone ID: LIB189-026-Q1-E1-A2
cgggccgacccacgcttcgacggacccttggccggttcaaaatggcggcttcggatgttgattaccgctgcttcttcggcggcctcccttgggcaacggacgaccactccctcaacaacgccttcagcacctacggcgaggtcctcgagtcaaagatcatcctcgatcgggagacgcagaggtcccgccgcttcggcttcgtcaccttctccacggaggaggcgatgcggaacgccatcgagggcatgaacggcaaggaactggacggccgcaacatcaccgtcaacgaggcccagtcccgcggcggccgtggaggcggcggcggtgggta

SEQ ID NO: 19458 - DNA, 157 bp, Zea mays
  Clone ID: LIB189-026-Q1-E1-A7
aaaaggtttcacacttacttacccttaaatggaagttcaaacccctccaaaagggtcaccaaaattcaattcaagggccttctttttaaaacgtctaaactggaaaaaccctggctttacccaatttaaaccctttgcagaaaatccccctttccca

SEQ ID NO: 19459 - DNA, 375 bp, Zea mays
  Clone ID: LIB189-026-Q1-E1-B5
gtccagaattcccgggccgacccacgcgtccagccaattcgcctatcacaaattaaaccatatcacacaaagcagacgtaaatgtccgccgaccccaacaatgcgcgcaacaccgacatctggatagcaggcgccttcgcggccttcacggtcgacttgctggtatacccgctagacacagtcaaaacgcgcatgcaaagcctcgactacaagaaactatacacaaatggcgccgacgcaaaagtcaaccggtcgatgtttcgcggcgtataccaaggaattggaagtgtaattctggcgacattgccttcttcaggagcattcttcacgacgtacgaaggagtgaaatctatcctgaaagaacacaatcctaaa

SEQ ID NO: 19460 - DNA, 263 bp, Zea mays
  Clone ID: LIB189-026-Q1-E1-B6
tttttgattcatacccgtgccaaccgaccaaattgccagatacacgattacaaagcgaatgtaatatactggttttgacagctcgccgtgtccacaaagtgtgacgcacaaatactcccaccacaaagatatacaatacaagcatacaagcagcaatctgcatgcctcactcaacaccaacagcacacaacccaggtagcacagcctgtggcttccccctgcccatggtgaaacccctggtgccatcaggcatgcgggggcct

SEQ ID NO: 19461 - DNA, 419 bp, Zea mays
  unsure at all n locations
  Clone ID: LIB189-026-Q1-E1-B7
ttcccgggccgacccacacgtccacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgaaggcgagtacgagaggtacaagaaggaggagaaggagcacaagcacaagcagcacctcggcgaggccggcgccatcgccgccggcgccttcgcactctacgagaagcacgaggcgaagaaggaccccnagcacgcgcacaggcacaagatcacggaggaggtcgctgccgcggcggccgtcggcgccggcggcta

SEQ ID NO: 19462 - DNA, 217 bp, Zea mays
  unsure at all n locations
  Clone ID: LIB189-026-Q1-E1-C3
gggtcgacgcacgcgtccacccacgagtccggccaggttgacgctgaaagggtatactcttcctatctagaacttaacttggaagaggtanaaccatgtctatcangaccaaaacggcctcatgatcgagtgacattgaagaatatgaagtctgattggctttcttgcttggacagcgatgtangattcaagggttttgctgtcnccaaagaatcac

SEQ ID NO: 19463 - DNA, 312 bp, Zea mays
  Clone ID: LIB189-026-Q1-E1-C5
cggtcgacccacacgtccgaccacgcgtccgcggacgcgtgggcggacgcgtgggctgttctcgcactataaatgtcctatctgatggactggacatggacgacgacatggatgatcttgattccgactcagatcttgatgttgacagcatcggtgagattgtgtacgcaatgtgagtaacatctcaacagccatctcagcagtcaaccaaggaaccaatcaagcatgggatgccctgttgtatactctggcaataggcatgcatccttttgtgaaaaacatccaagttcttttcccaagggatcccaatgt

SEQ ID NO: 19464 - DNA, 200 bp, Zea mays
  Clone ID: LIB189-026-Q1-E1-C7
aggtataggtctagaattcccgggccgacccacacgtccacaaaccaataagcaattagctcgagcaaagaggcagcgaacacccgcggcgacgcaagagggagaagcgagcgtgcaccggtcctcctctcattcaaaatggccatggcggcaccggccggaaaaacccgaaggtcccccctggcttccgggttcctaac

SEQ ID NO: 19465 - DNA, 435 bp, Zea mays
  Clone ID: LIB189-026-Q1-E1-C9
acgcgcccaggtagccggtcgggaattcccggcctcgacccacgcgtacgcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaggcgctctccgccaagctcccgcgctgcgacgtctgccaggagaaagcggcgttcatcttctgcgtggaggaccgggcgctcttctgccaggactgcgacgagcccatccacgtcccgggcacgctctccgg

SEQ ID NO: 19466 - DNA, 242 bp, Zea mays
  Clone ID: LIB189-026-Q1-E1-D1
ggtcaagaataccgggccgacccacgcgtccagaagcaggtaaagctctggaaaccttgaaaaattggaaaggggaaaaatccagggataaggtcccccaatccttcaatccccccaacctaccaaggacggcattaacggttgccaatgggttaaaggaccttgctggatttgtccttgaaaagctaggacctaaaaatgcaatcttcaccaaagcagccgatgccatggtggaatggaac

SEQ ID NO: 19467 - DNA, 429 bp, Zea mays
  Clone ID: LIB189-026-Q1-E1-D10
ccgggtcgacccaagcgtccgccccccgcaagtctgttaagattggcagacctgggtataaagtaaccaaacaatatgatcctgagatgaagcaacactcgtttctttttgaaattggttacccggaaatcgaagataattgcaagccaaggcaccgtttcatgtcatcatatgaacagaaagtccaaagttgggataagggttatcagtacctactttttgctgcagagccctatgaaattattgcattcaagataccaagtacagagattgataaatcagcgaacaaattcttctcttactgggatcctgacaagaaggaatatctactgcaactgtacttcaagccaagaccgccagaagctaataaaccaccaccagctcctccggggactttgcctaatgggactggggttcctggtgctccaa

SEQ ID NO: 19468 - DNA, 239 bp, Zea mays
  Clone ID: LIB189-026-Q1-E1-D2
gcgcccaacgacaccaaaggggtgttgtggttcaaatcgctcctcgggaaatgactgcccgtcaacgcaagcgcacctgctcccgtacagtgcttgcaattgcaacaaataaaaccaagcctgaattaattaaggttgggaatttaaccttgtaataaccgtccccccaaccgtgttttgtgaaactgttgacggtctgttaacgttatacgtgcatgttattttaaagatttcaaaaa

SEQ ID NO: 19469 - DNA, 304 bp, Zea mays
  Clone ID: LIB189-026-Q1-E1-D3
gggccgacgcacgcgtccaggtgtagtcacggcaaaattcttgcaccgacttataaaaaggtggcttcggtttcaaatttggataaaggatttgtaatggcaaaccttgaccctaaaaaaaaaaggaatttggctaaaaattagggattaatgggattcccaaccttaaattttttcccaaaggaaaccaaacctggtaaaaattataatggtgaaaggaacttggttgactttgtcaagttcattaccaagaaaattggtacaacccgtgacacaaagggtcaactaacctcaaaggctggcc

SEQ ID NO: 19470 - DNA, 109 bp, Zea mays
  Clone ID: LIB189-026-Q1-E1-D5
aagcccttcgtcttctcgcagtgccagtccatccacgcccgctccgtcttcccctgccacgacacccccgccgcgcgcatcaccttcccgctcctcctcaacgtccccg

SEQ ID NO: 19471 - DNA, 90 bp, Zea mays; identical to SEQ ID NO: 5454
  Clone ID: LIB189-026-Q1-E1-D6

SEQ ID NO: 19472 - DNA, 123 bp, Zea mays
  Clone ID: LIB189-026-Q1-E1-D7
ccgggccgacccaagcgtccagatcgtccaaccccaacgcgtccgccgcgaccggttctcgatcgatgatcatgtccggttcgtccgccatgaccaccggtgcctcgtccgccgcctcgtcgg

SEQ ID NO: 19473 - DNA, 365 bp, Zea mays
  Clone ID: LIB189-026-Q1-E1-D9
cgcgcccaggtaccggttaggaattcccggctcgacccacgcgtacggggggtattcatgtttggcatatgccagctctgaccgaaatctttggagatgattccgtattacaatttggtggatgaactttaggacatccttggggaattgcacctggtgcagcagctaatcgtgtggctttaaaagcctgtgtacaagctcgtaacgaagggcgcgatcttgctcgtgaaggtaatgaaattatcatagcagcttgcaaatggagtgctgaactacccgcagcttgtgaaatatggaaggagatcaaatttgatggtttcaaagcgatggataccatatacaataaaagcaaagccgcaacagtc

SEQ ID NO: 19474 - DNA, 383 bp, Zea mays
  Clone ID: LIB189-026-Q1-E1-E10
gaattcccgcctcgacccacgcgtacgcccacgcgtccggaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcct

SEQ ID NO: 19475 - DNA, 292 bp, Zea mays
  Clone ID: LIB189-026-Q1-E1-E5
ggtacaggtctagaattcccgggccgacccacgcgtccacccacgcgtccgagtcagcaccgccttctgtgctgagattgttgagtccgcagatgcctacctctttgcaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagaaggttaataagaacaccactgcctatgag

SEQ ID NO: 19476 - DNA, 340 bp, Zea mays
  Clone ID: LIB189-026-Q1-E1-E7
gacccacacgtccacccacgcgtccgcggacgcgtgggtttttttttttttttttttgtttttagaaagaaaagctgtgatatttcataaccctacagagacaaccagaagataatagaaaaaatcatatagcatgtatctgtgaaaataaatagctttgtgacactgacacgcaccagtgccaaagccaaacaacagagaacatcccaagatgccaacttgttctagcaactactacattacattttcaactttctaaaatggccacttgggtcaggccaccagaggctgatcaggcaaacctgccccaacgccggtaatccttacggaagtccgtcat

SEQ ID NO: 19477 - DNA, 307 bp, Zea mays
  Clone ID: LIB189-026-Q1-E1-E8
ccaggtaaaggtccagaattcccgggccgacccacgcgtccagcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcgg

SEQ ID NO: 19478 - DNA, 407 bp, Zea mays
  Clone ID: LIB189-026-Q1-E1-E9
ccggctcgacccacgcgtacggttgatccttggtatcaagttggcttcgtcctcacaaccggggtcaacagcgcatacgttctaggatactctggatcaatcatggtccctctaggctggatcggcggcacatgcggcctcctcctagctgccgccatatccatgtacgctaatgctcttcttgcacggcttcatgaagtcggtggcaaacgccatatcagatacagagaccttgctggacacatatatggaccgaaaatttacgggcttacatgggctctgcagtacattaaccttttcatgatcaacactggctttatcatcttagctggacaagctctcaaggccacgtatggactgttcagtgatgatggagttctgagactcccttactgcattgcgatatc

SEQ ID NO: 19479 - DNA, 313 bp, Zea mays
  Clone ID: LIB189-026-Q1-E1-F1
gggccgacccacgcgtcgaccaaaacttcggccaagccttcggccaacgcttcgattaaaatacatactggcccacccgtgattccttcacccagcagttcgtaaccacctgctaaatcatcaaaaagatgcccccctgcaaagtagcagcagccttactcctgttgatcatcacaacaatttctgtcaacaccgtaactgggtcgcgatgtaacgctcaagagaagaaccagattgtgagcttgtgccaaatgtacatccagagaggaaccctcgttcagctcccatcccaaactgggccatgctgtgccgc

SEQ ID NO: 19480 - DNA, 453 bp, Zea mays
  Clone ID: LIB189-026-Q1-E1-F6
ggtaatggtccagaattcccgggccgacccacgcgtcaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctcgggcctgctcaagttcaacgaccccgtgggcttcaacctcgtcgacgtcct

SEQ ID NO: 19481 - DNA, 397 bp, Zea mays
  Clone ID: LIB189-026-Q1-E1-F7
aattcccgggccgacccacgcgtccaattaaccctcgttcctgtcgcgcagccacgacctccacttccacatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaaactcgaggctgccaagaagttcgagccgaaataccgcctcatc

SEQ ID NO: 19482 - DNA, 380 bp, Zea mays
  Clone ID: LIB189-026-Q1-E1-G10
ttcccgggtcgacccacgcgtacgcccacgcgtccgcccacgcgtccgcccaagtgcgaccacgtcgccgtcggcaccggcaccgtcacgcacaaggccgacatcaagaagtttcaggccgccacgcgcctccgcgccaaggacaagattgagggcggcaagatcatccgcgtcgaggcgcaccccatccccgagcaccccaggcctaagagggtgtccgggcgggtgacgctggtgggcgacgccgcggggtacgtgaccaagtgctccggcgagggcatctacttcgcggcgaagagcgggcggatgtgcgccgaggccatcgtggcgggctccgccaacgggacgcggatggtggaggagagcgacctgcgcaagta

SEQ ID NO: 19483 - DNA, 396 bp, Zea mays
  Clone ID: LIB189-026-Q1-E1-G12
ctcccgggtcgacccacgcgtacggaaacccactctctctctcccccgattcctttcctcgtcctcatccgtccaggggagcaaacaagcaagcaagtaaacgggcgaggagctggatagaggccggcgacgcgaagcaaccgccgatcggagccgcggctgaggaggaggagcaagctcgagatggtgggtctcgtcggcggcagcacggcgcgggcggagcacgtcgtggccaacgccggaggagagacggagtacgtgcgccgcctgcaccgccacgcgccggccgagcaccagtgtacttccaccctcgtcaagcacatcaaggcgcccgtccacctcgtgtgggagctggtccggagcttcgaccagccgcagcggtacaagccgttcgtc

SEQ ID NO: 19484 - DNA, 285 bp, Zea mays
  Clone ID: LIB189-026-Q1-E1-G6
aattcccgggccgacccacgcgtccacccacgcgtccgctttcttggagatcctcaagaggcttgagaagctcaaggagcattattcacacgagaaccactggcatttgttccagtagcagtgcgcatataatcatacagtatatttttttactatgactgttgtcatgattggggctttctcgggagatctgacattgatgaatgtacaaaattgggtgcctctagaaaggtccactgagactgaaaaatcttcttgctgttttacgtcgatgctatttctggt

SEQ ID NO: 19485 - DNA, 67 bp, Zea mays
  Clone ID: LIB189-026-Q1-E1-G7
acccacgcgtccgaaaaaaaaaaaaaaaaaaaaaaaaaaaaaaaaaaaaaaaaaaaaaaaaccaaaa

SEQ ID NO: 19486 - DNA, 72 bp, Zea mays
  Clone ID: LIB189-026-Q1-E1-H1
aagaggttccaagcttaagtacgcttgcatgcaaagtcaaagctcttctataatgtcaccaagaattcaatt

SEQ ID NO: 19487 - DNA, 156 bp, Zea mays
  Clone ID: LIB189-026-Q1-E1-H10
agcccacgcgtccgaaaaaaaaaaaaaaaaaaaaaaaaaaaaaaaaaaaaaaaaaaaaggaagaaaatcaaaaaagataaaaacttacatatacatgacatcaaaaataataactcttcaaaaaagtaacctcaaattcaattcacggggcgctcc

SEQ ID NO: 19488 - DNA, 369 bp, Zea mays
  Clone ID: LIB189-027-Q1-E1-A10
ggtctagaatacccgggccgacccacgcgtcagctgggtcgaagcacagattgagaaacattctagaagccgtatagaactcatggtgaaggcaaggagtcagtttaaagaaagaagcacagcaacgaatgttgaaattgaagtgcctgttccttcagatgccacaaacccaaatataagaacttcaatggggtctgctgcatatgctcctgagagagatgcaatggtttggaaaataaaatcattccctggtggcaaggaatacatgtgcagagcagaatttagtcttcctagcataacagcggaagaaggggccccagaaaagaaggcgccgatacgggtgaaatttgagataccatatttcaccgt

SEQ ID NO: 19489 - DNA, 387 bp, Zea mays
  Clone ID: LIB189-027-Q1-E1-A12
cggtccagaattaccgggccgacccacgcgtcagcccacgcgtccgatctactgacctgtgacctccgcatttccaaacagcccgagcgagctagagctagcagagcggcaggcacctccctcctcaaggaacatggcccgcacgcagcagttggcagtagtggcgaccgccgtggtggccttggtgctgctggcggcggcgacctcggaggcggccatcagctgcgggcaggtggcgtcggccatcgcgccctgcatctcctacgcgcgcggccagggctcggggccctccgccggctgctgcagcggcgtcaggagcctcaacaacgccgcccgcaccaccgccgaccgccgcgccgcctgcaactgcctcaagaacgccgccgc

SEQ ID NO: 19490 - DNA, 376 bp, Zea mays
  Clone ID: LIB189-027-Q1-E1-A2
gggccgacccacgcgtcagtatcgatccacgcatccctcgcgagctccaacagaattggaagcaaacaaaccctgcaacatgcaaacaagccctgacgctttaaaacatcggccggcactcgattcgcagcaggtcaaagatggcggctgaagaaggggacaaagcgaaaagccgctgaggcgggcagcaaatgacggtggtgccggggctggacgtggcgcggtacatggggcggtggtacgagatcgcgtcgttcccgtccttcttccagccatgggaccggcgcgatacgctcgccagctaccggctgctggaggacagcgccacggtgcacgtgctcaacgagacgtggagcaagggcaagcgccactacat

SEQ ID NO: 19491 - DNA, 351 bp, Zea mays
  Clone ID: LIB189-027-Q1-E1-A6
aggttggttgcatcataaaaaagatctgtataaattcgcgcccaagctgattatgccactgtggaaatgcatttggatttccgtagtgtcagtccggtcgatagggtgccttgggttcttcatggcacgagcaaatgttctgattcttgtattcgaatgttttgaaatattctgtctgacgggactgcggagttggcgcgagaagtgtgcttgttcagttgttctatctgaaggcttagctgtctgtagctgtagctggtaacaacagtggctaaaatggtacctgaaatctttgtgacagtaacaagccatttttctttgaaaaaaaaacaatacgaaaaaaatagaatg

SEQ ID NO: 19492 - DNA, 379 bp, Zea mays
  Clone ID: LIB189-027-Q1-E1-A7
ccggctcgacccaagcgtcagatcagatgttcgatgcaataatttgtgacccaccatatggagtccgggccggtggccggaagtctggtggtcggaagctcataaaaggcgtcaaaggcccttacacagtgcctgatgagaaacgggacaatcacatcccatcaaccgccccatatagcctcgcagagtgcgtccatgacctcctccaccttgccgcaaggatggtagtcatgggtggcaggctcgtcttcttctaccctgtactgcgaggtgaagatggcactgcgaacccgcagttccctgagcacccctgcttcaagttaatcacctcctctgagcagatcctgagctttcggtacagccgggttctgctgaccat

SEQ ID NO: 19493 - DNA, 374 bp, Zea mays
  Clone ID: LIB189-027-Q1-E1-A9
gtaccggtctagaattcccgggccgacccacgcgtcagcactgttgtcgcactgctcagttatccctggtggtgtgccggtgactgagtttgcaattccaccctcagcatcttcgctagcggtgaggctgccatcgttgctcgcttgtcgacgctcttcaaggaaacacgtggtacatgggcaagttcgttgtgcggcaactcgcgaagctgggcaaccagatcaccatcgcatccaccatggtaggtcttgtggagtgcaaggtgtacgcgtacaaggtcggtctggatgtgatcaagttgctggagcgcatgcagattcgacaagaggggtggtagctttggaagttgagatgagcttgcgctgtggagaac

SEQ ID NO: 19494 - DNA, 390 bp, Zea mays
  Clone ID: LIB189-027-Q1-E1-B10
ggtccagaattaccgggccgacccacgcgtcagcacgcaaacgcaagctcccaagcagctaccaaccagccgggagagggagcgcacgcactgcgagaatggccacggccggcggaggggccgggcatctgaagctgctgggcgcgtggccgagccccttcgtgaaccgtgtacgcatggcgctgcacctcaaggggctggagtacgagaacgtggaggaggacctcaccaacaagagcgacctgctcctcgcctccaaccccgtccacaagctcgttcccgtcctcctccacggcgacaagcccatctccgagtcactcgtcatcgtggagtacctcgacgacgccttccccggcgctggccaggccgtcctccccgccgacccctatg

SEQ ID NO: 19495 - DNA, 375 bp, Zea mays
  Clone ID: LIB189-027-Q1-E1-B12
ggtccagaattaccgggccgacccacgcgtcaggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccaggagcagcggagccggcgccgggcgcccgaccagcagcagtacaggggcgtccggcgccgcccgtggggcaagtgggccgccgagatccgcgaccccgtcaagggcgtccgcg

SEQ ID NO: 19496 - DNA, 379 bp, Zea mays
  Clone ID: LIB189-027-Q1-E1-B9
ggtccagaattacccgggccgacccacgcgtcagcccacgcgtccgccgacatggcaagtggtctcatgccaaatgcaccgtgacatgagccaaacaacccatgaacgtcgctccgtaggggacggggaaagcaattccagcagacccacacacgtcgcgtcttccatgcatagaaacgagggaaagcggtttcagcagcagtggggtggagccattttactcatcctaatccgtccaccaacttggctacaaaaagtcgtaccgaggcccctcaagcgatagcggtggtggatctgctcggcgccggtggcccgacgctctccagctactccgacttacctacgtcctccaaggtacgcacgtacgtacatctgattt

SEQ ID NO: 19497 - DNA, 373 bp, Zea mays
  Clone ID: LIB189-027-Q1-E1-C11
gggccgacccacgcgtcagcccaagcgtccgatcataacatcaacggcatcctggctggccatggttggtgttctggctggtctcacctttctgatgggtcctgttacgatgctaaagctctacggagtcccatactttgtatttgttgcttggctggatatggttacatacttgcaccatcatggccacgaagacaagcttccctggtaccgtggacaggaatggagttatctgcgtggaggactgacgacgctcgaccgggactatggactgattaacaatatccaccatgacatcggaactcatgtcatccatcaccttttccctcaaatcccacattaccatctcattgaggcgaccgaggcagcaaaa

SEQ ID NO: 19498 - DNA, 409 bp, Zea mays
  Clone ID: LIB189-027-Q1-E1-C12
ggtccagaatatccgggccgacccacgcgtcagcggacgcgtgggtggcagagatgctctcatatacaagtaaaagcaactttatttggtccttggttgggcggaaaccaggccgggactcgggagcattttgcattttcttggcgtggtagcttttgatacggtgaagtcactgactcgtggagtgatgttgctcaataatcagaaccttgtcctaatacagccgctgagacatcagctaaggcgaataagggaaggatgagtcatttgcaccatgtttgaccaccaattgttaggtggtccatatattttgtactaattgtgagactttgtgctatggatctcaactgtataccttgctggtgcatggctttgggtttacatgggtgaaaatgagattggggtgccc

SEQ ID NO: 19499 - DNA, 332 bp, Zea mays
  Clone ID: LIB189-027-Q1-E1-C2
gccgacccacgcgtcaggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatg

SEQ ID NO: 19500 - DNA, 375 bp, Zea mays
  Clone ID: LIB189-027-Q1-E1-C3
gggccgagccacgcgtcagagagtataagcttgacctctacaataacgctggagtacattattgtatcagcagcatctcgctcgtagccatgatgacgacgagaaaagtggccgcggcgggaggcggggaggcggaggagatgaggcggagaaacgccgagctcgagagggcggcggcggaggcggcggcgagggaggaacggctgcggcgggagctggaggcggccctggcgcggctggccgtggccgaggaggccgaggagcgcctgtgcgtgcagctcggcgagctggaggccgaggccgtggagcaggccgtcgagtaccaggagcgtgtcagggcgctgtccgagcgcctcgccttccttgacggcgtgc

SEQ ID NO: 19501 - DNA, 373 bp, Zea mays
  Clone ID: LIB189-027-Q1-E1-C9
ggtccggaatacccgggccgacccacgcgtcagcccacgcgtccggccacggcttcctcctccgcctccgcctccgtctcgccgccgccgccctcctcctcctcctcgtcgccggcggtgctccagttcgacgagcagcagcagcagcaaaatccgaggccgcgtgcgccggcggcgtccgggcccacggaggaaccgcccaggccggcccgggcgtcagctccggctccggctccggcgtcgtcctcgtccgtccgccggtgccagacctgccgcaagcgggtggggctcacgggcttccgctgccgctgcggagacctcttctgcggcgcgcaccgctactcggaccgccacgactgctgcttcgactaca

SEQ ID NO: 19502 - DNA, 352 bp, Zea mays
  Clone ID: LIB189-027-Q1-E1-D1
acgcgtcaggcgtcgcgtcgcatcctacgattcaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttcta

SEQ ID NO: 19503 - DNA, 453 bp, Zea mays
  Clone ID: LIB189-027-Q1-E1-D10
ggtccagaattaccgggccgacccacgcgtcagagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgaactcgcaaaatttcccatattgaaagggcaagggcaaagggggtttctcttttc

SEQ ID NO: 19504 - DNA, 395 bp, Zea mays
  Clone ID: LIB189-027-Q1-E1-D12
ggtccagaatacccgggccgacccacgcgtcagcccacgcgtccggcgcccgcgaactctagaggacttgcgcacaagtgacggacaggttgggcccatctgtcggtgtgcgcgtttcccagctgagccgtggggaaagagaggatgagatgggccgaaaacatggaaccttgcccgactatgttcctttactttctctttttctttttttatgtttcttttctttttccaaattcaaggattcaaactaaatttcaattcctgttttgaacttcagatttccaaatatcgcacaatcctattgtgaatataacttctactatttgcattaatattatttatttttcttcctattatttaattatggaagggataattgactttataagaacttt

SEQ ID NO: 19505 - DNA, 387 bp, Zea mays
  Clone ID: LIB189-027-Q1-E1-D9
gccagggcccggtccagaatacccgggccgacccacgcgtcagggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtataca

SEQ ID NO: 19506 - DNA, 355 bp, Zea mays
  Clone ID: LIB189-027-Q1-E1-E10
cggtctagaatacccgggccgacccacgcgtcagcagaggaaaacaaagctattgaggagccagaagaggtgagtgccaagctgccagatgaccatgtaacttctgagaagtcgtcagaggaagacaaagaaaacgcagaggcatcagtagacagtgctcccctggggaacccattggaggtcaatgaggagagctccaatccttcaggggatactgtaactcctgagaagccactggaggaggataagacgagcgcagagccatcagaaagcgatgcatcctttgggaaaatattggaggccgatgaagtgagtgcaacccatcagaggatattgcaactcctgagaagccact

SEQ ID NO: 19507 - DNA, 364 bp, Zea mays
  Clone ID: LIB189-027-Q1-E1-E11
ggtccagaatatccgggccgacccacgcgtcagcccacgcgtccgcttctcctccccctccggttcgggttcgggttcgtgaggttctccggggttcggtttcgtgggtgagcggatcgagatggcggcgtcggatgttgagtaacgctgcttcgtccgccgcctcacctgagccacggacgaccactccctccacaacgccttcagcacctacggcgaggtcctcgagtccaagatcatcctcgatcgggagacgcagaggtcccgcggcttcggcttcgtcaccttctccacggaggacgcgatgctgaacgccatcgagggcatgaacggcaaggagctggacggccgcaacatcaccgtc

SEQ ID NO: 19508 - DNA, 413 bp, Zea mays
  Clone ID: LIB189-027-Q1-E1-E2
cggtcaggaattaccgggccggcccacgcgtcaggtccatgcgggctgcggccctgccttttctcccattcccctcaccacgtgacacgcgctctctcccgagtcccgacgaccgggcaacagccgccgccgccactcagcctccgtcgccgtcgggcccttcgccggcggcgaacaccatcaggtgtacatgcgtacgcccatgcccttggctgcgcccgcccctgcaagtggtttcctgctggtctgtgtggatttggctgccggaagattgattgatgcggccttcaggatcactgtagactcgctgtgagattccaaggctgctcaggtcatgttgggggaccagtgcatcatacaggcgttagactcggttagctcatcaagctctgcccctgattcgaacccccccg

SEQ ID NO: 19509 - DNA, 71 bp, Zea mays
  Clone ID: LIB189-027-Q1-E1-E3
caaagggtccaagcttaacttagcctgcaagggaagtcatacccctccaaaggggtcaccaaaatcaaatt

SEQ ID NO: 19510 - DNA, 386 bp, Zea mays
  Clone ID: LIB189-027-Q1-E1-E9
ggtccagaatacccgggccgacccacgcgtcagggaccacctccacggccacggcaagacggccaaggtgatgcacctgctgctctggggacccaagtgaagcggcgagaggccaccgtaccgccgggctctcccgctggcgttgctcgttttgctctgcctgcaatccgccccgcacggactgtactgtacctatatatacacctacatactacgacgtgcacctgtactacgacgtgctgctgtaccatactaaatactagtgcgctgctgctcccttgccttcttgcttgcaccagccactccgcttttttgctcgaacgatcgactgctcgtgtcgcgtcgggccacggccggtcgtcagtttgggtgtgtccactccactg

SEQ ID NO: 19511 - DNA, 362 bp, Zea mays
  Clone ID: LIB189-027-Q1-E1-F10
gggccgacccacgcgtcagcccacgcgtccgcccacgcgtccgcccacgcgtccgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaaggtctttccaacaaccattggtaataacgtcacag

SEQ ID NO: 19512 - DNA, 389 bp, Zea mays
  Clone ID: LIB189-027-Q1-E1-F11
gggccgacccacgcgtcaggaccaactagcaacatagaaagcacaatagtgtaccaacaatggcagccaaaatattttgcttccttatgctccttggtctttctgcaagtgctgctaccgcgaccattttcccgcaatgctcacaagctcctataacttcccttcttcccccatacctctcaccagcagtgtcttcagtgtgtgaaaacccaattcttcaaccctacaggatccaacaggcaatcgcagcaggcatcttacctttatcacccttgttcctccaacaaccgtcagccctattacaacagttacctttggtgcatttgttggcacaaaacattagggcacaacaactacaacaacttgtgctaggaaaccttgctgcatac

SEQ ID NO: 19513 - DNA, 414 bp, Zea mays
  Clone ID: LIB189-027-Q1-E1-F12
aacctgccaggccggtctagaattaccgggtcgagccacgcgtcagtgcaagaaaaaatctacatgttgatggcgtggatcagaaaaatggtaagttttgcttcatagatgtattaatatttggaatctcaataaacccctcttgttttccgtctgctaacatattcgtatggaacccagcacaaaactcaacgagaataatgatgcaatgatacatacatgtccacagtccatacgttttttttgaagaaataacacttttctagatgagataattagcacatgtgcaattagccaattactgtcttgtgttatgtgagccattggatttgatttttatatcctagaaagtgattcatgttacacttgacctgagattcatggaaccaattggttgagctgcacattcaaatt

SEQ ID NO: 19514 - DNA, 382 bp, Zea mays
  Clone ID: LIB189-027-Q1-E1-F9
ggtcaggaatacccgggccgacccacgcgtcaggacaccttgcccatattcaggtacttatagggcatggatatgggaagcttccttactgtccttgagctctagattccctgcatatgtaaggtggtccttgtgccgtcaagatggtgtaacttcctctccccagtctctagccttgatctgtactagagccaagcacgccagccctctccgtggtgaccattgtccacatcactgtggctagagctcccaacagaaggagtgtaaatttaagatgaagtggttgtggaagaggagtttgctcctttgcctattcatcaagtggatggagctatctaactggttattgggtagaaaggtcttgagcctcttcactgcaaca

SEQ ID NO: 19515 - DNA, 396 bp, Zea mays
  Clone ID: LIB189-027-Q1-E1-G11
ggtccagaatatccgggccgacccacgcgtcagcccacgcgtccgcggacgcgtgggggaaaacaagtcaaatgcaactcctatcaattacagcgagaaggatattacagtaatattcagaaggaggggtggttgtgatcttgttcaaagttttagtgattggaaaggaactgttgcctcagcaccagatgtcataggcatgacctttctttcaattgtctctcttgttgacgatgtaccaggaaagaagcaccttgctcgtgcagttgagctatacttgacctacaaacctccaattgaagaattacagtatttcttagattttcaagtcccactagtttgggctccagctccaccaggtattgctagtcaccataggaaggaacctgtctgccc

SEQ ID NO: 19516 - DNA, 436 bp, Zea mays
  Clone ID: LIB189-027-Q1-E1-G12
cggtcaggaattaacgggtcgagccacgcgtcagcccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcacaaattgctccccaaaaaaaaatctctactttttcaaaggaaaaaccccctc

SEQ ID NO: 19517 - DNA, 406 bp, Zea mays
  Clone ID: LIB189-027-Q1-E1-G2
cgggccgacccacgcgtcagcccaagcgtccgcccacgcgtccggacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataag

SEQ ID NO: 19518 - DNA, 330 bp, Zea mays
  Clone ID: LIB189-027-Q1-E1-G7
aattcccgggccgacccacgcgtcagcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgcccc

SEQ ID NO: 19519 - DNA, 403 bp, Zea mays
  Clone ID: LIB189-027-Q1-E1-G9
ggtccagaatacccgggccgacccacgcgtcagggcgccgactaacaacctcgccgacggcgggtaccacatgtataaagacatgctggagtggatcggccggccggcgaagaacgttccccagcagccgacacagccgctgcgggtgtccatctccaagaagctacgggcgtacgtggaggacaagtatagccgcgccggcgtggagaagggcaagtacgtcgtcatccacggcatcgcctctgactccgtcgccaacatgaagtccagaggcgacgacgactgccttcttcccctcgggcactgggctcagatagccaaggaaatcagctccggcgacagggggctcaagcctctgttcgtgatccctcatgagaagcacagagatgaaatccaggaagaa

SEQ ID NO: 19520 - DNA, 435 bp, Zea mays
  Clone ID: LIB189-027-Q1-E1-H10
gacccacgcgtcagacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggcccaactcgggggccatacataggtattgtgtggtgtgtgtgagagagagagaaacag

SEQ ID NO: 19521 - DNA, 394 bp, Zea mays
  Clone ID: LIB189-027-Q1-E1-H11
ggtccagaatacccgggccgacccacgcgtcagccttgacattctcaaagagcagtggagccctgctctgacaatttctaaggtcctgctctccatctgctccctgctgaccgaccccaacccggacgaccctcttgtcccggagattgcccacatgtacaagacggaccggccgaagtacgagtcgacggcccgcagctggacgcagaagtacgcgatgggctgacgaacgctttcctgctcgtccacccgactggcgtctcaagaaagccgttcctgggcgccattgttcccttggatttgttgttggtcgtgtgtatccctgatccatctaggatcatcgtattgtattgtattgtagtgtatgtcgtcggcttaccatcgttgccatcca

SEQ ID NO: 19522 - DNA, 380 bp, Zea mays
  Clone ID: LIB189-027-Q1-E1-H12
gggtcgacgcacgcgtccgcccacgcgtccggcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagc

SEQ ID NO: 19523 - DNA, 417 bp, Zea mays
  unsure at all n locations
  Clone ID: LIB189-027-Q1-E1-H2
ttcccgcctcgacccacgcataagaaaccaaacgatacaggaatacgatacgccgctcgcctgaatcgagaccaccaccgctcccgccctgcctcacctcgccgactagagtttttgccgccgcggatctcgccgtccccgccatggacgcgtcgcacacgggctcctccgcagccgccggcgacgccccgaccaccggggagcaccggatggggaccaccattgtcggggtctgctacgatggtggcgtcgtcctcggcgctgattccaggaccagcactggaatgtatgtagccaaccgtgcttcagacaagattacccaattgacagacaatgtgtacgtttgtcgctctggatctgctgctgatacacaagtcatttcggactatgtacgttnattcctccaacaacacacaa

SEQ ID NO: 19524 - DNA, 410 bp, Zea mays
  Clone ID: LIB189-027-Q1-E1-H7
cccacgcgtccgacgagagagagcagaccattaaccagctcttgacggagatggatggcttcgctggcaacagcggtgtcattgtgcttgccgccaccaacaggcccgatgtgctggactccgcgctcctacgaccagggagatttgataggcaggtcaccgttgacaggccagatgttgccggacgcgtcaagattcttgaggtccactcccgaggaaaggctttggcgaaagatgttgattttgataaaattgctagaaggacccctggtttcactggtgctgacctccaaaacctcatgaatgaggctgccatccttgctgctcgccgtgatcttaaggaaattagcaaggatgagatctctgatgctcttgagagaatcattgctgggccctgagaagaaaaatgc

SEQ ID NO: 19525 - DNA, 373 bp, Zea mays
  Clone ID: LIB189-027-Q1-E1-H9
gggccgacccacgcgtcagcccacgcgtccgagtatctctctctcccgcgcgcgcgggtgagccggggaccctcctacgtctcgccaccctgctggtatagcccgccggtcgtccacgccatggccacccaatatgcgcggctctccctgccatgccgcctgccctcgccgctccctccgccggtgccgacgacgacccgccggctgccgcgcgccgcggcggcggcggcgtccacctccccgcggtgcccacgcgtcgggggcgcggcggccacgcgcgcccgcggcccgtgccggcctcgcgcctccgagggcgaagtgcagcagcaggacgcggaagcggaccaagtggtggacagcaacatgctgccct

SEQ ID NO: 19526 - DNA, 452 bp, Zea mays
  Clone ID: LIB189-028-Q1-E1-A10
gggtcgacgcacgcgtccgaggacgagtggggtgatgcacaccatataagggtacactcatgttggatatctgctaactcgcaaaagaaactcaggtgcccacacacagtgctaggtttgctattcttcacagttctaatttttagcatttaaccaaagcgcgtttgtctatccttaaaaggagtgtgttttccaatgcttgaacttttgtagtaagggtgtgctacatcaaatccagcgtgtttaggatactgctacatacatgaaggtgagctttaggattgtttcctaaagcctcctagaatctgtcattaggaatttttagagatgctgacatacttagatttttctccctttttggggaaaatcttggttaaataagtaattgttgcctgtgtagtaaactaaaatgggctgttttaacacactcaaaaaaaaaacgggggaaagaa

SEQ ID NO: 19527 - DNA, 281 bp, Zea mays
  Clone ID: LIB189-028-Q1-E1-A6
ggtaccagtcaagaattgccgggccgacccacgcgtccaatgattaagataggagattattgttgaggagagagatcgattattattattgctgctactgcatatgtttagtgggtgtataggttgggaacacacattcatggaggatggaaccacacaccgatcaattggagggagaaagagattgttcgggtaattaattgtaatatatatagagagagacaattgacccacatacatatataagctattagtgcaatgcttgctgttgggtcaaaaac

SEQ ID NO: 19528 - DNA, 451 bp, Zea mays
  Clone ID: LIB189-028-Q1-E1-A7
ggtcgacgcacgcgtccgcgaggtggcacacaacgtgtgggccgacaccttctacgccatggcggagaacaacgtcatgttcgagggcatcctggtgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggatgcgacgcagaacctcaacgccatgaaccaggggcccaacccgtggcacgtgtccttctcctacgcgcgggcgctgcagaacacctgcctcaagacctggggcggccacccggacaaggtcaaggcggcgcaggacgcgctgctgctgcgcgccaaggccaactccctggcggcagctcggcaagtacacctccgacggcgaggc

SEQ ID NO: 19529 - DNA, 449 bp, Zea mays
  Clone ID: LIB189-028-Q1-E1-B11
ggtcgacgcacgcgtccgaggattaagccgaaagatcaaaatgacgcatcaattgtcacaaaaactaatttcaagcatctgtattggacgctgacacagcagctagcacaccacaccatcaacggatgcaacatgaggccgggggatatatttgcgactggcacactgagtggacctgaacgggactccctcgggtgtctgctggagctgacatggaacgggcagaaggagataccggtggggaatttgacccgcaagttcctagaagatggagatgaagtcatcttgacaggatgttgcaagggtgaaggctacaacattggttttggaacctgcaccgggaaggttctgccggcacttccctgagccaacacgtcttggcatcagttctccggagtctcaacgatctcagctatcagagagttgtctcaacggtctcaactatcaaa

SEQ ID NO: 19530 - DNA, 424 bp, Zea mays
  Clone ID: LIB189-028-Q1-E1-B12
ccggtcaaaaattagcgggtcgacgcacgcgtccgaccacgagtccgcggacgcgtgggccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaagtgtacaaggagctgcaggaggccatcaaatcctacccggacgccttc

SEQ ID NO: 19531 - DNA, 447 bp, Zea mays
  Clone ID: LIB189-028-Q1-E1-B2
acgcgtccgaccacacgtccgcccacgcgtccgcccacgcgtccgcccacgcgtccgcccacgcgtccgcatcatgtttgatgtaacttcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgattcgaaccttcactttgttgaagctgttgctcttaagcctccggaagttaccatcgacatggctatgcagcagcagcatgaagctgagcttgctgcagcagctgcaaaacctcttcctgatgacga

SEQ ID NO: 19532 - DNA, 140 bp, Zea mays
  Clone ID: LIB189-028-Q1-E1-B4
caaacctccgccggccccttggaaaaaaaaaaaaaaaaaaaaaaaaaaaaaaaaaggcgggcgacccaaaaggattaaacttagctacccgtgcaatggaactcaaaaggctcctctagagcggcacccaaaattcaatt

SEQ ID NO: 19533 - DNA, 460 bp, Zea mays
  Clone ID: LIB189-028-Q1-E1-B7
cgggtcgacccacgacgtccacgccgtcgggcgcctggaagggcaccagcggaggccacgccgtgctcatcagcggatacagcgagggcaaaggcaacttcgccatggtcagggacatgatacatacatacatactgctgatcgagctctgctgccttgcatctatctatatacctaacatgcatatgctgctgcttggacgacgcgcggcgtgcagatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcacggggccatcggcgcacccatccgcaccgtcgccaacttcagcggcgtgcacgtatccatgtcgaatctcctcgtctctgtcaacatcaacatc

SEQ ID NO: 19534 - DNA, 450 bp, Zea mays
  Clone ID: LIB189-028-Q1-E1-C1
cgcgtccacggacacgtgggcggacgcgtgggcggacgcgtgggtgagaggatgactcgggtgcaggaggctactctgccaataattcttcaaggaaaggatgttcttgcaaaagcgaagacaggaacagggaaaacagttgcctttttgggagcttgcaaaccaattggctgctgaggccaggaagcttctcaagtatcatcgctcactgggtgtgcaggttgtaataggtggcacacggttacctcaagagcaacggagcatgcaagctaacccatgtcagattcttgttgctactcctggaaggctaaaggatcatcttgagaacacgcctggattctccacccgaattagaggtgtcaaggttcttgttctaaatgaggctgaccgcctgttggatatgggatttagaagagacattgagaaaataattactttcatccctaaaga

SEQ ID NO: 19535 - DNA, 331 bp, Zea mays
  unsure at all n locations
  Clone ID: LIB189-028-Q1-E1-C10
ggtcgacgcacgcgtccgaccacgagtccgcccacgcgtccgcncacgcgtccgcncacgcgtccgcncacgcgtccgcaagcgacggcgcttgcacaagatgaaccagctctctctcctccaccacctacatcggctgtctcccggacgcggccatggcctcaccgccgcctcncccaccgtcgtccgagctgggctctcctcctgtgaaccaccaaccccgcagcagcacgcaaaacgcctccttgccatagcgcctcacgaaagcatcgcagcagctagggaggaggaaagccacttgcgtcaaaaactcgctgcagcgggcaataat

SEQ ID NO: 19536 - DNA, 453 bp, Zea mays
  Clone ID: LIB189-028-Q1-E1-C11
ggtgccggtcaagaattagcgggtcgacgcacgcgtccgaggtggagtcctcggacaccatcgacaatgtcaaggccaagatccaggacaaggagggcattccaccggaccagcagcggctcatctttgctggcaagcagctggaggatggccgtacccttgcagattacaacatccagaaggagagcaccctccacttggtgctgcgtctcaggggtggcatgcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaagggtggcatgc

SEQ ID NO: 19537 - DNA, 447 bp, Zea mays
  Clone ID: LIB189-028-Q1-E1-C12
ggtgccggtcaagaattagcgggtcgacgcacgcgtccggtgacgaggaggagctccagaaggagaacatcaagaacgccgcctcctccaccggcaacatcacgttgagcgtcaccaagagcaacccggagaccggcgaggtcatcggcgtcttcgagagcgtgcagccgtccgacaccgacctcggggccaaggcgcccaaggatgtcaagatccagggggtctggtacgctcagctcgagtgattcgagtgtctaactgctaggtgtccgaccgtcctcatggatcttgggaaggtgtacgtaccatggaaaactttggagagcagaggaggaatcgtgtacgtaatgtacttgttaatgcaaattcgggctgtcgcttttttattttcagtttgggtttcttctctttcttgtgttctcaagaactacatcccctgtgcaaaac

SEQ ID NO: 19538 - DNA, 450 bp, Zea mays
  Clone ID: LIB189-028-Q1-E1-C3
cgggtcgagccacgcgtccgactggatgccaagagtggtggtgagttggaatcagcacaagctaagaatcaggcactaagggaagctggtgcagttgtgcctacatcatatgaagctctagagagtgcaattaaggaggtatttgacaaactggttgaggaaggaaaaatttctcctgtgactgaaattacacctcctcccattcccgaggaccttaaaactgcaattaagagtgggaaggtccgagctcctacccacatcatttccaccatctccgatgacagaggtgatgaaccgtgctatgctggtgtgcctatgtctacaattattgaacagggttatggagttggtgatgttatctctcttttgtggttcaagcgcagccttcctcgctattgcactcagtttattgagatatgcatcatgctttgtgcggaccatggtccctgt

SEQ ID NO: 19539 - DNA, 477 bp, Zea mays
  unsure at all n locations
  Clone ID: LIB189-028-Q1-E1-C6
aggtaccagtctagaattcncgggtcgacccacgcatccacccacgcgtccggccacagaaaacatatcttgctgtagcggcatggctgcacgcaactgctggaaaaaaatatatgacatcttgtgttatgctgctacggtgcttctgcagcagcatgaagttttttttcttcttgttaaaataggttttggtgcactcatgaattcatgaagtgtgatcgttttctattgccgttgccacccttgtttcccaggcgagatccatcttcagcttagggttctacagcttggtggcagtgccgtcggtggttgcggtgatgaacgtattttggttctggaagatactcaaggggatggtgaaaaccctttctaggaggaagcacagcgaaaatgggagaacagattagaaggaatgaaggaaggatgctactgaactgtacacatgttcatctcaacgcacttacggcactcgcattc

SEQ ID NO: 19540 - DNA, 407 bp, Zea mays
  unsure at all n locations
  Clone ID: LIB189-028-Q1-E1-C9
gggtcgacgcacgcgtccgaccacgcgtccgactcttttttccctcacccagtcgctttcgcgttcagcgcgagctgagccagccagtgggtcggtcgctggaggcggagccataaaggcgtcagcgacggcagcatgatgagcggcagatcgggcgggagggacgccganggcgagtgggaggttcggcccggcgggatgctggtgcagcgcaaggacggtgaggcggccggccccgtcatcaggatcagggtctcccacggcgccaacttccgcgaggtcgtcgtgccggcgcaagctaccttcggtgagttgaagaggatccttgttcagactactggcttggagcctgagaggcanaggctcttcttccgtgggaaggagaagagtgacagagagttcctgca

SEQ ID NO: 19541 - DNA, 375 bp, Zea mays
  Clone ID: LIB189-028-Q1-E1-D10
ccggtcaagaattagcgggtcgacgcacgcgtccgattgcaatgattcatacaccaagactttgaagaaatttcatggatggcttgccagttctagttttacggtggcaatgaagcttgctcctaatagagagaaatttatggaggtcattagtggaaccggtgacatcaatgcagatattgagaaattttgcacgaccttctctcctttcctcaaagaaaaccacaactttctggcgagcgtcggtcttgatgatctgaaggcttcatagattaatctccatgctgattacaacaaaataagcatgtcttacgaaactcaaagtgttgccgagggtatacctgtttcccgtagccatctcccccttgaaaaact

SEQ ID NO: 19542 - DNA, 154 bp, Zea mays
  Clone ID: LIB189-028-Q1-E1-D12
cggtcaagaattcacgggtcgacgcacgcgtccgaccacgagtcagcacacgcgtccgacgaagcatcacaaagctgtgatcaccgagttcctctcaactctcaaggactagagtccaacgggatctcgaccaaatggttttacactaactcgg

SEQ ID NO: 19543 - DNA, 464 bp, Zea mays
  Clone ID: LIB189-028-Q1-E1-D2
gggtcgagccacgcgtccgaccaaacgtccgggccctaccttcttttttgctaacacctatttgattacaattaactaaaaattcagcaccaatccctcaatggggacatggcatgttggttcaacagtcaggagacttgattcccaggcagatgcagggttcacttcactgcttcggctggagttgtcagttctacagcttcaacatggtttgtcaggtctgccatggggacgcaatgatcgtcaactgctcggcatcctttgctatgctttgtttgtggagctgctgagtggtggtgtttggagaagtcttgaccctgaatatatagctgaatcaaagagtaaggaatcttgtcgagtgggattattggcaagggacaaggtcatgaggacatggatgcagtatgtgcatacatttgatttgagagccctttctctgcttggattgagcacatcctatgcag

SEQ ID NO: 19544 - DNA, 439 bp, Zea mays
  Clone ID: LIB189-028-Q1-E1-D3
cgcgtccgacgggagaaccgaaaatcacgggcgcgagagatcggagcacggcatgtcggaggagcagttcctcgccgtggcgattgaagccgccaagagcgccggcgagattattcgcaagggattctaccagaccaagaacgtcgagcacaagggccaggtggatttggtgacggagacggacaaggcctgcgaggacctcatcttcaaccacctccggaagcacttcccggaccacaagttcatcggggaggaggagtccgcggcgctcggggccaccgctgacctcaccgacgaccccacctggatcgtcgattccctcgacgggaccactaatttcgtccatggtttcccatttgtatgtgtctccgttggcctcaccattgggaaaattcccactgtcggagtcgtcttcaaccccatcatgaacgagcttttc

SEQ ID NO: 19545 - DNA, 301 bp, Zea mays
  Clone ID: LIB189-028-Q1-E1-D6
aattcccgggtcgacccacgcatccacggacaggctggggacggtagcatcgacgtggaggtgtgcctcgcgccagacaccatggcgcatctcctcctcgacaaggagttcttgcagtacgtgtcctcccctgcaccgtgaggcggtgacagagtgaatgtgtggcttgttgctgcgcagctacatatattaacgggatttgtaccctttcaccatttggaaagcacttgatatcggcaatttaacccccttgtacacaaattgtcctacaactaactctaggatatataggtgcatttgg

SEQ ID NO: 19546 - DNA, 270 bp, Zea mays
  Clone ID: LIB189-028-Q1-E1-D9
gggtcgacgcacgcgtccaaaagaaactctttgatcagggatacttggatgagcaattttgtcagattgaggacttgcaggatgaagcaagccctaattttacagaagaagttgtttccctgttcttcaagaactcaaccaggctaatgacaaatattgagcaagctatggacaggaatcccagagatttcagtaaatgggatgtaaacatgcagcatttaaaaggaaccggttcaacaaccggtgcttgcaggatgaaaaacgattgca

SEQ ID NO: 19547 - DNA, 252 bp, Zea mays
  Clone ID: LIB189-028-Q1-E1-E1
gcgtccgacacaactcggcagccacaagaaaccacccccttccggcacacgggctcgaccacctgactccatcaccgtgcctgtctgtgttctagggacaagaatagcacagatatacatgagcgatcagaggtggggagaagaggatgagcaccataacggcgtcttcgctgaaccccatcgcgccgctcttcatcactgcggcgtacctgcaggtgggagacttcacgcccgactggtgggatctcttca

SEQ ID NO: 19548 - DNA, 416 bp, Zea mays
  unsure at all n locations
  Clone ID: LIB189-028-Q1-E1-E10
ggtcaagaattaacgggtcgacgcacgcgtccgaaccccaacttcttctgagcggccggctgcgggcatgttcttgagcctgcctgtattctactccgtgtgtgttgagccatatatctgatgctcaaggattggttaatttgaacaagtggtgcaactgcgcgtgtacatggatttgctcttcctctatgtctctgtcctctgtctccggttactttccctgtttcactatgccatgcacatagacattgccatgttctgctgccagctcagggcttgtgaataacanaaataaaaaaaacaaaaaaaaaaaaaaacaaaaaaaaaaaaaaaaaaaaaaaaaaaanaaaaaaaaaaaagaaaaaataaaacaaaaaaaaaaaaaaaaatcaaaaaaaaagggggggccccccaaa

SEQ ID NO: 19549 - DNA, 423 bp, Zea mays
  Clone ID: LIB189-028-Q1-E1-E11
ccggtcaagaattagcgggtcgacgcacgcgtccggaatttttacaaaagaaaatacttatgatggtgaatccgtcaaaggccttgatgggttcaacatcagaaaagattacctctgccaggtaccaaactttgagttttaaatgataaagctgagaccgggtggttgacttgcacgagaagggagtctcggtgtagtgtctccgtttgagtcgattaaggaccatgtcgatgtaggcttgatgattgaggaccttttaactggtcacatgcctcatcatggataagctttgcctcgggcagactaataccagaaagggcaacacacaatgggagtggagagatggcgagagtagcgtgtaccctccatggtaagaggctggacggtggtgtatctgtgctctcggttggcgtgaacccggtc

SEQ ID NO: 19550 - DNA, 438 bp, Zea mays
  Clone ID: LIB189-028-Q1-E1-E12
ggtcaagaattcacgggtcgacgcacgcgtccgcggacgcgtgggaactggttgagaaaaataactggttacccgaggggcctattaccattggtgttacttcaggtgcctcaactccagataaggttgttgaggatgctcttcagaaggtatttgagatcaagcgtcaggaaattttgcaggttgcataaattttaagcagagatttggtgaagagctgaatagttttggcttggcaaaggttactagaaacgttgcacaggcaaatgtttgtacagtagctaaggatgtaacgagttgggcacgaatactaccacgagtcactatccttgtgctggaatttacagtacggtgaaactaaaatggtgttatcattggtccgaataacatttgcatcagcctttctaacttctaaggtcaactttttgccacttgatg

SEQ ID NO: 19551 - DNA, 283 bp, Zea mays
  Clone ID: LIB189-028-Q1-E1-E2
cacgcgtccgagcaagctgggagtggtggtccagcgccaacattaaaaggatggaaggaccttccgatggagctcctggtgcggataatatccacagttggaaatgataggatggtcatcgtggcttcgggggtttgaaaaggtggccttaaccccctggaatgggggtcaataaaccttcaattaaaaggtgcaaactgagcatgaataatttaatgataactcctgcccacaagttcaccaagttgcaagttctcaatctccggcaaaacaaacctcaact

SEQ ID NO: 19552 - DNA, 427 bp, Zea mays
  unsure at all n locations
  Clone ID: LIB189-028-Q1-E1-E3
cgggtcggcccacgcgtccgaccaagcgtccggcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtcnctttacttctgatgaactctttcaacacccatgatgacacacagaagattgttgagaagtattccaactccaacatcgaaattcatactttcaatcag

SEQ ID NO: 19553 - DNA, 457 bp, Zea mays
  Clone ID: LIB189-028-Q1-E1-E9
gggtcgacgcacgcgtccgaggcggaggcgcgcgaggacccttcttcctcttcctggctcgcgctcggcagcatgtgctccatgcacggccgctgatgagggagccagcggtggttattagtagtgcagacaagagctcgggcgcccgcccggccatgggatgggatggggaggcgttgcagcagcaatttatgtgctacctacgtactagtatttattataattgttattactaacaacaacgactggtagtatcgatcagagaccgacgctattcgatcgttggttcgtttcattgtccttccttgctagctggtggtgtatcgaccatctaaatctaacaggacacgtggacctggacggcaagagatgtccagtccagcagtgtggaacgtttgttgctttgtctatcattaattgctataagtttgtttcatatatacatatatactactgt

SEQ ID NO: 19554 - DNA, 363 bp, Zea mays
  Clone ID: LIB189-028-Q1-E1-F10
cggtcaagaattaccgggtcgacgcacgcgtccaagatcctccgctcaccgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagagttggagctaataactgcatctcaattcggcttgtcgtgccctagacggtattgctgtccaattgca

SEQ ID NO: 19555 - DNA, 407 bp, Zea mays
  unsure at all n locations
  Clone ID: LIB189-028-Q1-E1-F11
cggtcaagaattcacgggtcgacgcacgcgtccgatcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacctggagtcagggccgttcaatctttgccagtggcagtccatttgcccccgtggagtacgaaggaaagacttttgtgcctgngcagtcgaacaatgcctacattttccct

SEQ ID NO: 19556 - DNA, 405 bp, Zea mays
  Clone ID: LIB189-028-Q1-E1-F12
ggtcgaccgacgcgtccgaggacgagtgggcggacgcgtgggaagagcctggaccaacaactcttgctttagggattgatttgacctcgttggggttgaatttgaactcccaagataatctttacaagacatttggctctccgtggtcaagcgagccagctgtaggagaacctgattatcagatcccagcttgtttctctgcagagccaccaccagcgctgcaaccatttcattttcagaagtttcaccctttgacactattctacatcttttacagcatgcctaaagatgccgctcagttatatgctgctaatgaactatacaataaagggtggtttttacacaaagactaccgtgtctggctaacaagagctcctaattccgcacctcttgtgaaaactccac

SEQ ID NO: 19557 - DNA, 434 bp, Zea mays
  unsure at all n locations
  Clone ID: LIB189-028-Q1-E1-F7
gacccacgcatccacagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatantggtgcaaccatggacccaaatggaacaggagacatcgcacggacggcagaactgggaaaacgttcgtctgaactaggtgtaaaacagaaa

SEQ ID NO: 19558 - DNA, 329 bp, Zea mays
  Clone ID: LIB189-028-Q1-E1-F8
gacccacgcatccgcccacgcgtccgcccacgcgtccgcggacgcgtgggcgctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattggccctcacaatactgtacatgagggtcgcatctaccagctgaagttgttttgtgacaaggactatccggagaagccacatctgtcagattccactcaagaaatcaacatgacat

SEQ ID NO: 19559 - DNA, 395 bp, Zea mays
  Clone ID: LIB189-028-Q1-E1-F9
cgcacgcgtccgagttcaaccgtagcccagaaccctggcctgctgcctccttccacagctgcaaccgttactgacagcaccaagatcgcagcagtgccagccgcaccaattgctgtggccaacgcccagaagagtgcagcagatataccgcaggctcccaaggcatctcttcgcaggttccttgagaagagaaaggatcgccttactgcgaaagcaccgtacccgggttccccttcagatgttacacctgtgaagaaggagatgtcggatggtcagccatggcttgggctgggacctcagatcgccaatcctgatctgagcttgtccaaggaggcgagccagtgatcgatgatccagcatcaccatcttcaaaactgcgatactcaacagccatg

SEQ ID NO: 19560 - DNA, 424 bp, Zea mays
  unsure at all n locations
  Clone ID: LIB189-028-Q1-E1-G1
cgggtcgagccacgcgtccgatcgcacactgggagtggagagatggcgggagtagcatgtaccctcctggcatagtagcacgcctggtagggtaatgtgctctcgggtggcgcggacctgttcatgtagtggaggactccgtgggaacggttgacatatgcaagggttaagtgctacatatgtcgtgtggttagagatcccagctgggtataatcggttcgaatcgtcgttgctcctcggttatggagactcatccctgtgaccatcatcgtagttagcaagtgaaatatgagaatgaataaaatggagctagtataggccaagtgcttgaactagatcaggcanatatagattcaggtaataacctaactagtgaaataaaatttggcttaaggatcaactggtancaagcttttctgcaaaa

SEQ ID NO: 19561 - DNA, 433 bp, Zea mays
  Clone ID: LIB189-028-Q1-E1-G10
gtcgacgacgcgtccgacgatttataagaataacattctagatctagaagaaagtataggttcataattgataatataatatcgatgaaagtaaaaaaaacaacatctatgaaatatatataaataaaacgaaataaaatatgcataattaataatataacataaattaaaattattaataaaatatataaaaaagcataaaaagcccgataataggtaaaaaataaaaaagaaaatcacatggatattattttgataatctaaaatatatcatggaatatctcatgggtactttataaacactcaaagctaatcgtgaaacatcatatacatactatgtgagtcgtgagtcctcttaaagtataacgtaaaacatcaaacacacatgttaaacatcaaacacacatatataagccgacgttatttgtcacct

SEQ ID NO: 19562 - DNA, 216 bp, Zea mays
  Clone ID: LIB189-028-Q1-E1-G11
ccgggtcgacccacacgtccaaaacagtacaacctgtgcatattgttgatgttcccggtcatgctatgctcaagcccaagcttgctgaactcctgcctaaagctgctggggttgtccttaatgttggagctcaagatttcttgtccaacatgcaagctgccggaaaataccctttatacattctcacaaaagcatctgtcactaacataaggatcc

SEQ ID NO: 19563 - DNA, 377 bp, Zea mays
  Clone ID: LIB189-028-Q1-E1-G12
attcacgggtcgacgcacgcgtccgaccacgcgtccgcggaggaggtggtggtggtggatatgggggatcatcaggatacggtggtgcctatggtggcggtggcagcggcggcggcggctatggtggtggtcagagtacgagttcttgggactgaactgaactctgattagaagtgaaaaatgggccaaccttttgggcgtgaaaaatgggtcaaccgttatcgattagtccctgttggatggagcgaatgcttgaaatttgttgcttgacatacgattaatcttgcgttgtgttgtgctaagggattggcttatgttattatctggattggtgttttttctacgcctcaagcttgtgctgtcccctttcacaaaaa

SEQ ID NO: 19564 - DNA, 414 bp, Zea mays
  unsure at all n locations
  Clone ID: LIB189-028-Q1-E1-G2
gggtcgaggcacgcgtccgaggaaacataaggcattggctgcacatgtcattttttcccgagggtaacaaatgtggcccccagttttaccctgaagcaccggaaactgagtgatgcttgtggccattgtacgccacctgatgcttgtccgatccttcagactgaagcccacacttgacatagtgatgcttgctacacttttgttgtcgatatgcttcttctgccaacaacataagcaattctttcttctccgattatctgcggacccgatttctatgcgctcgaaccattgaactgagtggggactgtggagccattttgtgatgaacagttctaatatccagtataaaagtacgttgtaacatatgccagattaccatagcgatcgaaatctcctangagatgacagtttttg

SEQ ID NO: 19565 - DNA, 447 bp, Zea mays
  unsure at all n locations
  Clone ID: LIB189-028-Q1-E1-G6
acaagaagaatgtgattgtggccattacctctgataagggactctgtggtggtattaattcaacatcagtgaaagttagcagggcccttcacaaattgacatctggtccagaaaaagaaaccaagtatgttatattaggagaaaagggcaaagttcagctgttgcgtgactcaaaggacagcattgaaatgactgcaactgaactgcagaagaaccctatcaactacacacaggttgccgtgctcgcggatgacatattgaaaaatgtggaatatgatgctctgagggttattttcaacaagttccaatctgtcatatcgtttaagcccacaatggtaacaatactttcccccgaggttgcagaaaaagaatcagaagctggtgggaagatgggtgacctagaatcttatgagattgaaggcggcgagacanaatcagagattttgc

SEQ ID NO: 19566 - DNA, 420 bp, Zea mays
  Clone ID: LIB189-028-Q1-E1-G8
cgggtcgacccacgacgtccgcccacgcgtccgcttcgggcccaactccaccaccttcatcgtgccggcggagatcttcccagcaaggctgcggtccacctgccacggtatttcttcagctgcaggaaagtgtggcgccattgtcgggtcatttgggttcctgtacgcggcgcagagcacggatcccaccaagacggactccgggtacccgccgggcatcggagtgcgcaactcgctgttcatgctcaccggatgcaatgttatcggtttcctgttcacgttcctggtgccggagtccaagggaaaatcgctggaagagctctccggcgagaacgacgaggaggcagcaccgcagcaacagcagaccgtgccgacagatttgagtgaataaaacagagaaacagtacactcctactacta

SEQ ID NO: 19567 - DNA, 342 bp, Zea mays
  unsure at all n locations
  Clone ID: LIB189-028-Q1-E1-H11
ggtcgacgcacgcgtccaaggacgagtgggcggacgcgtgggcggacgcgtggggcaccccactgctccagccctttctaccgcccactccacctccttcccttaacccctcacacagtgatagacttactgttacaagggatatagtcaaagacgctctacagagacttgttcagagcgacgagttcgttgatctggtgtgccgggaattgcagagatcacttgtatacgctgcttgcttagtcctgtcgggagttttctggctcgtggcaagaatgtgcctgtaattttcctttgacttttttgcatgcttcncttcccgtactattgtataggtttgtg

SEQ ID NO: 19568 - DNA, 406 bp, Zea mays
  Clone ID: LIB189-028-Q1-E1-H3
cgggtcggcccacgcgtccgaggaagcgtgggcaaaactattttggttgaacagaagattgactacagcatcatgggaggattagtgattgaattcgggcagaaggtgcttgatatctcaatcaggaacagggcgaagcaaatggaggcgttcttgaggcaaccacttgacttctaacagccttttggataaaagaagcatcatcggaatgcagaggctgtcctgttgaaggttttcctgtgtctgcaattttaatctggccttttgaataaaatgtttcctctaacaagtgaagggcactgtttttattgtctcgtgggccacagatgcctgctgaacaatttatgttcatttcttcttttcttaaagaagcatgcactaagaacatgaaggatgcatgccatgg

SEQ ID NO: 19569 - DNA, 359 bp, Zea mays
  Clone ID: LIB189-028-Q1-E1-H8
ggtcgacccacgagtccacccacgcgtccgccgggaaggagctcctgcaggccacgcgcgagggcggccggctcaggctgcagttcgccaacgctgccgcagcagccgcaggtggtgtgggtgtcgtcgacaaggcggtgcacggaggtgacgacgatggcgacccccgtggcaagaacgcatgcatatacgacgacgaccacgatgacgagcgctaggtgatcgtcggggttcgttgatgtactttggatactttaacaacattcaataatggccctaaaaaaaagggttcccgcaatgcggccaccggctaaaaaaaaaaaaagggggggccccccaaagggttcaagcttaatttc

SEQ ID NO: 19570 - DNA, 199 bp, Zea mays
  Clone ID: LIB189-028-Q1-E1-H9
tgttattttttatgttctttttattgtttttatttttttttttatttgttatttttttttttgaaaaaggtatatcccaatccatccatgtgtaaagcccatggattactattttccacggggccgattagcggtcggttgaatattgccaacggtggctgtccctgtcatcaagagtgtttaaaaggaggatttttct

SEQ ID NO: 19571 - DNA, 352 bp, Zea mays
  Clone ID: LIB189-029-Q1-E1-A1
agttatatatatgagttgtatgcagtcaccgaactggtacaggcttccgctttccatttcctgttgggagtcgtgtagtgtaatcctggggtgtgtatttgtttcatcaatcatgccagccgatttgaatctcgtttcaccagcatgatctgatttgggtatacaagtataaaccgcaacgagcgatcttgtaaaaaaaaaaaaaaaaaaaaaaaaaaaaaaaaaaaaaaaaaacaaaaaaaaaaaaaaaaataaaaaaaaaagaaagaaacaagaacaaaggaaaaaaaaaaaaaaaagggggggcgccccaaaaggttccaagcttacttacgcgtgaatgcaacttcaa

SEQ ID NO: 19572 - DNA, 443 bp, Zea mays
  Clone ID: LIB189-029-Q1-E1-A11
ccgggccgacccacgcgtccaagacagtatggacatgtgtggacatggtcactggttaagtagcaatgggaagatcgtccacatcaatcgggtaactggtgaagcacaagcacgtagtgaaggtgtagcggaagtaatcttcaaaggttcaaattttaagctgcaaacaactatcactgttctcaaggtgaaccagatagttgttgatgctcctgcggagacactgactaatgcagctggcctgccggatggatacatgttttctgtgagatttagtgattcaattgagcacagtattggatcctctgcgagcccaattaatgtcccctttgaatgcaaggttgacccttcttttgttgggtttgttgagccatggactgagcatgccacaaagaaatcctactgcctgtttcatccatattcacctgcacaactgttgcccg

SEQ ID NO: 19573 - DNA, 454 bp, Zea mays
  Clone ID: LIB189-029-Q1-E1-A2
gggtcgacgcacgcgtccgaccacgacgtccggttttttgaatattatatcaacaaatattattaacatgggcacctactgctacaaaaaactgtatagttcttttccaccacgctattcacgtttcttgctattaagtgcttacagaaaatactgtggttttcttacctccatacatggtaaggtcatgttaactctaaatacctaaattttttaatttatacatttcgaattaatctttgttgttatttataatacggaatttagttagaatagaaatttcttaatgaagtacatctagcacgaatttgtttctacatttctactaaagcaggaaatggcactactctacttcgcagcctaagacctcaagatatgttggcaaccatcaaagtacatgtttcaagaaaatgagaattctagggaaatacagacaccaaacccatattacaca

SEQ ID NO: 19574 - DNA, 435 bp, Zea mays
  unsure at all n locations
  Clone ID: LIB189-029-Q1-E1-A6
ggtacaggtctagaattcccgggccgacccacgcgtccacggacgcgtgggcggacgcgtgggcagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcanatactac

SEQ ID NO: 19575 - DNA, 458 bp, Zea mays
  Clone ID: LIB189-029-Q1-E1-B10
ggtaaaggtctagaattcccgggccgacccacgcgtccacccacgcgtccgcccacgcgtccgcaccaagggccgaactcaaccaaccatcggccccatttgaagccccatgaatgaaggaaatgaaggaaaaaaagaaagaaacgcagttgtttctcagagtagttgaatgtctggagggaggctgcaatatagctgtctgctaactaagggcttcgttctccaagagaaataggcagacgctgtctaatcaatcatgggcatgtacatatgtgcatcattttatacagaaattttatatgtatctaatcaatgctggtttgcggtcatctggtcctttttggcgcatcacttgctcaccttatcccaatttagggctgatttgttaacaatagaattagatgggatacatgagaggaaatccattactatttaaaattaaataacaagggattttc

SEQ ID NO: 19576 - DNA, 437 bp, Zea mays
  Clone ID: LIB189-029-Q1-E1-B11
gtcaggaattcccgggccgacccacgcgtccaccccgccgccgccgccccccgtcgccccggctcccgcgcgcatcggtctggccctccccgtctcgtctcccccgctccgctgccgcaggtctattgtcccttccagaaacctggctgccagaagggagccgaggggaggaccatctactgcaaagcccacggtggcggcaggcggtgccagtacctgggatgcacgaagagcgccgaaggtcgcaccgaccactgcatagcccacggcggcgggcggcgctgcagccaggacggctgctcgcgcgccgcgcgcgggaggtccggcctgtgcatcaagcacggcggcggcaagcggtgccagagggagagctgcaggaggagcgcggaggggcactcgggcctctgcatctcgcacggcggcgggaagcggtgcca

SEQ ID NO: 19577 - DNA, 397 bp, Zea mays
  Clone ID: LIB189-029-Q1-E1-B2
gggtcgacgcacgcgtccgcggacacgtgggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacaacctaaaagaaggaggctttgccatgatgggtgcgctcgcatggcaggccaggcaataataaaaagatgattattgcgtgccgggggaggagatcgcacgggggttgatgtttttggccccgggttctcctccctcatcttgttccgtgttcctgtatgcgttgcttccgc

SEQ ID NO: 19578 - DNA, 420 bp, Zea mays
  unsure at all n locations
  Clone ID: LIB189-029-Q1-E1-B4
gggtcgacgcacgcgtccgagcagcacactcagctatccagcaaaagagatcgagacgcaggagtcatggccaccgtcagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgngggtcttcggcctcatctggtccctctacaacatctacacctctgac

SEQ ID NO: 19579 - DNA, 430 bp, Zea mays
  Clone ID: LIB189-029-Q1-E1-B5
cgggtcgacccacacgtccaatttgtttatactgttattttttttggttggaggatatctcatgtgcatgaaactgatataggctagtaatttactattatttgtagtgtctgattttattcttttgtgccaggagcttagattgctgataattgtcagtagcttttctagtattaattactgaaagaattgttaaagttgcttgacaaagcactttattctgagtttggtaaacaacttattttctaggcactacacgttatgacttattagaatcggatttaaaagagaattctcactattactaattggttggtgtatttgagataaggcggttgtcagacattgatctatttgatagggttctaggggctgtgtgcaaatactcaacggcttaacctagttttaagaggaaattttgaaagtgtag

SEQ ID NO: 19580 - DNA, 398 bp, Zea mays
  Clone ID: LIB189-029-Q1-E1-B7
aattcccgggccgacccacgacgtccgagtcctgcagccccgcaatagagcatcgtacttcatcgttccacttacatcgtttgttcgttcgttcttccgcgtgatctgcttgggagttgggggcaatggaggcctacgtcctgttcgcgcgcgccaaggagcaggaggaggacatcggctgcccgtccgagtcgtccgcggcgcgttccacgtcctcgtcgtcggacggggtggacctcgccgacgacgccagctcgtccgggtccacctgccacttcgagatggcctccctcatgacgcacctcccgatcaagaggggcctgtccaagttcttcgccggcaagtcgcagtcgttcgcgtcgctggcggccgtgggcggcatcgatgacctgcccaag

SEQ ID NO: 19581 - DNA, 288 bp, Zea mays
  Clone ID: LIB189-029-Q1-E1-B8
acccacgagtccaatcctgcagccccgcaatagagcatcgtacttcatcgttccacttacatcgtttgttcgttcgttcttccgcgtgatctgcttgggagttgggggcaatggaggcctacgtcctgttcgcgcgcgccaaggagcaggaggaggacatcggctgcccgtccgagtcgtccgcggcgcgttccacgtcctcgtcgtcggacggggtggacctcgccgacgacgccagctcgtccggggtcacctgccacttcgagatggcctccctcatgaatcacc

SEQ ID NO: 19582 - DNA, 421 bp, Zea mays
  Clone ID: LIB189-029-Q1-E1-C11
cccgggtcgacccacgacgtccgaccacgcgtccgcccacgcgtccgcccacgcgtccgctagtgttggagagaagagaatacactacactacgcatggcaaaccagcaccagggccagggcatggcggcattggccctggtgctgctggtgctggcggcggcggcggccaaaacggcttcggcggtttcttgcaaccccgggcacctggcggcttcccccccggcattaatggccggcccagacccttccgcttcttgcggctccaacctcaaggcccaacaggggtgcttctgccatttcgtgaaaaaccccacctacgggcgctacatcaacagccccaacgcgcgcaaggtcgtcgcctcctgcggcgtctccgtgccgcgctgctagtactagtacgtgtgctgtgcatgcatgca

SEQ ID NO: 19583 - DNA, 478 bp, Zea mays
  unsure at all n locations
  Clone ID: LIB189-029-Q1-E1-C12
ggtaatcggtcagaattcccgggccgacccacgcgtccagcatcgcaatcggcaacacgccgggcgttctgacggagacgacggctgagctcgccgcctccctctcgctggcggcagccaggaggatcgtcgaggctgaccagttcatgagggctggcctctatgacggatggctcccacacctgttcgttggcaacctgctcaagggccaaactgttggagtcattggagctggtcgcattggctccgcctatgcacgcatgatgattgagggtttcaagatgaacctcatctactacgacctgtatcaggccacacgtcttgagaatttcgtcacagcatatgggcagttcctcaaagcaaacggtgaggagcctgtcacctgnaagagggccgccaccatggaggatgtcctcagggaagctgacgtgataagtctgcatccggtgctggacaagacacctaccatctgataaac

SEQ ID NO: 19584 - DNA, 357 bp, Zea mays
  unsure at all n locations
  Clone ID: LIB189-029-Q1-E1-C4
gggtcgacgcacgcgtccgatcaacgggtcaatccgtgtgacggtgcagggcgaggtcatcgagttctgcttcggggaggagcacctgtgcttccagactctgcagcgcttcacggccgccacgctggagcacggcatgcacccgccggtctctccaaaccccgagtggcgcaagctcatggacgagatggccgtcgtgggcacggaggagtaccgctcggtcgtcgtcaaggagccgcgcttcgtcgagtacttcagatcggctacaccgggagaacgatttccggaaggatgaacatcngcagccggccaagcaaagaggaggcccggcggcggcatcacgaccctgcgcgccat

SEQ ID NO: 19585 - DNA, 423 bp, Zea mays
  Clone ID: LIB189-029-Q1-E1-C7
aattcccgggccgacccacgcgtccacccacgcgtccgcccacgcgtccgcccacgcgtccgcccacgcgtccgctgcgctccagctcccctccatcctcggccaaaaattctgcggcgagctccgatccggtgcgactactaacccacgccgcagaagccgcgcgtcctgatcgcgcgggggtcgaggagaggggaagcgcggcgccgcggttgcctgccaccgcaccgccgcaggagaaggaagaggagcccgtatccctccgccccgctgcccgccggaccgatggactccgagcactggatctcgcgcctggccgccgcgaagcgcttctacgcggcgcagctcggccacagcgatcgggccgggatggatgagctggagatggacgaggaggtcaggcccgagttcccctgcccctac

SEQ ID NO: 19586 - DNA, 341 bp, Zea mays
  Clone ID: LIB189-029-Q1-E1-C8
ccaggtacaggtccagaattcccgggccgacccacgcgtccaatggcttcctccatctccgccgccgctaaggcctccgcggccttcgcccacaagaaggagctggccgcgccggcgccgcaccgcgcgggctcgagccgccggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcc

SEQ ID NO: 19587 - DNA, 457 bp, Zea mays
  Clone ID: LIB189-029-Q1-E1-C9
ttcccgggtcgacccacacgtccacccacgcgtccgcccacgcgtccgcggacgcgtgggtgcaaaagcactgaatctcagggtaaggaagaaggacaatggtgttgtcaagattcaggggaggaaggtggggaggaagggtgtcctggagttcgacactgaaatatttgagatcacggcatcctaccacctcatcgagatgaaacaaacgggcggtgattcacttgagtacaagaaactgttggaagaggacatccggccagcactgaaggacatagtctgggcctggcatggagatgaccagcaacaaaagtagtagctttggatctctcttttttgttccataaaattgttagatctttcacttcagattgattttgttcgacatgtgcgtgttcttcttactagttacattctttctgtttctgtggaccattggactgtattctgtcgtgca

SEQ ID NO: 19588 - DNA, 402 bp, Zea mays
  Clone ID: LIB189-029-Q1-E1-D2
gcgtccgatcctatttctccactccgcttttgcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtaacggaccgagcatcacgagaacacttgagaggtaaaaaaaaaacagttatgcaggcccagatactgctgtacagaacaaagag

SEQ ID NO: 19589 - DNA, 439 bp, Zea mays
  Clone ID: LIB189-029-Q1-E1-D5
gacccacgagtccacccacgcgtccgcccacgcgtccgcccacgcgtccggtcttcggacgctgcctccgcgccacacagaaaggaaaaagtatctctctctcccgcgcgcgcgggtgagccggggaccctcctacgtctcgccaccctgctggtatagcccgccggtcgtccacgccatggccacccaatatgcgcggctctccctgccatgccgcctgccctcgccgctccctccgccggtgccgacgacgacccgccggctgccgcgcgccgcggcggcggcggcgtccacctccccgcggtgcccacgcgtcgggggcgcggcggccacgcgcgcccgcggcccgtgccggcctcgcgcctccgagggcgaagtgcatcagcaagaggcggaagcggaacaggttgtggacagcaacatgctgccctactgcagc

SEQ ID NO: 19590 - DNA, 421 bp, Zea mays
  Clone ID: LIB189-029-Q1-E1-D7
aattcccgggccgacccacgcgtccaggaggcgctgacaatgtaaatcagtgttttcttgaagcagcgcgctttggaagtactgaacttgtacgcattctgctgaaggtcgcatatcagaatagcttggctgtggacaccgatctggctctggtgtatgcctcacattactgcaagttcaaaacaatggaatgcctagttgatgaagggaacgtgagttctttccttggccctctgataaaagctgcagagcgtgggtgcttgcaggttgtccactggttcgtcagtcgaggcgtctctgacattgagatgtgccttgccctgacgactgctgcctccagcggccatttcgtagtggcgtcgtacatgcttgcacatatccctcagcaaatccttgaagctctcagcacacagattctcaa

SEQ ID NO: 19591 - DNA, 415 bp, Zea mays
  Clone ID: LIB189-029-Q1-E1-D9
tccgggtcgacccacgacgtccgaaaaaaaaaaaaaaaaaaaaaaaaaaaaaaaaaaaaaaaaagaaaagggcggaagcactataggttctaagtttacgtacacgcgaagggcggcctcccaacacgtctgaaacctaaattcaacttccaggcaatgtccttcctcttccatcgtggcgactgagttcactcttccggccgtcgttttaaacgctttgaaccggaaaacccttgcggtagccgacgttatcccccttgcgccaaatcccctttccctcacctgcagttacgcagcctgggcccgcaccggtacccctcccgaacatttgcacaacccgaatggggagtggaacctaccctgaacctgaccattacacgtgccagatcccgagctcccgcccatttcgcccgct

SEQ ID NO: 19592 - DNA, 445 bp, Zea mays
  unsure at all n locations
  Clone ID: LIB189-029-Q1-E1-E10
cccgggtcgacccacacgtccagaacacgccgctgtctcgaccccttgtcctcctccttcagcaagatggcggagattgagataaaaacagcacctgctgacttccgcttccctacaacaaaccaaacaaggcattgttttactcgctatgtcgagtaccacaggtgtttgaatgccaaaggggatgatgctggtgtttgcgaaaaatttgccaagtactacaggtccctttgccctggagaatgggttgagaaatggaacgagcagagggagcatgggacgtttccaggacctctctgaatgtaccgcccgagacctccagttggaccagtcaacaagttggccaggcagtcctactgttccattctgcattcctacttccagaatcgtaaatgccttttgtcncttgctcttcaaccaagtcacacaaaactgttagtgatgc

SEQ ID NO: 19593 - DNA, 208 bp, Zea mays
  Clone ID: LIB189-029-Q1-E1-E2
gggtcgacgcacgcgtccgagtttcgcgcgtggacgccaccgtcctccatcccatcatcgccgcgggccatatcccggttatcgccaccgttgccgccgacgagactgggcaagcctataacatcaatgctgatacggcggctggcgagattgccgctgccgtgggcgccgagaagctgctgttgctcacagatgtgtctggcatttt

SEQ ID NO: 19594 - DNA, 376 bp, Zea mays
  unsure at all n locations
  Clone ID: LIB189-029-Q1-E1-E6
ttccgggtcgacccacgacgtccagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggttccggccgccatcncgctggcgcccatggcggccggg

SEQ ID NO: 19595 - DNA, 444 bp, Zea mays
  Clone ID: LIB189-029-Q1-E1-E8
ggtacaggtccagaatgcccgggccgacccacacgtccagagaaggttgtggtgtctgaccgtgtcgtggactcaccgtgctgccttgtcactggtgagtatggctggacagccaacatggagaggatcatgaaggcgcaggccctgagggactctagcatgtcggggtacatgtcgagcaaaaagactatggaaatcaacccggagaacccaatcatggatgagctccgtaagcgcgccgaggctgacaggaatgacaagtcagtcaaggatcttgtgatgttgctgttcgagacagctctcctgacctccggcttcagcctggatgaccccaacacctttggcacccggattcatcgcatgctcaagctcggtctgagcatcgatgaggacgagtctgctgaggccgaagctgagatgcctccgctggaagatgacgccggc

SEQ ID NO: 19596 - DNA, 455 bp, Zea mays
  Clone ID: LIB189-029-Q1-E1-E9
cccgggtcgacccacacgtccacccacgcgtccggtgagagagaggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttggggacctgtgtta

SEQ ID NO: 19597 - DNA, 449 bp, Zea mays
  Clone ID: LIB189-029-Q1-E1-F8
ttcccgggtcgacccacgagtccacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggt

SEQ ID NO: 19598 - DNA, 422 bp, Zea mays
  Clone ID: LIB189-029-Q1-E1-F9
cccgggccgacccacgcgtccacgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgt

SEQ ID NO: 19599 - DNA, 403 bp, Zea mays
  Clone ID: LIB189-029-Q1-E1-G1
cgggtcgagccacgcgtccgaaagtacatggagagcggcggcggtggcggcgtgagggaccaccaccaggacggcggccggtactcgctgttcgcgccggggccgtacgggcagttcaccacggagcccttcgcgttcgctgggaacggcggggtgtcgctgacgctcggcctcccgcacggcgccggaggcagcgccgagcagaccgcgtcgttcctcatgggcagcaccacggccggcgacagcggcagccacggcgccgccaccagctacgacatgaacatgcagagcaccaagtcgttcgcggcgcagctcatgagggacttcgtggcctagctcccttaggacgcatagcatagcagtcgtccacgcaattaatcaaatcatctctccatcgatcaat

SEQ ID NO: 19600 - DNA, 95 bp, Zea mays
  Clone ID: LIB189-029-Q1-E1-G3
gggtcgagccacgcgtccgaggacacgtgggaaaaaaaaaaaaaaaaaaaataataaaaaaacaacaaaaaaaaaaaaaaaaaagatcaaaataa

SEQ ID NO: 19601 - DNA, 317 bp, Zea mays
  Clone ID: LIB189-029-Q1-E1-G6
aattcccgggccgacccacgacgtcaacccacgcgtccgcccacgcgtccgcggacgcgtgggcgcacggagtgaacaaggctgagcgtcgcctcattccgacttccgatccccaacggaaagcggagccaggaccgggagctggaccatttgcctcccccttcgtcccgttaaacgggccttaaatttccccctacacacataccgggagataaatctctcacaaccaacgtttgaaaaaaccatttgtaactaaatttttcaaaaagccacttgagaactaccattacatggctgttatatttgggaatcatcat

SEQ ID NO: 19602 - DNA, 466 bp, Zea mays
  unsure at all n locations
  Clone ID: LIB189-029-Q1-E1-G7
aggtataggtccagaattcccgggccgacccacgcgtccagcgctgtccgctagaccccgcccgaatcaatggagattagggctccgccgacgagcctgaggctcgcgccgccgcccgcctccgccagcttccgccgaaccccgcttaggacctccttccttcgcggcagcgtgtcacttaaagttgtgcaagtacggcagtcaaatgtcaacagatttaagtgcaatagcatacgaagtaacctctttgataggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaatanatctaaagctgcagaacaagcttctgctgattggtatcggagggctcaac

SEQ ID NO: 19603 - DNA, 422 bp, Zea mays
  Clone ID: LIB189-029-Q1-E1-H1
gggtcgacgcacgcgtccgagcacaacatcgttgatgccacctcagaggaagaatcccagatgagttctgcagtgtcggtgtcagtcaacaggcatggccagatatgcgggcttaccaagaggggaagggcacggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaatttggttccatttttatgttattattagtagtagtaaacaccgaggatttggattctgggaacgaacgacgtcgtgttggctttggctg

SEQ ID NO: 19604 - DNA, 276 bp, Zea mays
  Clone ID: LIB189-029-Q1-E1-H10
ccgggccgacccacgcgtccacccacgcgtccgcccacgcgtccgcccacgcgtcgggcttccgggctccggcttcttctcctcgccgtcgcgtgagactgcgctaaagcctaggctttgagacaccaatggcctccgcgacggcgacggcgcccacattcgctctcgcatcgtcattctcgcgcggcggtttccttcggcaccttcttcgggccggccggccaagccttaatcccctgcggtccttcccttaacccttaaaccgcgggcccgcgc

SEQ ID NO: 19605 - DNA, 426 bp, Zea mays
  unsure at all n locations
  Clone ID: LIB189-029-Q1-E1-H12
gggtcgacccaaacgtccgcggacgcgtgggcggacgcgtgggatcacattgagtagcaagtaatgtgttccaataatatgtagacatttgagacaaatctgcattattattactaacaaaaactaagacagcaacatcaacacacccaacaacagttcaattcacccaaccacctcctctccctgctctttgatgtcgccctcgcttcttcctccccgaccggccatcagttccgacgactgcttccttcgtttgtccctgcagccagctgtttccaccgttcccagggcaatggtcgcggtccccgcctcgttcgactactcacctgccgtttccaccggttggcaggccgccccatgacccataccagtagaaaattaacgaagctaatgggtacagacacangacagttctaaaatgggact

SEQ ID NO: 19606 - DNA, 364 bp, Zea mays
  Clone ID: LIB189-030-Q1-E1-A11
gtcgacgacgcgtccgaacaccgaccgtctccaacggcgacaactgcgtctccatcggcgcaggcaccctcaacatgcacttcaaaaacttcacctgcgggcccggcggccacggaatcagcattggaaccctgggcaaccagggctcccggccttccttggccaacttcacggtgcgcaaccccttgatccgccactccaacaacggcttccggatcaagacttggcagggcggctccggcgccgtctcctccgtgtccttccagaacgtgcgcatggacgcggtgcggaaccccatcatcatcgaccagtactactgcctctccaagagctgcgagaacgccacctcggccgtcttcgtctc

SEQ ID NO: 19607 - DNA, 319 bp, Zea mays
  Clone ID: LIB189-030-Q1-E1-A4
gggtcgacgcacgcgtccgaccatagccaccaccactccctgctgcctgctgcctgtccttggaaactccttcaatggaaaaggggtgatccatttattggcctgcattacagcttgaccgctgggcactgcttgctcctacggcaactacaatgcctctgctctggaccatcatccgttgagagcaaggcatgcgtcacacatgttcaacctcgccatcagcgatgcgtgtctcgtaacagaatcagagcaagcatcatgcagcagcagcagcagccaggactagagggcgccgtcatgaagccatcagagcctgctg

SEQ ID NO: 19608 - DNA, 382 bp, Zea mays
  Clone ID: LIB189-030-Q1-E1-A5
cacgcgtccgaggacgcgtgggcggacgcgtgggcgccgcatagaataattctggcgaggatgacgagctcctttctgaactaaaagataagtgggatgcaatggagaacaagtcctctcttgccttgtatggtgctggagcaatcctcgctgtctggatatccttggttgtagtgagatctctcgactctgtcccgttgctctcatgcatattggagctagtcgggctcagctaatctggatggtttgtgtatcgatacctgctttttcaggaaaatcggaaagaattggccggtgttatccatgatataaatagaaggattgttggcgatgatgaataactgtttcctggtttggtactccaattaacccgccctgtttg

SEQ ID NO: 19609 - DNA, 149 bp, Zea mays
  Clone ID: LIB189-030-Q1-E1-B11
cgggtcgacgcacgcgtccgatccttcaaggagatcgcggagaggatcggagttgaggtgtagcaagttgtttctcctcggtcggcgccacttaccccgggcgtcttgtacatattcccaagagaaataacaagagcatcagtttctcc

SEQ ID NO: 19610 - DNA, 448 bp, Zea mays
  Clone ID: LIB189-030-Q1-E1-B12
gggtcgacgcacgcgtccgcacacgagtccgcccacgcgtccgcccacgcgtccgcatcaatcatcattcatcttagtagtataggcaccaaatcaaatctgcaacatcaattatctaactccaaaaaccatgaagctggtgcttgtggttcttgctttcattgctttagtatcaagtgtttcttgtacacagacaggcggctgcagctgttggtcaacaacaaagccatgagcagcaacatcatccacaacaacatcatccacaaaaacaacaacatcaaccaccaccacaacatcaccagcagcagcaacaccaacaacaacaagttcacatgcaaccacaaaaacatcagcaacaacaagaagttcatgttcaacaacaacaacaacaaccgcagcaaacacaacaacaacatcaacaaccccaacaccgccaaaacctttacct

SEQ ID NO: 19611 - DNA, 344 bp, Zea mays
  Clone ID: LIB189-030-Q1-E1-B9
gggtccacccacgcgtccgaccacgcgtccgattcacacctaagcatcccagcttgaggaagggttcttgggctgatgttaaatacaaaggtgagtggatgaaaaggccaatctcagaggctgaagtagcctggcttgcaaggattctgatccggctctctgactggttgaatgacgccctggggcttgagtgtgctgatgctgaaggtagtcctgctggcgccacctacattcagtttgatgggaacacgacggtgggcgggccaagggatgctgcgagaatggctctcggtgctgtatgttcattcatggtgctagtggggcaagcggtactgaagttgatg

SEQ ID NO: 19612 - DNA, 189 bp, Zea mays
  Clone ID: LIB189-030-Q1-E1-C1
aattcaaaatcgcaaaaaaccgcactataatatacaagcttaattaagattgaattaaacatcataatacttataaacaaataaccaaaattaaattaaatgaaattagtttaaaaaaaaccagaattagaaaaaccatgatcataaaaaaaaaaacactaataaaggaaaaatcattttaaaagaaaa

SEQ ID NO: 19613 - DNA, 365 bp, Zea mays
  Clone ID: LIB189-030-Q1-E1-C11
ggtcgacgcacgcgtccgcagacgagtgggcggacgcgtgggagcgtttactcctaactagtttgccgatcgacccgggcgacgtgagatacgagcggcgtcgaccggggcccggggagccctccgaagccgcagccgccgatcggggtttccttcctaaccggaagcggaaaatgacccaagacaagaaaacggaggcaccaacgggcagcacgccgccgaacttaattggaggtggagccgaaaccccggggcccgccggctgaccgaaccgcatcctgtcctcccctgtcgcggaggtccgtcgccgcgcacccctggcacgacctcgagatcggtcctgaagctccggccgtcttcaacgt

SEQ ID NO: 19614 - DNA, 450 bp, Zea mays
  Clone ID: LIB189-030-Q1-E1-C3
gggtcgacgcacgcgtccgagataatgtgcacagcagtgcaagagataaagtacccggaaaaagtgattcatatatgaaagggaaacatgcaaatgggtgagtacatctgttgcattggtctgtttttttgttgatttgtaaatctggtgacgaaaatgttcacgttatttgggactttttgagtattaaccctgctattcttcattctgatagtgaaacaagcagtgctcggtcgtcagagtcattggcttatcggttgatgacacccctacccaacttgggaaccaatagtttgtcacctccacctttgagttcggcctccagttctggctctgcagcacatacaccgaacagtatgcatttttcagtcccataccatcagcctagtcctttgccaaagcctaacgggaaggaagcaataaatttggtttcgcattgaataacagcat

SEQ ID NO: 19615 - DNA, 433 bp, Zea mays
  Clone ID: LIB189-030-Q1-E1-D10
cggtcaaaaattaccgggtccacgcacgcgtccggaccaaatcctgatgaaagtgatccctgggatgaccgtcgacaacgcgttgaacatcatgcaggaggcgcatgtgaatgggttgtcagtggtgattgtctgttcccagtccgaggctgaggagcactgcacgtcactcaggggcaacggcctccgaagctcgatcgagcctgcgagtggtggctgctaaggttctagaaatgggtgtatcttgttttgccaagtatagtttgtaaatacccagcatatcaatctaagctgaaactgaaacgggttggttacatgcagttatcgatacaacgaagctaagtacctcttgggtaggtgtaaatcttgtaagggtaacctgtagaagaagaaacatagtaattttgggtaatgatttatgaaccatttagtt

SEQ ID NO: 19616 - DNA, 417 bp, Zea mays
  Clone ID: LIB189-030-Q1-E1-D3
gggtcgacgcacgcgtccgagcgactcaccgagcgagagcagcacacacgcagctagctaggagcatcagcagcggcagcagcaatggcggcctccatgatcgcctcgtcagttctggcggtggcgcctcagggcgtgccgcacctcgggcgccgcgcctcctccttcgccgtcgtctgctccatcatcagcatcaagaccgacatgccctacgggattgcgggtggcctgaccgtcgacgtcaacgtcaacgggagaaacggcaagggcaagggcgtgtaccagttcgtctacaagtacggcgcgaacttcgacggatacatcccaatctacaacgaggatgactggtctcccaacggcgacgtctacgtcggtgtgaacactgggcttctgatctgggctctcatcctcgctggg

SEQ ID NO: 19617 - DNA, 405 bp, Zea mays
  unsure at all n locations
  Clone ID: LIB189-030-Q1-E1-D9
cggtcctaaattcacgggtccacgcacgcgtccgcaaacagaagctctgctcggctatcccttcgatttcaccacggcaggtgcggaagaacaagacgagcagcagctccacgaacatcgcgacaatctctcgacttctgcacgagcagccgctatgcctttggcacaattgcctgacgccgatcaacaccgggagattgtagataacctacgtaagagcagcacggcatactacacgctccagcagattgttcgcctgttggttctcttccgtgaatggcgtgaagaggaacaaacacttattcaaattcgtgcagaacgcaaggaaagaaggcgcatctgccanacacaagcctgacactcaacgcacgaaggcgcttctagactcaatatccaatgtcttcg

SEQ ID NO: 19618 - DNA, 449 bp, Zea mays
  Clone ID: LIB189-030-Q1-E1-E1
gggtcgacgcacgcgtccgaccacgacgtccggctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacg

SEQ ID NO: 19619 - DNA, 418 bp, Zea mays
  Clone ID: LIB189-030-Q1-E1-E10
ccggtcgtaattcacgggtccacgcacgcgtccggggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagccgccggcggtgggtacggtggtggc

SEQ ID NO: 19620 - DNA, 341 bp, Zea mays
  Clone ID: LIB189-030-Q1-E1-E11
gtcgacgcacgcgtccgaggacacgtgggcggacgcgtgggccacgaaggagaacatccggatggcgatgcactggctggtgcagggctgcagctacggcaactccctggtgttccacttctcgggcatcggcgcccaggtggcggacgacgacggcgacaaggcggacgggtacaacaaggccatctgcccgctggacgcgttccagaccgggcccatcctggacgacgagatcaacgaggtcatcgtgcgcccgctggtgcacggcgccaggctgcacgccgtggtggacgcctgctacagcgccacggtcctggacctcccctacctgtgccgcatgt

SEQ ID NO: 19621 - DNA, 463 bp, Zea mays
  Clone ID: LIB189-030-Q1-E1-E3
ggtcgagaataacgggtcgacgcacgcgtccgaaaaaaagagaaggagaaaaaggaaaaagaagaaaaggaaaagaaagaggagaaaaaacctgaaccgaattttgaaatattgagtaaccctgctcgtgtaatgaaaaatcaacttaaagtcatctcgcttgtcgattccggaagttacgttccgctcaaagatgtttccatcggcggcatcgtcatggttcgtcatgtcaaggccggatctgaagatgaacaacttgtggagccagttgctgcatttggtcccaaagctgatgacgaaaaggagcctgacccaccagagccatttgaatacaccgaagaataaaatccaacattaaattcaattatatattttttttctacttttttttctctcactaataataatacattggatttattcgtttagaaaaaaaatctatgtctaatttaatatatactta

SEQ ID NO: 19622 - DNA, 372 bp, Zea mays
  Clone ID: LIB189-030-Q1-E1-F10
ggtcgacgcacgcgtccgtatataatctatgttagtgacatgctaatggaaggtcaatgggagaaaaaggcagtgtatacattttacttggttcgtgagctatatgtgactttccgcaacttcagaattcgcattgcagattatgtgcgctacagaaagatcacttccaacatgaatgaacgctttccagatgctacatcagaagagctcgatgtgagtgatgctacatgtattatttgccgtgaggaaatggctacagcaaaagaaactgctcgatgggcatctgttccatgtgcattgtctaagagaaacaggagaacaggctaaagaagaggttcctctacggcttctccatgggagcttcagctccac

SEQ ID NO: 19623 - DNA, 351 bp, Zea mays
  unsure at all n locations
  Clone ID: LIB189-030-Q1-E1-F3
gggtcgacgcacgcgtccgacccagagcagttgctgtttgttaaaaaacccaaccaaaattttaaagggaaaggtggtaattgatgcaattcgccctaatttaacccccaaaacaattaatctttggtcaaggaccaacggcaagacgacatcaaaattttgggcacctaaataagccatcgattcaggctcttatcatgggctgaacaggcactactactcaattgcaatcaattaccggaaaaatgagctagaggagaaaatgttgttgaacttgcacannaagaaatggacagatggactaattttgaagaagtttgacactcactcanaaaacaaacgagcagactg

SEQ ID NO: 19624 - DNA, 393 bp, Zea mays
  Clone ID: LIB189-030-Q1-E1-G10
ggtcgacgcacgcgtccgattgacagaggtgtatctgctgctgctaaggttgtcaggaaggcatatccacaagagaaagttggagtatttgttcagcgtggaaagggtggacccctctctgtagttgaatacagtgaaatggatgcagctatgacaactgaaatcaatcaaactactggccgccttcgttattgctggagcaatatctgcttgcatatgtttactttggattttctgaaccaagtgacaaacagtcttgaaaaggatagcatttaccatctagccgagaagagaattccttcagttcaagggtacacatcaggattaaagcttgaacaatttaaatttgatgtattcaactattctccttcaacagctctttttgaggttttg

SEQ ID NO: 19625 - DNA, 373 bp, Zea mays
  unsure at all n locations
  Clone ID: LIB189-030-Q1-E1-G12
ggtcgacgcacgcgtccgcaagttaggatttttatcaggagggtttctangagcaaaatcccgtaaaaataaatcttcacaaaaagatcttgctaatgtccgccagacatttgcagaggaagatcaagaaaatttgtacaatcttgttcaggataaagctacttctggaaagcagggtcttggcatcaaaggcctgccaatgaaagttgctggccaacgttggaagggaaacaaaacttcgtttgttgatagtgatgatgataattcagcccagtccgatgagtattcagaaatcgaagagaatggcgatgaggaagaacatatcagtgcttctgaatcaatagacacagataagaatgcagacaaagaaatg

SEQ ID NO: 19626 - DNA, 218 bp, Zea mays
  Clone ID: LIB189-030-Q1-E1-G5
aggacgcgtggggttgtggagtaatacaacttcctcatctaccatttcagtcatccaaacaatgccgaagtgcacctacatgtcttcttccatctgtaatactatgcttactatgtggacatgtggttgcctcacagaaaaaaaaaaaaaaaaaaaaaaaaaaaaaaaaaaaagaaaaaaaaaaaaaaaaaaaaaaaaaaaaataaaaataaaagaaa

SEQ ID NO: 19627 - DNA, 452 bp, Zea mays
  Clone ID: LIB189-030-Q1-E1-G6
attcccgggtcgacccacgcatccgaggacgcgtgggcagcagcttctgcttgctctggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgggtcgtctgagccagcagcacgggctgtcaagcaagggcgccaacgaggtgctcctcgtcat

SEQ ID NO: 19628 - DNA, 461 bp, Zea mays
  Clone ID: LIB189-030-Q1-E1-G8
attcccgggtcgacccacgcatccggaagacgagtcaacctcaaagactaaaaagatacatataaggatacgtgataaaccggctgcacctactgtagatgtcaacaaattgaaagaagccactaaacagctaggcttgggtcctccgctgagtaggacaaggtcattatcagggacacctcaagacttcaatcaggctcctacacaaccaggaggtccagccgcagctgtttccccagcaatgccaaattctgcgattgatttatttggaacaaatactttagtgcagccgcaagcacccactagttccacaggtcctgttattgcaggcatgggagtgacggctgggccgattcctgaggacttcttccagaacactattccatcgcatcaacttgcggctcaactacctcctcctggaatagtcctgtcacggatggctcaacccgctcctggcattg

SEQ ID NO: 19629 - DNA, 410 bp, Zea mays
  Clone ID: LIB189-030-Q1-E1-G9
ggtccacgcacgcgtccgaggacgcgtgggcaaagatgcagtggcatatgcagactgggttaagaaacatcatcagttttctgatatgcttgttcaaacctcaccagctgtaactgggcatgcctttcctagactgaaactacggtacaaaccatcacttgttcagagtggaaggaaagacttgaagctaggacatgccttgatgtgtcctcaggcgaaacatctggaaagggggcttttgctgcttgatgtgaggaatgattatgaatgggatgttgggcactttgaaggtgctcagcggcctaatgtggactgcttcagaagcacttcctttggactttcgggagagatcctctaaatggtgtagacaaagagaggacagatatactaatgtactgcaccggggggga

SEQ ID NO: 19630 - DNA, 436 bp, Zea mays
  Clone ID: LIB189-030-Q1-E1-H11
cggtcgaattaccgggtcgagcacgcgtccggatggaagccacgatctccaactctcagtggaaacactcgagtcactgatcaagctaacgaaggaaggtatgaagatgaaggttccacggtatgacaagtctgcgtttgggggaaggggtgaccgggctgatccttctgtatggccagaggttgaagggcccttagaggttgttctgttcgaaggatggatgcttggatttaaacctccttccaaatgaagttgtgaaagaagtggatccacagctggaggtggttaacaagaaccttgaagcatactctgatgcttgggacaggttcatccagtcatggattgttattaaaataagagaacccggtagcgtttaccagtggagactgcaggcagaggtcgctatgagagcagatggaaagcctggaatgtctga

SEQ ID NO: 19631 - DNA, 338 bp, Zea mays
  Clone ID: LIB189-030-Q1-E1-H9
gggtccacgcacgcgtccgcccacgagtccgcccacgcgtccgtgatttccaaggcatttgagggaaaatctgctgtaaacaggcagagaatggtctacaaggctatatgggaggagcttcagagcactgtgcatgctgtggaccagatgactaccaaaacgcctgatgaagctgctgccaacaagtaatcgatagatgcacaatacctgtgaaagcacagattatctgtgcttcgaagatcaggccattgcttggaccaaattttttctcttgggtggtattactttgcgtgtcagctgaatggtcaataatctgcggtatggatagcgcatggctt

SEQ ID NO: 19632 - DNA, 112 bp, Zea mays
  Clone ID: LIB189-031-Q1-E1-A1
agcggacgcgtgggcggacccgtgggaaaaaaaaaaaaaaaaaaaaaaaaaaaaaaaaaaaaaaaaaaaaaaaaaaaaaaaaaaacaaaaaaaacaaaaaaaaaaaaacaaa

SEQ ID NO: 19633 - DNA, 374 bp, Zea mays
  Clone ID: LIB189-031-Q1-E1-A11
ccgggtcgacccaagcgtccggtgacactaaccaccgcagatttagaagcagtggaagcacgagtgattcatggaaggaagtttccgaagagggtcgtctggctttccatgcgctgttcagtagagaaaagcttccgcaaagcttttctcccccacaagcagaaggctcgaaggaagttggcaaggaggaggaagatgaagtcaccacagtggcagttgacctcaacaagagtaccacaagcattgatcatgacctcgacacaattggtgagccaagggcttcctttcccaatgaactgtcgcccctgaagctgaaattgcgccgaacaggcttcaaaccatacaagagatgttctgtggaagcgaaggagaat

SEQ ID NO: 19634 - DNA, 256 bp, Zea mays
  unsure at all n locations
  Clone ID: LIB189-031-Q1-E1-A12
ctcaccggcaagctcttcagcaccatcgacgatcttgaccatgccgcgaagatcaagagcaccccagaggccgagaaatacttcgcagcaaccaaagatgctcttggcgatgttctcgccaagctaggctagacgcaagggctaataatggccatgtaatttcggacttgtgtttgttcatatggacccggcaaggcaatgtaccattttctgttgatattgtatcaggaagcacttaactacaggaaanccaacg

SEQ ID NO: 19635 - DNA, 394 bp, Zea mays
  unsure at all n locations
  Clone ID: LIB189-031-Q1-E1-A4
gggccgacccacgcgtcaggcattgtaaaggtgtcagctanggaacaaaccacaaggcaaagacaagaaatcaacaacaagttctccgggggtttgtcagaggtcgaaattgagaagatggtgaaggaggccgagctacattctcagaaggaccaagaaaggaagtctcttattgatctcaagaactctgcagataccacgatctacagcattgagaagagtgtcagcgagtacaaggacaaggtccctgctgaagtcaccaaggagatcgagtctgctgtctctgatctgagggcagctatggctgaggacgatctggacaagatcaagcagaagctggaagcagcaaacaaggctgtttcaaagattggagagcacatgcaacaaagtggcg

SEQ ID NO: 19636 - DNA, 368 bp, Zea mays
  Clone ID: LIB189-031-Q1-E1-B1
cccacgcgtcagcccacgcgtccgcaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcagggtgtctgt

SEQ ID NO: 19637 - DNA, 324 bp, Zea mays
  Clone ID: LIB189-031-Q1-E1-B10
ggtaacggtcaggaattcccgggccgacccacgcgtcagcccacgcgtccgcccacgcgtccgcacgctcgtcctcttcttggtgctgggcgccgtcgtcggagctgtcaggcggttcctcaacaggaacaacgacgattacgacgactattgattatcagtgccaagctcctgctatacttcaccttcgtgtgtgcgtgtaatatatgacgaaatttttcccgtgcggaattctaggaacggagtgtactgacgatgcatcaggagatgtatgtaataattttgtccagtgaaatgtaatgagcatagcgtctatagttaaaa

SEQ ID NO: 19638 - DNA, 362 bp, Zea mays
  Clone ID: LIB189-031-Q1-E1-B11
ccgggtcgacccaagcgtccggccgcggttctgatatggaaactaggtacgggcttctacgaggaaccctcagggctccagccctgggctggatgatgtacaatgttctggtgagcaatgagaagtcgatccagtctcagtacaagtcccacgtctacgccaaccctgacaacgtgacgccagatatcatcgagagccgatacgagttaaccaaaagaaaaggcgcacggttcgtccccgcggccttcctgacaggcctccttgatcctgtccaatcgagggaggagtttctgcagttgttcgccaagttagacggagacgtaccagttctggtagtgtcaacggtcaatgctcccaagaga

SEQ ID NO: 19639 - DNA, 450 bp, Zea mays
  Clone ID: LIB189-031-Q1-E1-B2
ggtcaggaattcccgggccgacccacgcgtcagcggtgtaccactgggaaattgttctctctgggatctgtaattttttcccccttcctgtgcgcgcatgtcatgtgcagggctggtgcagacctgggcggcggtgatcatgggcgtgttcgcgggcagcgtgccgtggttcaccatgatgatcctgcacaagaaggtggcgctgctgacgagggtggacgacacgctgggcgtcttccacacgcacgccgtcgcgggcctgctgggcggcgtcctcacggggctgctggccacgccggagctgctggagatcgagtcccccgtgccgggcctccgcggcgcgttctacggcggagggatccgccaggtcggcaagcagctggcgggggccgccttcgtggtggcctgggacgtcgtggtcacgtcgctcatcctgctggccatcggcct

SEQ ID NO: 19640 - DNA, 412 bp, Zea mays
  unsure at all n locations
  Clone ID: LIB189-031-Q1-E1-B4
ggtccagaatacccgggccgacccacgcgtcagaaaaaaaatcatcctatcctgtcaaatgttctttgaaatttagttcactcgtaggctaccttcaaagatatgattgtaatctgcagttttggaggcatcacaatggagataggactttgcagttgaacttggcggcaaatgatcggactttgtatcccacattatttgatgaatgttcatgttgtttaagtgttctcggttctcactatcaaattgatagttaccagagggggtggtcttgctgattgcagatctctangtgggatacttgcatgggcaccgaaagatccagatctattcaaacctacaacaacctttagctcattgtgtttgttcagtgtcctctacctggaagtagataatgattggggtcattgtt

SEQ ID NO: 19641 - DNA, 432 bp, Zea mays
  Clone ID: LIB189-031-Q1-E1-B7
ccgggtcgacccacacgtccgcttgacagcatgaaccattcatctgctcaggtaagagaagcaattggtattgccatgtgtgttacaacctcaaatatgacactttctgggttatttggcactggatgttcaccgcaaggccttcatggggatgtaagcatgattgaacaaacaggaaataaatattggtctgaacgtttgacagatggagctaatgaattagccgtaagtatacaaaatagtactcaatctaagcaactagaatcaacatcagattcggctgaagataccatggatgatagagagcaggctgatgctaaaaggatggaaacgatatttcattttatgatcgcatctttgaagtctgggcgatcttctgttctactggacactattattaggcttgtgtacccaattctctcactacaggaa

SEQ ID NO: 19642 - DNA, 354 bp, Zea mays
  Clone ID: LIB189-031-Q1-E1-B9
ccgggtcgacccaagcgtccgagcgccaacgggttcgagatccggcggtacacggacgccatgtggatcaccacggcgcccatcgaggacatctccttcgtcgccgccacgcgcaccggcttcctacagctgttcgactacatccagggcaagaacgcgtacaaccagacgatcgagatgacggcgccggtgctgacgcgggtgtcgcccagcgacgggcccttctgcgcctccgccttcgccgtgagcttctacgtgccggccaagaaccaggcggacccgccgccggccgagggcctgcgcgtggaccgctgggccggggccaggtacgcggccgtgcgccgcttcgggggc

SEQ ID NO: 19643 - DNA, 323 bp, Zea mays
  Clone ID: LIB189-031-Q1-E1-C1
attaccgggccgacccacgcgtcagcccacgcgtccgcccacgcgtccgattgattcttgaagagatcgagcttcttttgcaccacaaggtccaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgaattcgtccaagccgcggcggagtccggcgaagccgcccacggctgcaactgccgtggcaactgcaagttcgacccctgcaactg

SEQ ID NO: 19644 - DNA, 451 bp, Zea mays
  Clone ID: LIB189-031-Q1-E1-C2
ggtctagaatacccgggccgacccacgcgtcagcacctgcgcgcctcgactggtagcccgaaccctagctagcaggtcggaggcgagagagcagccatggcgcggtgcctcgcgctcgtctccctccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtcactggagagaaatcgaagacattggaaaggcttgaccctggtgccactgctacacacacatatgtcctggagaacaaaacacagggcaagttccaaggttcaccagctattattacgtaccgtg

SEQ ID NO: 19645 - DNA, 418 bp, Zea mays
  Clone ID: LIB189-031-Q1-E1-C3
gggccgacccacgcgtcaggaaaaaaaacgcgcgcaaagcaatcgttggagcccaacagctagggttggtggcagtcggcgggccttcgttcttgggttggtgacttggtgttggttccaactgatctctctggccgtaaatggctcggaagttgcaagaacagagccaccaaaaccgcgccacacagcaggcacatgtgatcgatcgagagcgacgactgaggacaagccgcgcggcgctgcgacccagcggcgcgaccgacgcggacgggcgcgcggccggctctgcccgccctgcagctccacccaccggaaccgaattaaacaccgccgtcgccgcggctggggcttgcgctctcgacagacaggccatgcgcgccacaaggtcgttgaccccggccaagccggcctggcatgt

SEQ ID NO: 19646 - DNA, 449 bp, Zea mays
  Clone ID: LIB189-031-Q1-E1-C4
ggtcaggaatacccgggccgacccacgcgtcagatgatgaagtcatgcgagcagcgggggagggacctcctgaaccagaacgtgataacggccgcggggctggcggagtggctgaggggggcgaaggagggcgggcaccacgagaccgtgagcctgggcctgccgtcctactcgctgctgtgcaccgtgctgcagtcgatcagggccgggtccgggggcctggtgctgggcagcttcgaggtgaaccagcacaaccggccgcaggaccggctgctggactggttcttccaccccgtgctggtgctcaaggagcagatacaggcgctgaggatgaccgaggaggaggtcaggttcctggagaagctgaccgtcttcgccggcaacgtcgcgggcgctggggcctggcggttggaagaacggcgccgggatgatggtggtgccccaggacc

SEQ ID NO: 19647 - DNA, 387 bp, Zea mays
  Clone ID: LIB189-031-Q1-E1-C9
ccgggtcgacccacagcgtcagcggacgcgtgggcgacgccacagcttgtgttgtgcgcgcgcaatggcactcgtgtccgcctcctcgtcctccaccaccgccgtcgcggcgctcgccaggaatgggcagcaacgggcgtcgtcgtcgttgttctcctcctcctcctcttcctccttcctcgtgggcaggacgctgctgaggcaggccgaggcagcccggccgtcgttcgccgtgcgcgccgcggcggattccgacaggccgatctggttcctcggtagcacccctccaccgtggctcgacggcagccttcccggcgacttcggctttgatccctgtggcctcggatctgacccggagagcctgccgtggaacgtgcacgccgggct

SEQ ID NO: 19648 - DNA, 410 bp, Zea mays
  Clone ID: LIB189-031-Q1-E1-D2
ggtcaggaatacccgggccgacccacgcgtcagagaaaagattcgcggcggtggagtcggagctcaactcatcaatagggtttgatcagcgctccgctcgtgctagccacccagcccccccgcgcccacttgcgacggcgatggcttcgccgtactcgctcagctgggccgacgcgccgccctaccactaccacgggagaccccagccagcgcccgactcacccgcatcctccgacggggccgggccccgctcgctctggatcggcggcctgctgccatggatggacgaggactacctctacggctgcttcaccacctcgcgcgagcttctttcccttgtcatcaaacggaacaagcagactggccaatcagagggctttggcttcctcaaattttctgaccaatacggc

SEQ ID NO: 19649 - DNA, 415 bp, Zea mays
  Clone ID: LIB189-031-Q1-E1-D3
ggtcaggaattaccgggccgagccacgcgtcaggtcaatacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatgggggcgtgattttaataagccaaatcgcttgctatattgggaaccttggaattgagaacagcgtcactagctgtgattcgctcctttctcgttaaattatcatatgaataggccaagtccatacgtttaccgtgtggcgctctgtcagtc

SEQ ID NO: 19650 - DNA, 180 bp, Zea mays
  Clone ID: LIB189-031-Q1-E1-D4
ccctggatacaaacaagtccataacacagtgatcaactaaaatttactaccattgtcgttgaaccaattagcagtaccatcacatatagaagttcaaaattgggactctttcttgttgagtaacagaattgcaaattcagctaaaataacttcgagttcactcattaggtctcatttggg

SEQ ID NO: 19651 - DNA, 422 bp, Zea mays
  unsure at all n locations
  Clone ID: LIB189-031-Q1-E1-D5
gaattcccggctcgacccacagcgtcaggatacggaatcctagtctcgcaggtgcccaaggacactgaagccttctactcgctgagagacccgtctgaagtgatggggttcctcaattccttggtgagatggaagaagcacccgctgtgacgcaactgaaaacacaacgactgattcagaagccgtaaagcgactgtacttcgtgcggcggcaattttgtagagtttttggctcaccgggtggctcattctttcatgcgtttttattttttatttttttaactgtcacagtccttcgtcactgagaaataacaagtggttgtcccacaccctcttgcaactgtaatctgtaagcaagaggccctccctgttcggtctatatatatatattgaatanaaccgggacgcttttgccttgccctg

SEQ ID NO: 19652 - DNA, 205 bp, Zea mays
  Clone ID: LIB189-031-Q1-E1-E1
gggccgagccacgcgtcaggccaagcgtacgcgcacgcttcaggtgactcatgagtttggcttcgcgtggctaaactacctccgaggaaggggtgcccatgctgccaaaaatcccgtccatgttggctccacagtgtggatccaggattattcggcttggggatagcgctcaaccagttcggttacatgatgtcccgcaaagata

SEQ ID NO: 19653 - DNA, 344 bp, Zea mays
  Clone ID: LIB189-031-Q1-E1-E10
tcccgggccgacccacgcgtcagggaatgcgtgagggaggcactcagtatcgggattaccaatggtggcaatgtcgatagcgagctctccaaccggtggagagcacagacgatgaattagcttgatgtcttgagcaggacgctgacgttgctcctcaagtatggtacagtcgtctgagcattgatgcttagatgttgatggttttggtgatgtacctcccatcatttgcccctttgttgtgtatagtacctaggtgattgtgcgatgctttgtaatgtcttcctcagctggtcccttatccgtcctactatatttgcctatgtataccccgggtttgatagttt

SEQ ID NO: 19654 - DNA, 367 bp, Zea mays
  Clone ID: LIB189-031-Q1-E1-E2
gggccgacccacgcgtcagagttgctccgagcatcttaattattatatgtattattacaaggcacaatggcacatacatacagtgatacagctgcaatatacatgaacaccctttgtctcgctcctgctttatctatgcaactgctggcatgcatgcaaaagacgcctcgggagataagacccctgttattctgctagtacgtatgcatgcatgtgcacgatcgatgggcgcgatggtcatatcatccgttggttcagtagtagggctggatcttccagcgctggggcaatcccacccggtgcgcctggtgccctacaacccggactttttggacgaatccgtgctgtggaccgagagccgcgacgt

SEQ ID NO: 19655 - DNA, 382 bp, Zea mays
  Clone ID: LIB189-031-Q1-E1-E4
gggccgacccacgcgtcagcggacgcgtgggcggacccgtgggctccatgagctttcaaacaaccaaaggttcccaattgctggtgcttccaacctgttggctaacaccctttatccataccttgggatggaactgtcaattggtacaatgatccctggatgggatgagaagggtcctgccttgtactatgttgacagtgagggtgcgcggctcgtggggaacaggttctctgttggctctggttcactgtatgcttatggtatcttggatgatggttaccgcttcagcatgtcagttgaggaagcagccgaattagcgcgacgggctatttatggggcaacattccgtgatgcagcaagtggtggttgtgttagtgtttac

SEQ ID NO: 19656 - DNA, 410 bp, Zea mays
  unsure at all n locations
  Clone ID: LIB189-031-Q1-E1-E7
gaattcncgggccgacccacgcgtcagacaagactgcctttgatatagctgaagggttaccagtatgtgaggagtcttgcgaaattaaggatattttatctcaacatggtgcgctcagatccagggagctcaatcagccacgagatgagctacggaagacagtgacagagataaagaaagatgtccacacacagctggaacaaacaagaaaaaccaacaaaaatgttcatggcattgctaaagaactcaggaagttgcacagagaaggcatcaacaacgctacaaactctgtaactgttgttgctgtgctgttcgcaacagttgcttttgcagctatattcaccgtacctggtggaaatgacaataatggacttgcagttgttgtccagactacgtcctttaagatattc

SEQ ID NO: 19657 - DNA, 150 bp, Zea mays
  Clone ID: LIB189-031-Q1-E1-E8
agaaaaaaaaaaaaaaaaaaaaaaaaaaaaaaaaaaaaaaaaaaaaaaaaaacggacgacgctcaagatgtttcatccttacatagtcctgcaagatacatcgtagctcttcaataatgtcaactagcattcaattcacaggccgatcca

SEQ ID NO: 19658 - DNA, 373 bp, Zea mays
  Clone ID: LIB189-031-Q1-E1-F1
ggtcaggaatacccgggccgacccacgcgtcaggatcatgaaatgtgacgttgatatcaggaaggacctgtacgggaacatcgtcctcagtggagggacgaccatgttccctggcatcgctgacaggatgagcaaggagattactgccctcgcgccgagcagcatgaagatcaaggtcgtggcgcctcctgagagaaaatacagtgtttggattggtggctcgatccttgcgtcgctcagtacgttccagcagatgtggatatccaaggatgagtacgatgagtctggccctgctatcgtccaccgaaaatgcttctgagctagctatctgccgcgcctttcatagcgtgtcaagctgttgagatctgcgttg

SEQ ID NO: 19659 - DNA, 435 bp, Zea mays
  Clone ID: LIB189-031-Q1-E1-F3
gggccgacccacgcgtcagcggacgcgtgggcaaatccttttgattttggttccatgcaaagtttgctcaatgatccatctattaaggagatggcagatcaaattgcaagggatcctgcattcaaccggatggctgagcagctacagaaaagtgctcaaagcacaggagaacagggcacacctccattaaatcctcaacaatacatggaaacaatgcaaaaggtcatggaaaacccccagtttatgaccatggcagagcgtctggggaatgctcttatgcaggatcctgctatgtccagtatgctggaaacctttagtagtccatcacataaggagcagctggaagagcgtatgtctcgcattaaggaagatccagctatgaagtcaattcttgatgagttagagaatgggggcccttctgcaatgatgaagtac

SEQ ID NO: 19660 - DNA, 409 bp, Zea mays
  Clone ID: LIB189-031-Q1-E1-F9
ggtatcggtcaggaattcccgggccgacccacgcgtcagcccacgcgtccgcccacgcgtccgcccacgcgtccgcttccgagctctttgcacaggagagaaaggggtcggcaagagtggcaaagccctccactacaagggaagtaagttccacagaatcatccccagcttcatgctccaaggaggtgacttcactctcggggacgggaggggtggtgaatctatctacggcttgaagtttgcggatgagaacttcaagatcaagcacactggtccaggccttctgtccatggccaatgccgggagagatacaaacggatcccagtttttcatcaccacagtgacaacaagttggttggacgggaagcatgtggtgtttggcaaggtgttgtctggaatggatgttgtg

SEQ ID NO: 19661 - DNA, 93 bp, Zea mays
  Clone ID: LIB189-031-Q1-E1-G11
agcccacgcgtccgcccacgcgtccgaaaaaaaaaaaaaaaaaaaaaaaaaaaaaaaataaaaaaaaaaaaaaaaataaaaatatgtaataag

SEQ ID NO: 19662 - DNA, 443 bp, Zea mays
  Clone ID: LIB189-031-Q1-E1-H1
ggtccagaatatccgggccgacccacgcgtcaggacgctggcagaagagaaccagaagctgaaagagcttctgcaaaagcttctggcgtccggcaacgatcagatgggggtcatcacggacctaagtgagaaggtcaaggtgctggagcggaggctggcacgcaagaagagaccaaaggtgagggtgcacaagccatccaggcatgcttcctgtgtccactgaaaggataagtctgtaaggttttgaggttttatgttgtatggatccccatgttgcttcctgtgtccagctattgtgcactgtgtaggtatagccatgctgtggcactgtgcttcgtcttggacaacacaaggtgtggcatgttctgtattttatgtctgtataatgcatccaactacatctaatgttctgtgaacaattgattgggacaaatcgatatgac

SEQ ID NO: 19663 - DNA, 388 bp, Zea mays
  Clone ID: LIB189-031-Q1-E1-H2
ggtaacggtcaggaattccaggcacgcgtaagcccaagcgtccgccatcatctgagaccttatcccggattcgaaatgagaaggccaggagatatttgagctgcatgcggaaaaaatatcccgtgccctttactcataaatttcgacatgctgatcctttggctcttcgtcttctagagcgtttgcttgcatttgatcctaaagaccggcctagtgcagaagaggctctagctgatccatactttgcatcccttgctaatgtggaacgtgagccatcaagacacccgatttctaaacttgagtttgaatttgaaagaaagaagctggccaaagatgatgttagagaactgatctatcgagagattttggagtatcatccacagatgct

SEQ ID NO: 19664 - DNA, 410 bp, Zea mays
  Clone ID: LIB189-031-Q1-E1-H9
aattcccgggccgacccacgcgtcagcccacgcgtccggttacctatgactgggcttccgaggttttcattcaaatcaaacacattagatccggttttcctcggcttctcattcagccaattcacggttcaaaatccactccttaaaattcaacataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctaaaaaaaacagtaacctaagaaacaatgtaaaatatgaaaatgaaataaaaaaagggggggcccccaaaaaggttcaaattaaagtatcgggtaaaggaaaattaaaacctctccaaaagggcccccaaatttaaattaagggggcgttttttaaaa

SEQ ID NO: 19665 - DNA, 362 bp, Zea mays
  Clone ID: LIB189-032-Q1-E1-A10
gggtcgacccacgcatccgactacggcggcatcatggtgtgggaccgctttaacgacgtgcagaacaactacagcagccaggtgaagggcagcgtctgatgggcataccgcatacgaagcttcaagctacagcacctagccatgcatatatatatagtggctattcgtcaagttatcggactgctagatacaaatataataagagcggatcatcgggagacaaagacgcatgtcagctattgtctcgttttctaagcaacgagcgagagctgcatgcgctggttagatttaatatggatattgcccatacgttatgtaattaaatcaaataaatgttaagttcatattgaatgtgtcgaaaa

SEQ ID NO: 19666 - DNA, 228 bp, Zea mays
  Clone ID: LIB189-032-Q1-E1-A11
cgggtcgacccacgagtccgaccatgtcgccgccgttgcgcgaggagttgatgattgcgtacaaggacgacgaggtcgtggacgcctgagtgcggcaagcagagaggaggatcgacgccagcagcgtcttatcttaattgccttgttgttcaatgatgaatcgatcgaattcccttgggttagctttattattgttgttgttattattaatttgactcgctataaaaa

SEQ ID NO: 19667 - DNA, 391 bp, Zea mays
  Clone ID: LIB189-032-Q1-E1-A5
gcccgggtcgacgcacgcgtccggcgttgcgtcatgggggagagagagaagtgggagacccgcgagaggctgccgtgtagggactagggaccgtagagtaagcgacagcgaaggagggagagggggatggccgggatcgggccgatcaggcaggactgggagccggtggttgtgcggaagaaggcacccaccgccgctgccaagaaggatgagaaggccgtcaacgccgcgcgccgctccggcgcggagatcgagaccatgaagaagttcaacgctggtatgaacaaggcggcgtccagcggcacatccctcaacaccaagcgcctcgacgacgacacagagaacctcgcccatgagcgagttccaagtgacctgaagaaaaatctcatgc

SEQ ID NO: 19668 - DNA, 413 bp, Zea mays
  Clone ID: LIB189-032-Q1-E1-A8
gggtcgacccacgcatccgagactacgccacggcatcagacgaccagcgaagaagctgacggaggggcgactctaagcccaattgaatcatgatggcgtcgattaatcgtcacccgacatcgagcgcggtggaagatctggacatgcagcctgctctcggacagatcattaacatcaagttggtacagactggggagaaggagaagctaatggacctactccgcgaacgactcgctgactgcggctggagggatgagatgaaggcactctgcacggcatatgcatcgcacacagggataaatactgtgacagtagatgacctcattcaggtaattactccgaatggaacaccatccatgcctgagtcactgaaggcagaactcctgcaactcatcgggtccatccttatgtcg

SEQ ID NO: 19669 - DNA, 420 bp, Zea mays
  Clone ID: LIB189-032-Q1-E1-B1
aattcccgggtcgacgtacgagtacgcgtccggtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcg

SEQ ID NO: 19670 - DNA, 416 bp, Zea mays
  Clone ID: LIB189-032-Q1-E1-B3
cgggtcgacgcacgcgtccgaccacgcgtccggcgccatgtggtcgtggcggcgaagctgtacgcggagatggacgcgctcagcgagctggaggcgtcagagcggcggatggagcggtggaagcagcacagcgggccaatcccggcgcagacgacggggacgggcaaggggtcagcggccgatcccggagagaagctgatgagtaagctcagggagcagcggcagaaggtgcgacgggtcatggagggatcgctgtggaacgtcgccgccagcaaggcggcgaggctcatggccaagtcggtcctcgccgtgctcgcgcgcatctccctcgcctttgccgcgttcgttccaggccttcccccttggacggtaggacgcgcgtgggcgctcggtcactcatccggatcggcccgtta

SEQ ID NO: 19671 - DNA, 297 bp, Zea mays
  Clone ID: LIB189-032-Q1-E1-B4
gggtcgaggcacgcgtccgcacacacgtccgccttgtttggattggggtgtttgttccataaacagtctcattgctaattgtttcattattactacaaatcttggtcaaggcgtgaatatccttgctcttgatataattatagtattttgaatccctattgtgttttttacttaagtgataaatgttgcaaagaaaccattagatacaaggataagcggcagaaggtgcaacaggtcataaaaaggatcactatggcacatcactcaaaggagtgaagctaagctcatcgtcaattc

SEQ ID NO: 19672 - DNA, 407 bp, Zea mays
  Clone ID: LIB189-032-Q1-E1-B9
aattcccgggtcgacccacgagtccgactttctataaaaaaaaaaataaaaaaaaaaaaaaaaaaaataaaaaaaaaaaaaaaaaaaaaaaaaaaaaaaaaaaaaaaaaaaaaagggggcggcccctctaggatctaagcttatatttccttgtaaatgctttctcacatctcttatattgtctcccaaatttaattctcaggggctcttttttaaaagtttcgactgggaaaaacctgtgtttttccaaatttaactccttttgcaacatacccctttttcaatatggggttttatccaaaagggccccacagctttcccttttcaaaatttttgcacccttaaatgggaatgtgacaccccctatttcgcggcattaaacccgccgtgtgtgaggggttttccca

SEQ ID NO: 19673 - DNA, 398 bp, Zea mays
  Clone ID: LIB189-032-Q1-E1-C10
gggtcgacccacgcgatccgaccacgcgtccgcggacgcgtgggaaaaaaaaaaaaaaaaaaaaaaaaaaaaaaaaaaaaaaaaaaaaaaaaaaaaaaaaaaaaaaaaaaaaaaaaaaaaaaaataaaaaataaaaagataaaaaaaaaaaaaaaaaaaaataaaaaaaaaaaaaaggggggggtcgccctaagggttcaaactttatttccccgttaattggattttaaacctcttcaaagttgtccccaaatttcatttcaggggctttctttttaaaagttcgtgctgggaaaaacgggggttttaccaaattttacccccttaaagaaaattcccttttcccaaatgggggttatatgaaataggcccgattcatttccctttccaaaattttt

SEQ ID NO: 19674 - DNA, 349 bp, Zea mays
  Clone ID: LIB189-032-Q1-E1-C11
gtgttttttctggcattgatgcaccagaagacgaactgcctggtataatgctaacgaacgatgactatgatccaagaagtggtctacgagcaatagatggaggacacgattatgaagcaggtcttccagacttcgatccactaaggcaccacaacgattactgtccttgggtgaatggcaatgttgctgctgcatgttgtctgagtaccggttcgagcacagctctttcaggctggcacctcacggtagatgccatccagactctgcaatctcttggccaggctcacaatcagacgatgcagtcagactctgcggcttcattacagaaggatcatcacgtcccgcctat

SEQ ID NO: 19675 - DNA, 407 bp, Zea mays
  Clone ID: LIB189-032-Q1-E1-C2
cgggtccacccacgcgtccgaccacacgtccgcccacgcgtccgagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataag

SEQ ID NO: 19676 - DNA, 188 bp, Zea mays
  unsure at all n locations
  Clone ID: LIB189-032-Q1-E1-C4
agcggacctcgacgcccgcgccaagtcggccgagcccagcctacagaccgtctgatggatcgagcgcaaggggcttagcgtatgctagtcaaagaatataatttggtggcctatatctatagtttgatgtagtatgtcctgtantangaacagtaatttcttactgtgagttagtttacggttcaaaa

SEQ ID NO: 19677 - DNA, 443 bp, Zea mays
  Clone ID: LIB189-032-Q1-E1-C6
attgccgggtcgacccacgcatccgaccacttgtacatgcagtcgtcgcgggtaatctgtcactacacgttagaggatccttcatttcgttacgtgtttcctcagtcctataagcatgtggatcagtggttgagaagccacgaaggtgactgcaaggctataataaatttgtacaatgagcagttgcttcaatcactgcaggctgataatgagttgaggaggattgcacatgacatctcaagtcacgggaggtatacgggccgtttcattactacgaagcagctagtaaaggatggacggaatccagaggcagttttggacattctaagtttgagggtaatcttggagcctcggtgtggtggcaattcatctgattggggccctagggcttgccacaggacacatgacgttattcacgccatgtgcaatgagatcccaggttc

SEQ ID NO: 19678 - DNA, 404 bp, Zea mays
  Clone ID: LIB189-032-Q1-E1-D1
gggtcgacgcacgcgtccgacatccagcttcccccaacaaaggaatctccctccccttcctcagcagggtagccatgtttggtcttcgtgcccgcgcagcggcgcagctccagcgcccaaccccgtctccctcctccgcttcctcggcgtcgttctcgctcgcgaggctcgggtgcgcctccccgctcgccgccctcgcgcctctggcttccgcaccgccgtcgccgtcggccagggagacacagccgacctccctctccgccaggtggcctgccgcgcccatgcgtccctggggaacccgtggccactccaggccgaccacgcgcgttctctgcactgctgccggcagcgtccaaagagaggggaaagaactgctagttcagcatttgcttgttggtgaaaag

SEQ ID NO: 19679 - DNA, 335 bp, Zea mays
  Clone ID: LIB189-032-Q1-E1-D10
ttcccgggtccacccacgcgtccgaaaagtggcaagggatatgttcacgatggactatcgctaccctctctcggctttccaggcctttgccatttgtctgagtagctttgatacaaaattagcctgtgaataaatggagaagaacaaaggtaaaggagaacagcaggttgcttgcattaggccatcagtgtacctctttccatctggctctcgtgttgccttggttgtatttgtgcttaatgtagccatgaagttggtggccatatatggacgcatgtgttgttgttggccctctcccttagaagtgattaaaagttgcatttggaccacatgtt

SEQ ID NO: 19680 - DNA, 390 bp, Zea mays
  Clone ID: LIB189-032-Q1-E1-D3
gggtcgagccacgcgtccgagaccacgtcaagcacgccctcaccctcttcacagacttcgtggccgtcctcgtccgcgtcctcgtcatcatgctcaagaacggggccgacaagtcggaggacaagaagaggaagaagaggtcgtgagcgcgtcgagaagggaagctcttccacttccacatatgcataggagtaactgctggggttccttcctggggtggaagtgtggaactgagctgagtgttcagaagtgttcctttgttcggcacctttgttctcttcctctcttgatgagtctgtaaatagctatgtcaatctggttaagcttggtttggttgcctgtgcctgtgttcgctggcctttggatagaatgcaaattaaagatgttgct

SEQ ID NO: 19681 - DNA, 416 bp, Zea mays
  Clone ID: LIB189-032-Q1-E1-D5
ccgggtcgacccacgcatccgaccacgcgtccgcccacgcgtccgcccacgcgtccgcacacggtcgcggcgcgaagcaatggcgaccacggcgccgctgctctcgccccagcgcgcttgccctacccatctccggcgccgcctctcgcccctacatctcgtattccccctcgacgcgtcagcgaggcggctgcgccttcgccgggcgccgccaccttgttcggccaagttcggcaagttcgacgcctccgacgctccggcggaggccgaggaggcggagggcgcgacggatggtgggctggcgcatcccgtggaggaggaccatagttgcttggcatctgatttggagggcgcgattcggcagtcagggaacgctagcgcagatttcgtaaactccggaggcatgcgagctatcg

SEQ ID NO: 19682 - DNA, 388 bp, Zea mays
  Clone ID: LIB189-032-Q1-E1-D8
ggggtcgacccacgcatccgaccacgcgtccgcccacgcgtccgcggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaataaaaattaaaggggggggccctttaatgtttttaaatttattttattttaaatgtaatttatatgatttttttttggtttaacaaaatttaatttctgggggttttttttaaaattttatgatgggaaaaaccttgggtttatccaatttttatccctttaaaaaaaatccctttttctcaa

SEQ ID NO: 19683 - DNA, 143 bp, Zea mays
  Clone ID: LIB189-032-Q1-E1-E1
acgcgtccgataaaaaaaaaaagaaaatgaaaaaacaacaacaaatggataaaagggaggccggactaacatgatcaaaggcttacgtacgcgttcaatgcgactgcaatatctctgcgtataatgacaacgtaacttcactt

SEQ ID NO: 19684 - DNA, 437 bp, Zea mays
  Clone ID: LIB189-032-Q1-E1-E10
gggtccacccacgcgtccgaagctgcaaaggtcactggaatgcttttggagatggatcagaccgaggtcctccacctgctcgagtcccctgatgctctcaagtccaaggttgctgaggcgatggatgttctccgcaatgtggcccaccagcaaaacccaaacctcccgaccagtcagcttgccgcattatcactgaccgaaggcattatgtcctaacttgaaggccataacaaactatcttcagtttccaactcagtgcgggtgtttccagaggttgtctggcacatgacagtattgttccttcgatactatggttggacttgtgaatgttgtttccatactggatgttaggttttatttgcgccctacggtgacctgccgttaaggcaaagaacttatttgcaagtctgagcactattttggggggttgggttggg

SEQ ID NO: 19685 - DNA, 401 bp, Zea mays
  unsure at all n locations
  Clone ID: LIB189-032-Q1-E1-E2
gggtccacccacgcgtccgactccagtacgaattacgacacaccaagcgtcggcaccaatggcttactaccaggaggtggactactgctcggaggangtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgt

SEQ ID NO: 19686 - DNA, 407 bp, Zea mays
  Clone ID: LIB189-032-Q1-E1-E3
gcgtccgagcctctccaatcatacgcgagccacccaccgcgcgacctcagggtgcctgtgcctgctctcgctgttccttcctcatggccagcgcctgccacctcgccgcgccgctcggcctcgccccgttgccccgcggctgcgcctctgctggcgtcgtggccgtcgtccggtgcgctcggtcgtcaggctccacgataccgacaggcgttgctgtcacggcgacgtccggcggtcatggcgccacggacgaggtgccgggaattgttcaggctgtgcaggacgcatgtgaaatagttgaggacaagtatcctgtggacagcatccgtgtccctgccatcgtcgcgctctggacggtattatgtgccatcaaggccatcgactagcttcctcgtctgcctggtgtc

SEQ ID NO: 19687 - DNA, 379 bp, Zea mays
  Clone ID: LIB189-032-Q1-E1-E6
aaaatccaatccagagttctcaatacttgtctcgtgagtttgtccgctaacatattcaccttcttgatccttaacatatttggcatgtggcttacaagcacaattgcatatttcctttacatttggacagtactcatacagacatacacaatgtatctgcacggcaaatggtcaggtacgagggcaagctaagctaacaatcgcctcacttgtttccgagtccgaacaaggacttgatggcgttgatggcgttctcgttgatgaacgactcgtcgtagttcttcagcaagggctcgaactcctccgacttcctcaggttcgcgagatccgggtcggtgcgaactgccttgaagtcttcataccctgacttgagcgcatc

SEQ ID NO: 19688 - DNA, 362 bp, Zea mays
  unsure at all n locations
  Clone ID: LIB189-032-Q1-E1-E7
ggagcgaaagaataacaaacattggtacccaagattgtttgctttcacaacgttacaacatatatatcatatatgcatggacaggtacaatgcctctccagcagcaccagcaacaagggtggttagcagcagggactataaacaacagagtaccatccgcgttgatagatttttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcancgatgtgcgcaaagatctttctgatgctggtgaagggtg

SEQ ID NO: 19689 - DNA, 419 bp, Zea mays
  Clone ID: LIB189-032-Q1-E1-F1
gggtcgagccacgcgtccgaggacacgtggggctacccttggacgcatcattaatgttatcggtgagccgattgatgagaagggtgatataacgacaaaccacttcctccctatccatcgtgaagcccctgctttcgttgagcaggccactgagcagcaaattcttgttactggaatcaaggtcgtggatcttcttgcaccctaccaaagaggtggaaaaattggtctcttcggtggtgcaggagtgggtaaaactgtgctcattatggagctgatcaacaatgttgctaaggcccatggtggtttctctgtgtttgctggtgttggagaacgtacccgtgaagggaatgacctgtacagagaaatgattgaaagtggtgtcattaagctaggtgacaagcagagtgaaagcaagtgtg

SEQ ID NO: 19690 - DNA, 303 bp, Zea mays
  Clone ID: LIB189-032-Q1-E1-F10
cgggtccacccacgcgtccgagactcggtactcggcacggatggcgatggggacggaatggccgccgacacctgcgcagcagccgaaaccggtggtgagcgccgtgtcggtcctgaagctggtactgttcctgattctcgccggccttccactgcggctgctggtggggcccccagcctagctcctgccgtacaccgtcgcgccaaacggggccgcacatcttttcgcggttccggtcatggaaacaaccaccggcagtcgcggccgccggataccttcccttaaaacctctgatgccgtttt

SEQ ID NO: 19691 - DNA, 402 bp, Zea mays
  unsure at all n locations
  Clone ID: LIB189-032-Q1-E1-F12
attcncgggtccacccacgcgtccggttctccttcatatggtggataattggattttattggatatcagctgggggtgaggaggttattcaggatgcacctcaactttactggctttgcatagtctttctggcatttgatgtgttttttgttgtattctgtgttgctctggcttgtattattggtattgctgtctgttgttgccttccttgtatcatagcaattctctatgcagtatctgatcaggaaggagcatctgaagatgacattcgtcaaatcccaagatacaaatttcggcggacggatgagcctgagaagcaagatgttgaccccatgggtccttttggtggaataatgatagagtgtggcaccaatcaacctattgagaaagtgcttgcagctg

SEQ ID NO: 19692 - DNA, 460 bp, Zea mays
  Clone ID: LIB189-032-Q1-E1-F3
gggtcgagccacgcgtccgaacacgcgtccgagcttcttcagcaacaaacaacacaatcgaaagtctcaaaagctttccgaaagccaactctcacgcaacgccaaatcaacaaacacctcccgccaataccaagcgacatcagcccgcggagcgctcttacgaaaacaactaaaccaataccactaccaactaagcaataatgggtctcatgtggactaaaggcttcggcggaaagcacgctggcggtggagtcatcatcgacaagcacggcgctcgccgcgctcctttcaggttctccttcaagggcctgaactgcttcaagtaaactacccaagttcctacgattatcagcacacgggaacagcgacggaattctactttcggttctcgactgccttcaagtgttttcacctttgttctttttttttcacgactcgacctacctgttcccaagggggg

SEQ ID NO: 19693 - DNA, 429 bp, Zea mays
  unsure at all n locations
  Clone ID: LIB189-032-Q1-E1-F5
attcncgggtcgacccacgcatccgattgggactgggccgcccggccgcgaggaataaactcactcctgtcttcatacgtatccatagccggcaggcggcagtacctgtatgtggttttagctatacgcgacctcagttcgggcgcaagctacaaccccgaccaggcgagaagaagcatcgatagtgtgacgagctaacccaccaccagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggccgagcgcgcgtccgcgtcggacttcaagaacca

SEQ ID NO: 19694 - DNA, 440 bp, Zea mays
  Clone ID: LIB189-032-Q1-E1-F6
gggtcgacccacgcatccgaccacgcgtccgggcacaaccgaagccaccgcttctagttctcgggttcatcgccagcaatccagaccacataatgggacagccggtgacgaggaggagggagagggacgcggaggcggagctggacctgccgccggggttccggttccaccccacagacgacgagctggtggagcactacctgtgccgcaaggcggcggggcagcgcctccccgtgcccatcatcgccgaggtggacctgtacaggttcgacccgtgggacctgccggagcgcgcgctcttcgggacccgcgagtggtacttcttcacgcccagggaccgcaagtaccccaacggctcccgccccaaccgcgccgccggcgacgggtactggaaggccaccggcgccgacaagcccgtcgcgccgcgcgccgccgcccgc

SEQ ID NO: 19695 - DNA, 404 bp, Zea mays
  unsure at all n locations
  Clone ID: LIB189-032-Q1-E1-G2
gggtcgacgcacgcgtccgcacacgacgtccgcccacgcgtccgcggacgcgtgggcggacgcgtggggcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgancccgtagaccttcgccaagaaccgcgagctggaggtgattcactcccgctgggccatgct

SEQ ID NO: 19696 - DNA, 384 bp, Zea mays
  Clone ID: LIB189-032-Q1-E1-G5
acccacgcatccgagtacgcatccgctcctcgcaacgcaagggctccacagaaaggctatgatcgatccccacaggtgacagctgagtatgctttatgctacatgcaatttaactggacggcacaaccacaatgatgcgggggtcctccgctgtactcggacacagtcgccaggagcgacacctcacgagatcaatcaggcgcagatacaaccacatattccatcgccacctgcttccccagcacttcaacattcagctattgatgtatctggacatcatagcttaccccatccactgggtcccatcagttcaggacatctcgtcatagcactagatttagttacgccagggacgatccctgctgacttcccccatggcattct

SEQ ID NO: 19697 - DNA, 371 bp, Zea mays
  Clone ID: LIB189-032-Q1-E1-G9
ttccgggtccacccacgcgtccgagacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgctaccgccgccgtggccgttgccgccagcgtcctgcttgccggcggcagcgccatggcccatgaggtgctgctgggcgcatgcgacggtgggctcgtcttcgatcccagccagttcatcgtcaaggccggcgacaccatcaccttcatgaataacgccggcttcgcgcacaacgtcgtgt

SEQ ID NO: 19698 - DNA, 417 bp, Zea mays
  Clone ID: LIB189-032-Q1-E1-H10
ttcccgggtccacccacgcgtccgaggacgcgtggggtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactcggtgcgggctatccgcccgggactgcccctcttcctctacaactactccacgcaccagctccacggcatcttcgaggtacagtacagcacagcacagcacagtagccactagccagttcgtggttccctttccttgcttcttcttcgttcgctgtccttgcttcttcttcgttcgct

SEQ ID NO: 19699 - DNA, 411 bp, Zea mays
  Clone ID: LIB189-032-Q1-E1-H12
cacgcgtccgaacacgcgtccgggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccgggttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggct

SEQ ID NO: 19700 - DNA, 430 bp, Zea mays
  Clone ID: LIB189-032-Q1-E1-H3
cgggtcgagccacgcgtccgacaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctcccactaccttactaa

SEQ ID NO: 19701 - DNA, 404 bp, Zea mays
  unsure at all n locations
  Clone ID: LIB189-032-Q1-E1-H8
acgcgtccgaaaacgcggcagaccccaagcaccaggtggcctcggcggccgcgggtaaccagggttgtcggaaagaacagcgttgatcgcggggaacacaggggcgcacaaaaaaaccggcgaccctttcccaaaaaaggtttggtatgacatcaaggcaccgtccgtgttcagtgtgcgcaacatcgggaagactctcgtatccaggacacagggtaccaggattgcttctgagggtctgaagcacagagtctttgaggtttgcctagctgatcttcagggcgacgaggatcanncttacaggaaaatcaggctccgtgctgaagatgtgcagggcangaatgtgctcacaaacttttggggcatgaattttaccactgataaactcagatccctagtgaaga

SEQ ID NO: 19702 - DNA, 410 bp, Zea mays
  Clone ID: LIB189-032-Q1-E1-H9
ttcccgggtccacccacgcgtccgaggacgcgtgggaaccgtgctctagttgaggagcgtgaactgttaagcagggaaatacaagctggaaaagatgaggtccgccacttgaatgtgatcattgctgacattaacactgagaaagaagcttatatcagtaagcttatggacaagaggaggaagcttgaagctgaacttggagcaagtgagcacttgtgtgatgaggtcaggcatcttcgtggtgaaattgacaagctcgttaccgctcggaaagaactatctgcagaggctgcatctctcgtggaagagctgaacagggagcaatctgttaaacagcagctacctgtgctgaaaacagaaattgatggtctgcaacaggaacttgttcacgtgaggactgcttgcgggtt

SEQ ID NO: 19703 - DNA, 269 bp, Zea mays
  Clone ID: LIB189-033-Q1-E1-A4
cacgcgtccaaatcatatcctacgctgacttctaccagcttgatggaatcatggcagtcgaggtaaccggcggacctgatgtccccttccaccctgggaggcacgacaagcctgagcctcgaccggaaggccgccttcctgatgccacccagggtgggtgatcacctcatgcacgttttctccacacacatgggtttgagccaccatcacattgttgcgctttctggtggtcacaccctgcgaatattccacaaggacaggtctggatt

SEQ ID NO: 19704 - DNA, 355 bp, Zea mays
  Clone ID: LIB189-033-Q1-E1-B3
acgcgtccgagcgaaacgacgcacgctgacgcctccttgttcagagtcctactcccgccgcctatagaggcctcgtcctcccccctccggcgaaaaccgattccccgattccctccggcgtgtccgtggtcccttactgcaagcaaggacacgggggggctatcgagctccgttctgaagcggcaagaaagatgattaatcttttcaaaataaagggtcaaaagaaataatacgcaccaagtgctgctggaaaggcccctgttaagaaacaatctgctggggagctccgtcttcataaagatattagtgagctcattcttttttttaccacattaatttcttttcccaatggcaa

SEQ ID NO: 19705 - DNA, 402 bp, Zea mays
  Clone ID: LIB189-033-Q1-E1-B6
gtcgacccacgaatccagccagaggctcctcctactctcgctccaacgaaggtcacagcgcctgaggttcttctgcctgcgaagcagatgctgtttcaaaaaccacagcatctctcgccgcctcgatcgagtgtccctggcatcttgcagtctggggcggtccccatgagcgcctcatctagctctaaccttgactccccagctccaaaatcttcggtcccgttagctgttcctcctgtaagccaggctccgccagcaacactgatcgccactacaactgcagcagcaataatgcctagagctgtccctcaagctaggatttgcttcccttgctcgattcttggagaaaaagaaggaaagggtgacaactgccccgccttacccatcagcccaagacccact

SEQ ID NO: 19706 - DNA, 299 bp, Zea mays
  Clone ID: LIB189-033-Q1-E1-B7
cccacgcatccaacacaaataatgcttggttgtggacagaaacaaacagggtcatttctggatgctgctgctcctaatggtctttttggacttggaatacatgaggtttcagttccaagggtctggagctcataaaggtttgacatctaaggggggtggctatgtgctttggtcgtgatggtattgggccaatcagctttggagaccaatatatctcacaccactaatacacacctcttgacatcaactgacaacatcccacatacgccatcactatatgcgggattactgttggaaat

SEQ ID NO: 19707 - DNA, 318 bp, Zea mays
  Clone ID: LIB189-033-Q1-E1-B8
gacccacgaatccacccacgcgtccgcaaaaagtactgtgacatggacagcattaatttctggttatgcccaagataatcaggtcgaaccatgtctccatttatttgcactgatgaggcagtctgtgtgcaagccaaatgacaccacatttggagggatcttgattgtctgcacaaatcatccattccttgtccttggaaaaattttgcaaccccaacaattaaaaatgggttttggttccaacttcaatttttcaattccattgacaccattttatccaaattccggaacaatgtgtaaaccccaactgtttttttt

SEQ ID NO: 19708 - DNA, 328 bp, Zea mays
  Clone ID: LIB189-033-Q1-E1-C1
acgcgtccaaccacacgtccgggtgcacccgctccgacctcaagtgcagatacgcgcaccctcacaactccgtttccatcgacctggacaataaggtgactgcgtgtgcggattctctgaggaacaattgcttccgggggatgacatgccggggcgaggatccgcctccacatatccaggagcaattactgagatcagttggcgtggaagacccaaaggtgaagacgatctgcagagattttacacgtgggaagtgttcacgatcagcaaatgactgccgattcttgcaccattcatctgttgaagatgttgcaattgtttttcaaga

SEQ ID NO: 19709 - DNA, 201 bp, Zea mays
  Clone ID: LIB189-033-Q1-E1-C11
cccacgcatccgaagacacgtgggcaactccatccaagacgaacgaatacatcccactaatcctttttcttttcttttcgtttttatttttaatttcttggttcggttcttgatcaccggttcgggcttaggaccttatccatgaatttatattggcaggtacattttgtctaaggatctacacgcaggaggatggctctc

SEQ ID NO: 19710 - DNA, 370 bp, Zea mays
  Clone ID: LIB189-033-Q1-E1-C7
cccacgcatccaaggacgcgtgggcaacggtggcactgctcattaagatgaacatgatgtgcatagttgcatactttgatcatggaacgatggctgaagaaaccaccttgctggcaaatgcgtggggaagaaatgaaggaaccaatggcatggaggatggaagaaagctgatggacaatagtattggttcaaaccgtgagtattcaatcgatgatatgtctcatccaaaggcaccacatactgagctcaagcaaccctcatacttagctcctggttgctcaagcaaccctctcaagcaaccctcaaacttagctcttttttgcattccccaaagttcaagcatacatatatagccttccactcatcatat

SEQ ID NO: 19711 - DNA, 331 bp, Zea mays
  Clone ID: LIB189-033-Q1-E1-E1
acgcgtccaagggaatttccatacaaatcgaaggccattctattgtttcaaaagatcgaaggtgtggatgtttgcctctttgccatgtatgtacaagagtatggctcagattgcccaccaggaggtcaaagacatgtttatcttgcatatagggagggtgtcaaatacttccggcctgaaatcaaatctgcaactggagaagctctccgcacctttgtgtatcatgaaattttgattggttatctggactactgcaagaaacgagggtttgtaagctgttcaatatgggcttgcccatctacgaaacgagatgattattttttatattgcc

SEQ ID NO: 19712 - DNA, 298 bp, Zea mays
  Clone ID: LIB189-033-Q1-E1-G1
acgcgtccactcaatatggtagtggtagtgcaaattattatagagtgacgtccaccaggccatacaggcccatcactctacctcctggacctggtgctttgaatggtccaagtgcgcaggcatcggcaagatcaaggctctattctggagatgcgggtgcggctgtctcccgatcatcagataagaagggatcgtcttacaagtattctttgtccagtatgtcaacttatgatcgtaaatgaggatttgttttatctgccaatggacgaacctagtgaaccttgaaagtttgggtttc

SEQ ID NO: 19713 - DNA, 156 bp, Zea mays
  Clone ID: LIB189-033-Q1-E1-G3
cgggtcgagccacgcgtccaaccaaacgtccgggggctgttctccctgtcgcaaccgcaccagggcatcgacggcgagtggagcgacaagagcggggtcatcgtgtaccgctggaacgacgaggggagccgggccaggacacgccgcgctaactgg

SEQ ID NO: 19714 - DNA, 369 bp, Zea mays
  unsure at all n locations
  Clone ID: LIB189-033-Q1-E1-H2
cgcgtccacccaagcgtccgcccacgcgtccgatcagaagatgcaaagaaacttcctttcatattggttataaatttgcaggtgccagcaaaaccaaattataacttggttatgtacgaggcggcacacagaccantgaacaaagattcggtggggggtacattcattgatggaactgatgcataccgagatgccagatttaaacttataccaagcattgttgacggttattggatggttaagcgtgctgtatgaacaaaagcttgccttctgggcaaagcactaacgtgcaattatcttcgccaggataattttcttgagatagatgttgacatccgttcatcatccgtttcccggagcattattggt

SEQ ID NO: 19715 - DNA, 336 bp, Zea mays
  Clone ID: LIB189-033-Q1-E1-H3
cacgcgtccaaccaaacgtccggcggcagcaaagcaacacgcgacctcaatcctcctcgcccctccggcctctcctcccctccctgcacccgcacctgcggagagcgccgcaagctagctggggaggagcgagacagtagcaggaggaggacgggagggaggaagagatggcgggctgtgatggagccaagtcgtcggcgtccatggaggaagaggcatgcgcggagaacaagtacggagggatggcacccaagaagcccttgatatccaaggaccacgagcgcgcctacttcgattctgcggactgggtgctgggcattttttttctctaacagc

SEQ ID NO: 19716 - DNA, 429 bp, Zea mays
  Clone ID: LIB189-034-Q1-E1-A11
tccgggtgcccccacgcgtcagccatcgcgtccgactccttccctgccctctcactccaaatccctcctccaccaccgcttcctccgcgtcacccctctcgtcgtcgcctcacgaggcgaccagcggcggaccctcgggggcgcaaccatggggctcttcactgtgacggggaaggccaccacgcccttcgacggccagaagcccggcacctccggcctccgcaagaaggttactgtattccagcatccccattatctgcagaactttgtccaatcaacattcaatgcccttcctgtggatcaagtaagaggtgcaacaattgttgtctctggtgattttttctatttctcaaaagatgctgttcagatcataacaaaaatggctgctgccaatggagtaacacgtgtttgggttggacaaaacaatct

SEQ ID NO: 19717 - DNA, 438 bp, Zea mays
  Clone ID: LIB189-034-Q1-E1-A12
cacgcgtccgcgaaccattagctttatctactccagagcgcagaagaacccgatcgacaccatgagggtgttgctcgttgccctcgctctcctggctctcgctgcgagcgccacctccacgcatggaggcggcagctgcggctgccagccaccgccgggggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcatttttttcggcctcagcctcatccccagccacacccatgcccgtgccaacagccgcatccaagcccgtgccagctgcaaggaaccctcggcgttggcagcaccccgatcctggg

SEQ ID NO: 19718 - DNA, 448 bp, Zea mays
  Clone ID: LIB189-034-Q1-E1-B10
tcccgggtggccccacgcgtccggtacgaaaccacctcccgcggggagcgcgcctacgaaatcttctcgcgcctgctgaaggagcgcatcgtctgcatcaacgggcccatcgccgacgacacggcctcgcttgtcgtcggagagctgctcttcctcgagtccgagaacccgagggcggagcccgtccacctctatatcaactcccccgggggtgtcgtcaccgcggggctcgccatctacgacaccatgcagtacatccgctgccccgtcaccacgctctgcatcggccaggcggcctccatgggctcgctcctcctcgcggctggggcgccgggtgagattttttttctgcccaacgccagggtcatgatccaccagccctcgggcggcgctcaggggcaggccactgacatcgccatccatgccaaggagattctcaagctgcgcg

SEQ ID NO: 19719 - DNA, 449 bp, Zea mays
  Clone ID: LIB189-034-Q1-E1-B12
tcccgggtggccccacgcgtccgctatgaacagacatcgaccatccatttgcaccgaacaatcaatcagattaaaagtctaggagcaaaggcaggagttgttttgaatccagcgactccactcactgcaattgattaggggcttgatgttgttgacctggtgctgattaggggggtgaatcctgcgtttggtggccagagctttatcgagagtcaagtaaagaaaattgcagaactgagaaggttatgtgcagagaagggagtgaacccctggattgaggttgatggtggtgttggtccgaaaaatgcctacaaggttattgaagctggcgcaaattctattttctcaggttctgcagtttttggggctccagactacgctgaagctatcaaatggaataagaccatccaaagacctctagctgtagccgcataaacaacttgacgtgt

SEQ ID NO: 19720 - DNA, 396 bp, Zea mays
  Clone ID: LIB189-034-Q1-E1-C10
cacgcgtccaccaaaacgtccgcccacgcgtccggattctctaaaaaagattgatccatcattggggagtcaccgtaagtccaaggtccttacagatgaatgtgcaaatggatcatctcaaatgagaggatgttcaagtggcaaggtgccaaatgaagggagtagccctcaagtctcatcagaagttgcctgtgatgaaaatgctatactgaaggttatggaattccttgcgttgccaagggcggacgccatccaactcctcatgcagtacaatggaaatgcagaagcagtcatccaacagatcttccaatagtgcttactgtattttttttactagtctgcttgctttcaaacgtaattatttgttgatacttttcttgccctgtacagaacatt

SEQ ID NO: 19721 - DNA, 429 bp, Zea mays
  Clone ID: LIB189-034-Q1-E1-C11
cacgcgtccgccaacgcgtccgccaacccactagctcaaaaccctaaagatctcgcctgctcgcctccgccgccagagcgagctccccatcttcatccgtcaaccatggcgacccagatcagcagggggaagaagttcgtcagcgacggtgttttcggggcggagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtacgatcagggagctcacctccgtcgtctttttttatgttcaacttccctgagaatggcgttgagctttatgccgagaaggtcctcaaccgtgggctctgtgccatcgcgcaagcccaattcctccgttacaa

SEQ ID NO: 19722 - DNA, 395 bp, Zea mays
  Clone ID: LIB189-034-Q1-E1-D11
cacgcgtccgctactgcacctgctggacggcttccgcggctccggcacagggttcgagccccgcgggagggaccccgcgctggtgaacaagtccaccgacttcctccgggaggaccacatggtgcggcgcgtgtggtaccaggcggagaacaagggcggggtgaggacggaggacggccggtgggtgctgccgccgcggcagagggtgctcgacgaccacccggaggacactgaccatcacctccagcggctcggtctcaccgcgtgaagctcagcaatactctgatagtagcgttaactactgcgtgtggcgttcgcctacttgttttttgcagtcggttcacctgttgccgcgcgcggcagctcagtggcgccttcatgccgtgcatgatgcc

SEQ ID NO: 19723 - DNA, 400 bp, Zea mays
  Clone ID: LIB189-034-Q1-E1-F11
tcccgggtggccccacgcgtccagcagcggccgtttgcctcgatgaggtcctctgggttaccagcctcgtgcacgccttccagtgggccctgcctgacggcgcggcggccgtttgcctcgacgaggtcctcaagctcggggtggagatgaagacgccgctcgtcaccgcagggggcccccgcaccgcctgatccgtcctgccgccgacgcgtcacgtcacgcgttgtttgcatggatgatggtatctttgtctgtctgtgtggtcttcgctaaagtttgcttcttctcgatcgtcggttcgttcgtgcctccaccttagcctagggtttggtttctttttttgtactgagtgtgtcatagtctcaccatcaccggggctccaattttggaaaactgcgtg

SEQ ID NO: 19724 - DNA, 411 bp, Zea mays
  Clone ID: LIB189-034-Q1-E1-G11
ccgggtggccccacgcgtccacgaacgcgtgggcggacgcgtgggcggacgcgtgggagaacgcgtgggcggacgcgtgggtgaaggagaagaagatgctcctatcggagctatgccagggtgctataggcttgggtggaggcacgggctgcttgacgaggtttacaggggcgcgcgatgttggtgttaatagttttgttctctttcctaaagttcccgatgcattgaagtctccaacaggagatgaagcgtacaacgataatggtctggttccacgtacaatccgcttgctcaaggacaagttccctgatattgttatctacacagacgtctcttttttttcttagtcatctgatggtcactatggtattgttacggaagatggggtaattatgaatgatgaaacacttt

SEQ ID NO: 19725 - DNA, 376 bp, Zea mays
  Clone ID: LIB189-034-Q1-E1-G4
gtccggaggaagattgtgctgtttgatagccaagtaggaagtgataaatgtcatggcattgaagttactcctagatggaatggtggacacgaatttgtactcactttaggtgacgctaggaggggtgtgaaggttacttggtcgatgggggatggacggctttaaatgggttcgcctgttcgttgttaagcatcatcggtggaagtgtagtagtgctcttgctctggtttgttgtctgaggctgttggagtctagataagtataacagtgttcacactatcatgcccgtcctgttatttagtgaaccttaatttgtctatatgttgctactcttgttatttattgaaccttactttattctagttgcattggaaaa

SEQ ID NO: 19726 - DNA, 424 bp, Zea mays
  Clone ID: LIB189-034-Q1-E1-H11
gtaccggtcagtacttcccgggtggccccacgcgtcaaataaatcagtcccagcagcgcaagcacgcagcccccaacacacgcctcttctcttcatcgctctggccacagggcatgcctgcaggcatgcctgcgacgtcgatgagctattggcaggggcttacgagttaggactcttcattctgatgggtgacagatcgttgtccttaagaatggtgtctacggcatcaaaggcataatataggtaggcaacatttctttttttctttctgacagctgtgtatttatgatgctattgggtatgcttgataaaatagtggaaccctaaaccccaaaaaaccctaaacccttattgtctgtttttgagctaatgtcacacatttggtacaagaaattctgtaaataaaattgcgaaatatggcaac

SEQ ID NO: 19727 - DNA, 385 bp, Zea mays
  Clone ID: LIB189-034-Q1-E1-H9
cccgggtggccccacgcgtccaccaccgcgtccgggcgaggtgaccagcggagggttcaacacgtgcctgaagaagaacatcgctatgggctacgtgaagtcgggaatgcacaaggctgggacggagttgaaggtggggggtcgcgggaagtcctacgacgccgtggtcagggggatgccgttcgtgcccaccaagtactacaagccctcgtacattatattcttgtacagagggacgccttgcgtttctcttttgtcgttgcggcttgttcttggcagattggttaagcattgcaactgtaacttctgtgagattgtcttacggttcacatttcatttttttctgcctaataagccttcttttcccaaatacaaagcatgcatg

SEQ ID NO: 19728 - DNA, 482 bp, Zea mays
  Clone ID: cC-zmle189097b08b1
tcttgatgatggagaagtcgctgcccaccatgacctaccgggcgtggaggagggacgcccagaccgggcctccgcagtaccagagcagcagcatcttcgagaacgccagtccagaggaggtgagggacttcttcggggacgacgagttccggatgtccaacaggtgggacgacatgctcatctaccacaagaccctggaggagtgccggaccactgggacgatgaaagtgcattgggtccggaagttccccttcttctgcagcgacagggagtacataatcgcccggcggatatggaagctggggggcgcctattattgcgtcacaaagggcataccatgctcatccattccacggcgtagcagacctcggagagtcgatctgtattactcaagctggtgcatccgcgcagtggagtccaggagagggaacggaggaggaaggggggcgacggcctgtgaggttctgctgttccaccacgag

SEQ ID NO: 19729 - DNA, 396 bp, Zea mays
  Clone ID: cC-zmle189097b08a1
gggcactcagatacaagattacatgtaacaaatttttacacatgtatatagtaggaaacccctctccctcgtgatccgacagccggcagcgtatacacacgtagacaccaaaacgctcttcgtccgctctctttcagccacaatggcatcagcaccaattacacatccacaaagcccacacaaaccacctccttcccccgcttctcgacgtcggcgatcagcacacggcacgaccgtacgagcgacaaggtgtgtgggacgctacaacgtcttcctctgcccgacgaacctccgcgcgacgccgaagatgagagccttggtcaggagcccctggtcaagggtgcagcaggccagagcgaccgcgccgccgagcacgaggagcctcgccgctgcgtg

SEQ ID NO: 19730 - DNA, 161 bp, Zea mays
  Clone ID: cC-zmle189097b09a1
atagaaaagccaaattgtcgtaaaaactcataatagtgatacaatgcaacaatacgccaggaaaaagagcaaagaaaacaagtgagcaatcgaatccttccctccaaaccaaaggccacgatttgacaggctttcatacacggggtaacgcttgatattga

SEQ ID NO: 19731 - DNA, 257 bp, Zea mays
  Clone ID: cC-zmle189097b10a1
acacgggggaacccttgaaattgaaaaaaaatggccctaaaaaaccacccgaacccgccccggggggagacccgggaaatccggacacggacctggagggggaccagggttccccaaagggaaacccaataaagctcgggggaaacaagggcaaaacctgattccggggggaaaaaggaaaccggaacaaatccacacaaaaatcgagccgggagaaaaaaggggaaagcccggggggcccaaagaggggggaaccc

SEQ ID NO: 19732 - DNA, 410 bp, Zea mays
  Clone ID: cC-zmle189097b10b1
ccacgcgttttgttcggaatgctttctaagtacatattaattcaatatcaagcgttacaccgtgtaaaaaaaaaaaaaaaaaaacaaaaaaaaaaaaaaaaaaaaaaaaaaaaaaaaaaaaaaaaaaaaaaaaaaaaaaaaaaaaaaaaaaaaaaggggggccgttttaaaggaacacaagtttacatacacataaatgggagggcattttttttttataggggaacttaaatccaattaattggccgtctttttacaacgttgggactggaaaaaccctgtggttgcccaacttaataaccttgcagaaaatgccaatttcgccagttggccaaataaaaaaaaggcccgaacaaatcgtttttccaaaaagttgtacaacctaaatggcaaatggaacccgcctttta

SEQ ID NO: 19733 - DNA, 362 bp, Zea mays
  Clone ID: cC-zmle189097b11a1
gggctactaaggggacaaaaaagctgggatttttaataaccctaccgggacaaccagaagattaaaaaaaacaatcattttgcctggttttgggaaaaaaaataggtttgggacactggcaccccccagtgccaaagccaaaaaacacaaaacatcccaagatgccaacttggtttagcaaccactacattacattttcatttttttaaaaaggccacttgggtcaggccaacaaagggtgatcaaccaaacctgccccaggggcgggaatccttactgaaggccgccattagctgtggtctttactttcgcacaacctatttatccatgcgaaaaaaaacccggaatggtgggggcccaaa

SEQ ID NO: 19734 - DNA, 478 bp, Zea mays
  Clone ID: cC-zmle189097b11b1
ccacgcgtttctgtcgagggagtagagcaaattgaatcagggttggtgtcgattcggaggctttcgcttctgcttgcggagttgcggtggagatttgaggcctgcggcgacgatggcacctgcggaatccggggagaaggcgaccagcttcgccatggcctgcagcctgctcagccgctacgtcaggcagaacggtgccgcggctgccgatctcggcctcgctatcagagctgaatccgatgcaaagaggacgtcgacggacatggaaaagggggagacggggaaggagaccatggatctcttcccccagatcgctggattcggctcggaggctgccactaaggaagcccctgatgcgagggagccagagaagcgccaactgactatcttctatggcgggaaggtccttgtgttcgatgacttccctgctgcgaaggcaaaagacctgatgcaaatggccagcaagggttcatccgta

SEQ ID NO: 19735 - DNA, 63 bp, Zea mays
  Clone ID: cC-zmle189097b12a1
atcacaagaacaaatccggatcccctttaattattgttccggatgaacgatccgaggaatgag

SEQ ID NO: 19736 - DNA, 401 bp, Zea mays
  Clone ID: cC-zmle189097b12b1
cgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggagg

SEQ ID NO: 19737 - DNA, 486 bp, Zea mays
  unsure at all n locations
  Clone ID: cC-zmle189097c01a1
atatatagnatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagtcgagggcggcctcgtcggactccgcccggggctcgacgaacttgggcgcgggctttttttccggggccacgccgaggacgacggtggcctgcgcggcggtgctcgtcttcttcaggtcagggtacttcttgccgcactagcagcttgagccgc

SEQ ID NO: 19738 - DNA, 479 bp, Zea mays
  Clone ID: cC-zmle189097c01b1
gactacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagaggtcttcagtttgctatctctctctgcatgtttggcgtcagtctttgtgctcat

SEQ ID NO: 19739 - DNA, 366 bp, Zea mays
  Clone ID: cC-zmle189097c02a1
gatgtaggtattagtattacgaagaagttttattcaggtcacgagcttattgtcgtaattcgtacaggagctgagtgcgtgcacgtacgatagccaagtacgatgaccctgcacaaccagtcaaccacagacatacataaggcacgcaggcaggcacgaacgggcgtggatgccggccgccgggcggctcagttagccctggcgaggaagctctccctgcgctcgtggacctcgccggtgcaggtgttgatgtcctcctcgaccctggtctcgcgcaccacgaagccgtggccgccgtggtgaccatggtggtggtggtggtggttggcgccggcgcgtgagaccgtgttgacctccttggacttt

SEQ ID NO: 19740 - DNA, 477 bp, Zea mays
  Clone ID: cC-zmle189097c02b1
cttactcgtccgagcaatccacacaagcacttggacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactggttgtgcaaggtcatcgtacttgctatcggacgtgcacgcac

SEQ ID NO: 19741 - DNA, 412 bp, Zea mays
  Clone ID: cC-zmle189097c03a1
ggaaggacgcatccaacatggtaaaaatttttacaggttacatcccaatccatccatgtgcagagcagaggaattacatttatacacggtgctgatcaccgctggagtgaaatgaaacaaggaccacacgactctacataccatgcagctagagaggaggatcggcaggagctatatatacgcatctttgatgatatctacttgaagaagtaggggaggtcgagcacgtagaggagaaagtaggcccagagcacgccggatatgccgccgaagaagaatcccccggtgaacttggcccaaccgtcggaggtctgcagcttggcggccttcttcttcctgccggagagcgtgagcttgggctccgtggacgggtccccttcgttgaaggaggcgacgccgtacatggtgaggc

SEQ ID NO: 19742 - DNA, 447 bp, Zea mays
  Clone ID: cC-zmle189097c03b1
gttgttaccctcctcagctagtacctaccggcgagtagtttttgcgtctgcaggcagatctgagttagccggcggatccgatccgtgcgcgtgctgctgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgacccgttcatcggcagcctggagacgccggtcacctccagcccgctcgtggcgtggtacctttccaacctcccggcctaccgtaccgacgtgagcccgctgctgcggagcgtctaggtcggcctcgcgcacggataccttctcgtggggccct

SEQ ID NO: 19743 - DNA, 344 bp, Zea mays
  Clone ID: cC-zmle189095h12b1
ttttattccaagtccccgctcttggattcccgacgacgagctcggagcttcttcttccctgctcggtgctcgtcgcaacagctgccgccatgtctgccgcgaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatcagctcaagggaagcagtgcaaatatt

SEQ ID NO: 19744 - DNA, 404 bp, Zea mays
  Clone ID: cC-zmle189095h12a1
ggcaaacacagcaaactattattattgaccgatttccataacattgttttgcttcaccaccaggaatcccagaaactgactgactaataatccaccaatagactcctaggacagatttattgagagcgactactccaaaataaactactagagtaaacagaacagctgcaagcctgcaactgcttgcaggagatccataacccagcacagacatttaggacaactacttgacgacaatgactactgctacggtggtgtcaacgctaatcttgctgctaagctattacaagacttcccagaaaccaattgaggagctcattcagaatgttctgaaacttgaaaggtgcaagcatcatcctaacatgaaggtccactccaccatctggtttacttgttggggggaa

SEQ ID NO: 19745 - DNA, 422 bp, Zea mays
  Clone ID: cC-zmle189097a01a1
gaacttcttatttctggttggccacatacatcattcaaaaaactttattattgaattacaactaataagcaatctaaaagagggcaccaccaatgatgtgttgttggtaggaggccgctgggtctgtcaaagcaagttggacaaagggcaacaattgttgtagttgtaagagggttgcggggttagccgcaaactgctggtagaaaggcagcaactgttgctgtgtcaagaaggaagcacggtttgctgcagctagctggctaaatggtagtagtatttgctgctgcaaataagcagcggggttcagtgcggtcaattggttaaatggaagaagttgttgttgctgagagtaggcagtagcttgcttgctgaatggtaatagttgttgctgcaataagcaacatggtttagcgtaaacagtt

SEQ ID NO: 19746 - DNA, 483 bp, Zea mays
  Clone ID: cC-zmle189097a01b1
ctttctcgtccgcccacgcgtccgcccacgcgtgcggggcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatt

SEQ ID NO: 19747 - DNA, 482 bp, Zea mays
  Clone ID: cC-zmle189097a02a1
ccgaaccctaggtttatttctcaaacttccgaactagcctttacattcttttaggagtcgagtcgcagatccttaaagttaacactctttgggttcataactataaatgctaagcagttttatcatataaccgcgctcgcgtggctcagagcatatacagtatataggataacactaaagtttcaaccttcgtccagattaggggtactgcgctcttcaaacagaactggagtttctcggggtcttcgtccaacatcgggaagaggtggcctcgccattatcctttgtcgaagctccccgtatccgatctcgccgtttcattctctttgcatacacattgatgtcaaagtcggccgtgtttcttccttcaaatatatgctccagctcgcccaggtcgaacatgtcgcccagaattttttggctctccgaactgcccgtgacacaaatttaactttttcgtacatttttggcccgacccgtgg

SEQ ID NO: 19748 - DNA, 471 bp, Zea mays
  Clone ID: cC-zmle189097a02b1
gtttattatggacgaaaaagtgaaatttgtgtacagggactgttcggagagccagaagatactgggcgacatgttcgacctggacgagctggagcatatatttggaggaagaaacacggccgactttgacatcaatgtgtatgcagagagaatgaaacggcgagatcggatacggggagcttcgacagaggataatggcgaggccacctcttcccgatgttggacgaagaccacgagaaactccagttctgtttgaagagcgcagtaccactaatctggacgaaggttgaaactttagtgttatcctatatactgtatatgctctgagccacgcgagcgcggttatatgataaaactgcttagcatttataggtatgaacacaaagagtgttaactttaaggatctgcgactcgactcctaaaagaatgtaaaggctagttcggaagtttgagaaataaacctagggttcg

SEQ ID NO: 19749 - DNA, 419 bp, Zea mays
  Clone ID: cC-zmle189097a03a1
aaaacaaaaatgggggttcccatatttccaatgaccaggactttatttgtgaccgggggctgggtacatcactttccccatgtttctgagacactgaaactttaacttgacaacatctaccttaggatttcataattggacaagagatgcacttaattagtaacacgctgcagcctgcaaaacacctaccccagcattcatcctttttatcccacgtgcactggaaataacccccttatttatcaccccgtacattgggcaatacaaccttattataccttgccgccaaaattgactccctacgaaaatacccaagcagcacaggcactgggtgccttttttattccaagcacacaaacctaagacgaggggaccatgctaccccctctttttttttttggaaaatgctgttgacggag

SEQ ID NO: 19750 - DNA, 482 bp, Zea mays
  Clone ID: cC-zmle189097a03b1
acttgttgctgcctttatattccgacatgcttattccgtcagaggatttgcgtattaacatggttgacttttcagccctcccgcgattgaaaggctttctggaggcgtctttgaggaagttattgtgacaaactccatcctgctgccggaagacaaatgcttccctcagctgactgtgctttcgatggcgaaccttgtgggggagacaatttggcatgttcatcgcgatggctccgtcagcagcatcttccaatagcagaaacgagcgcgtagcatcgtcacctcgtcttgcgttcgtgtgcttggtatagagaaggcacccagtgcctgtgctgcttgcgtattttcgtagggagtcaattttggcggcaaggtataataaggttgtattgcccgatgtacggggtgataaataaggtggttattgccagtgtacgtgggataataaggttgcattgctgtgtaggtgttctgcaggctgc

SEQ ID NO: 19751 - DNA, 307 bp, Zea mays
  Clone ID: cC-zmle189097a04a1
ggaagggaaaccaaccaactccaagcaaaaacctggtggggtttttatttcatgaagcaacagttcgtagtccaccagggcaaagcctttttatggatcaagattgttaacagcacacacattttttttcccccacaagtttgggtttaaccagcgccagatcaaaggcggtaaaggagtgtggagccagcttgacctgcatttgtttcgggggggtgtttagttggttttttaccggcgcaaccttgtttgggttactgaaggagtttttgtccatgacgttgccaaacgggaggaccggggcggt

SEQ ID NO: 19752 - DNA, 485 bp, Zea mays
  Clone ID: cC-zmle189097a04b1
aactttgtaaacgtgttttaaagtccctaaactggttgtatggtgcactacacatatctaaacttgtaaaatggtgcaccgcaggtccatttatggaccatactgaccattatgatgcaccacttaaaacaagtttaagggcctggaaatatgttttcaaagtgcgtagaccaaagtggccccaacaactttaggggctgctcatgcatttaactcgatattctttgtatagtcgtacacttgctaggtgaatatgctacgtagctggtttacatgtttgttcccacaaacctggtttcggagctggcttaaagccttgacggagctttgctgggttgaaattcgcctcagacaaattctttgttgtttccaggtattgctactattgcctacgcacacgttgttcggctacgacttcttacagatgcacacgttgtgacggggcggtggttgcaattcaaagactaggatcaagttagttttac

SEQ ID NO: 19753 - DNA, 258 bp, Zea mays
  Clone ID: cC-zmle189097a05a1
gaagggaacccaaccaacaccaagcaaaaacctggtgggggttttatttcatgaagcaacagttcgtagtccaccagtgcaaagcctttttatggatcaagattgctaacagcacacacattttatttcccccacaagtttgggtttaaccagggccaaatataagggggtaaaggagtgaggagccacgctgacctggatttgtttcggggggttgctcagctgggttttcaccggcgcaaccttgtttgggttaat

SEQ ID NO: 19754 - DNA, 504 bp, Zea mays
  unsure at all n locations
  Clone ID: cC-zmle189097a05b1
atttgtctgaacatctcgcagtggacctaagggtgttgcgagcgagtacgctgtctggagaagcgacgcgggtagaggcagtcttcttgcttcgttggctgaagctgctttcctcactggcctggagaagaacagtgatattgttcagatggcaagttacgcaccactcttcgtgaacgacaatgaccaaacgtggaacccggacgctatcgtcttcaactcctggcagcactatggaactcctagctactggatgcagacgattttccgcgagtccagcggcgccatgatccatccggttaatatcaggtcccggtactcgagttcgctggccgcgtctgcgatcacgtggcaagatgcagagaatagcttcctgagagtgaaggtcgtgaactttgggtcggacaccgttaacctcacggtctccacgagcggactcggggccagcgtcaacgcgctgggatcaaccgccaccgtccttacgtntggcaacgtcatggacga

SEQ ID NO: 19755 - DNA, 351 bp, Zea mays
  Clone ID: cC-zmle189097a06a1
cacttcaatgaacctcaatacaagtaagttgaactagatacgtgtgcacccaaacaagacctaggttaagaatttggggtccaaagaagcccaggaaaccagaacaatcggtaacctgtgttttggccagcaaggactgcatcagcatatataacaaacactacacatacacctgtgcttctccgggcaaatcttcataaacatagcgactttcatcgctcactctgacagtcgctgtgattgatcagttgccaactagagatgtgtccaagtcctaagccccccatgtggcagcaaaaaggatacctggaggtagtcatctcagagtgtcccttcaacctttttcttgat

SEQ ID NO: 19756 - DNA, 379 bp, Zea mays
  Clone ID: cC-zmle189097a06b1
ccacgcgtgcggtttcctctgccactcctcgcccaaagcgccagaggcgcagcccgagccacagggtgcctcctctccctctcctcgtggcctcgtccttctcgttcaagacgaaaccgtacgcgagcgagctggtgagggaggaagagcagggaggtgggatcaggccggctccatggacgccacgctcctcctcctccccgccaactgtacggtcgccgccagcgggcggatgcggcctctactgcctgcaggcccacatgtggcttcccctggtccctccgcgcggccaaggacctgcatccgggcctcagccgtgtgcgcagccctcgccgttcgtggacttccgcaacacgcttccgtggccgggcaaagcact

SEQ ID NO: 19757 - DNA, 115 bp, Zea mays
  Clone ID: cC-zmle189097a07a1
gcagatcaacactttattagtacaagctagcagcaccgtgcagcagccataatttaagtaggagtgtacaagatcacatggcaaacaaaccatccctgactgttatttctttttt

SEQ ID NO: 19758 - DNA, 116 bp, Zea mays
  Clone ID: cC-zmle189097a07b1
taataaagaaataacagtcagggatggtttgtttgccatgtgatcttgtacactcctacttaaattatggctgctgcacggtgctgctagcttgtactaataaagtgttgatctgc

SEQ ID NO: 19759 - DNA, 440 bp, Zea mays
  Clone ID: cC-zmle189097a08a1
gtgggtgtccaagtagtgtatgtgaggggctgtaaaatagggtgtttacatctagtgataactgaaaagacacggaaagatactgactactaatcatccatggatagaagaaaaaaatacgtaaaaaggtccaatgctacgacacaactcttggcctgaaagcccaaagcccattggaccaacagccacatgtgaatccctgagctagcatcgtatcatatcgctctgagcttgatctgggcaccatgcatcgggcgcagcattataactcggcgcggcgcatgggtatacgtcggcgcgagctcgaactggaagcgctgaaggatcatgctcagcgccatcttggcctccagaagggcgaagttctggccgatgcatatccgcgggccccagccgaaggggaagaacgccagcctatccttggacgcccttggcacccc

SEQ ID NO: 19760 - DNA, 434 bp, Zea mays
  Clone ID: cC-zmle189097a08b1
tcatatcgtacaaatgccacttccaggtccttgccagcgaaaaacaaccgaaggatgcgccaaatcaaaagcgagatcgactggattcttcggggcctgatcggtaaaagaatgcaagctatgaaagaaggtgagagcgacaaagatgacctgctgggcttgctgctggagtcaaacgcgagagagacaggcgatcagagcggccagcccggccaaggattgacgatggaggaagtcatggaggagtgcaagctgttctacttcgcgggaatggagacgacgtcggtgctgctcacgtggacgatggtcctgctaagcatgcacccggagtggcaggaccgtgcgagggaggaagtcctcggactgttcgggaagaagaacccaccgggatacgaccgcctgagtcgcctcaaacagtgaccatgatcctctac

SEQ ID NO: 19761 - DNA, 361 bp, Zea mays
  unsure at all n locations
  Clone ID: cC-zmle189095g12a1
ttttagtgacaaaangcaggtttgcactaagcatatgcatccatcacgcgggttcacagggtcagctcctatattaactctttatagtacactcagtgagaagaccagacactacacgtacgtaccggcgcttggccatctatcttacgctacagagctgcttaccgcttacagggactaaaatgccgcgaacttagctgctggttaaaataccaaaaggtaacactgcttgctacttactagcacaaggccgggactgggtacacacagatatttacaccggaaggcggggagagcaaattagcaataacaattggcagtaggtaaaccttggccttaacttgccaccaagaagcaacca

SEQ ID NO: 19762 - DNA, 305 bp, Zea mays
  Clone ID: cC-zmle189095g09b1
cctatttgtgcgcggacgcgtgggcggacgcgtgggcatttgtcctattacaacaacaatccttggcacatctaaccatacaaaccattgcaacgcagcagcaacaagcactgagccacctagccgtggtgatccctattgcctactggcaacaacagctggttgcattcaacccacttgctttggtaaacgtagctgcataccatcatcaacaacagttgcaacagatactgccagtgctcagtcaattagccatggtgaaccctatagcctacctacaacattaataacttttttcatctagc

SEQ ID NO: 19763 - DNA, 390 bp, Zea mays
  Clone ID: cC-zmle189095g12b1
tttctttgcaggtcggtggacctctctaaattcaccgactactgcgaactccaagcagagctggacaagatgtttgacttcgagggtgaattggtatctggcagccaaaactggcagatcgtctataccgacgacgagggcgatatgatgcttgtgggagacgacccgtgggaagagttctgcagcatagtgcgcaagatctacatctacacgaaggaggaggtccagaagatgaactcgaaatcagctgcgccaaggaaggaggaatctccggcagcgggcggcggaggaggttgcgccgccgccacaaacgagtagtatggtggtttgctcttggtggcaagttgaggccaaggttttactactgctattggtaatgctgatttgctc

SEQ ID NO: 19764 - DNA, 54 bp, Zea mays
  Clone ID: cC-zmle189095h01a1
aactttcttattttttttttttttttttattttctcaatatcttgggggtggtt

SEQ ID NO: 19765 - DNA, 313 bp, Zea mays
  Clone ID: cC-zmle189095h02a1
gctgattcttgcgggcagggcatctttcgctttttctttctcgggggcccagcaatttaaacacaaaaagccatcccgggtttcacgccgcaggttcctttggccagggccccccgccacatttatttttatcaaagacaaacaccctgttggattgggaccaaagggcccccgtaactagcggcccctggcaggcagaaagaagggccttttcaaccccaccgggcccccaccctgtcggggacccgggggtccaccccgaattttcggaccccctccttgggggcccccagcttgctttagggaggggttc

SEQ ID NO: 19766 - DNA, 302 bp, Zea mays
  Clone ID: cC-zmle189095h02b1
gtaccggcccggaattactgggtcgacccacgcgtgcgtggactttttgtcggacgcgtgggttaaaatgttccttctatgtatatgtaagggaccacaattaaggggacaggaggatagcaattagacaagttgttttactttgaataaaataactcatgtgctgagttctctgctaaatgaactgtaacgtgaaatcctttattgtatttctgattgaaattgctcgaacaatctaatataatatcttttttaatgaaataaataaaaactatttgtattaattaaggaaaccctaaaaa

SEQ ID NO: 19767 - DNA, 163 bp, Zea mays
  unsure at all n locations
  Clone ID: cC-zmle189095h03a1
ctatattatctttttctgtttacaanaacaaccgccgacagagggggagttgagattagactcgtgggttgagggcccaaccacatacagggcacaacccacagccttcgcgacgacggcgatgtactatataaggagccaacccacctacgggtgggggagg

SEQ ID NO: 19768 - DNA, 54 bp, Zea mays
  Clone ID: cC-zmle189095h03b1
tccacgctgtacgcggatttgataagcgaccaaccgccgtccgggggaccacaa

SEQ ID NO: 19769 - DNA, 379 bp, Zea mays
  Clone ID: cC-zmle189095h04a1
aaaggggggcttgtttttaaattttatttcgttcaaaaaattttgagaagggcaattcaagggtgggattttgatcctttcagttgttacaaattcatgccaatttattgatgtttagcaatggagttacaaattcatgccaatttattgatgtttagaccacgtaatggacaaatccttgtaatagctatgcttccttttatttacaggtgctaccggccttgtaggggtatatcaatcggtttacctccacccaatatccgttttagtccccaccccaattttatttcaggctgggcttacccttttttcaaaattggtgtccctacctgaaaaaaaaatcccttccctagaggggtttttttgttccacaattttt

SEQ ID NO: 19770 - DNA, 388 bp, Zea mays
  Clone ID: cC-zmle189095h04b1
accgttttgtttagagacatggcgcgccaccaccagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggggagctgtcgacggtgtgcccgtgggcggaccaggtgcgctggcactaccactgggccagcccgctccactacgccaacaccccccaagtctgcaacttcaagtattctcgggactgccacaattcttgtggccagcaagggatgtgcgtcggcggggctatcaacaactacacggacc

SEQ ID NO: 19771 - DNA, 328 bp, Zea mays
  Clone ID: cC-zmle189095h05a1
ttttgttttttaggctcgacggctacttcattttgttggaaggcactctttaacagacaaacttgcataacaaaacaagccaaaccaaaaacaaaaaaaaaacaaccacaggagggatctggtgatctaccaggcatgagatgagactacagcagcaagcttgtgtttcggattacaaaatgatccagggccttgccctggcacacgtggtaataaacacatggcagttcactttgagacgacatcgtcaccagcacccaccttgagacacaaccgaaacacaccggagtttctctccttttttttttttcccccgcctttttgtcag

SEQ ID NO: 19772 - DNA, 353 bp, Zea mays
  Clone ID: cC-zmle189095h05b1
ccgctccggaattactggctcgacccacccgtccgcccattgcttttcataaatgatttccccgatagctggggaatctcattgatggaagcagtggttgtcttacactgttatatgattagacgctgcttctttgtacctttggaagagatcctggtataatacctcgcaatactcatccttctgaacctgaatccattgatgggatcaatgatacacgagttcagactccacaacaatttcattcgccttgcacaaaggaaggtgatgtaaatggaaacagtgaacaggtaaaatactgagactactgacatgtgaaccgaacaccttgatgctaacactgtttcattatc

SEQ ID NO: 19773 - DNA, 405 bp, Zea mays
  Clone ID: cC-zmle189095h06a1
gcggccgcccctatcttttttttttgttgctttggcaaccactacaggttaatgcagccaccggggatcactagacataattcaaccactgaccaatatcatcatgtacaagacacatgaaaaatcaagctgccatcaagccaagcccacctaatcttgtccatcttttcacttgcaagtcacaccacatcccataatagacatatctctatctatttcaacttcagctgccttgttcttctcaggcacgtaatctttcttttcattcaagctttacaaattatagacgagaatgaacctggtaattccaaatggatggaccaaaactaaggtctattttggttaactgcaacagcaataaatagttcgtgggccagcttatgagcacatcaccattaacccacc

SEQ ID NO: 19774 - DNA, 379 bp, Zea mays
  Clone ID: cC-zmle189095h06b1
gatttttgtttcatgtacagccaaatgtgcagtctcgggaaaacatgatattcacagaccctatgcaagatggttagaaccatatgaacgattattacctggcatccagatttttagctcagaaccagggtcctctatctccttatgtgcagattccgcaacaacccagaaactcgcaggttataaatggtcactgggacgggtggagtgatttgagacaagggaataacgcttctatgtcagacatgtccaggatattatattcaagtgaagcgaacaagttgcataagctggtttcaaatgatgtccataacagaagcctttggaattgagaaccgctacttgggataatgtgcgactttgagctgacatgttcaac

SEQ ID NO: 19775 - DNA, 421 bp, Zea mays
  unsure at all n locations
  Clone ID: cC-zmle189095h07a1
atncttaacaaagcacaaaagaactaagacttgctaattcgttacaggacggcagcatataagttaaaacacaaaaagacaaccgtgtccaaaaccagcatggatccagcgtccaggggcaccgttcacatttattctcagcatagacaagcagcaaagttggtctgcgaccaaaggccattgggacgaccctcgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgttcaagatgctcgacctgctgtcaccggtgaagttggtggaaaccagatcctccttcacgttgcccataatac

SEQ ID NO: 19776 - DNA, 439 bp, Zea mays
  Clone ID: cC-zmle189095h09a1
caaacattaacacatgccgaattatcatacaaaccgcataagttacaaatacaaggtttacagtatgagtttgttggataccttgacattttctcacgtacattccatagctataactacaagcactaattccatggaaatccattgaattccttattttctacactcatgaacagtcattgtaaacaacgtgctaacttgctgcaagtgcagcacttattttaaccacgtacctcctagcattcggcacaatacataaatagaatattaacagtagaatcaattaatctgaatggacgatacagctgccgatacctcccttgttcttgggtcagcatcttccaatgagacaccacggcagtcttctcgaacgagaagtggcagaacgccagcagagctccaagcatttgctacagcattacttgcattccccaaagtc

SEQ ID NO: 19777 - DNA, 544 bp, Zea mays
  unsure at all n locations
  Clone ID: cC-zmle189095h09b1
atagaaagcagattgaagcacgcggtctccctcttactccagaggcactgctttcattgcctccattctcttcaatcacatttaactcagaggttgctaatggaacaatgactggagagaaatgtaaacctgaagtagccaaaactggacttgggtcatcagctgccatgaccacatcagttgttgcagctcttcttcactatcttggtgtcgttagcctctcatgtccaggacaatcttctggtgataatacaactacacgagaacttgacttggttcactctattgcccaaagtgcacattgtatagcacaggggaaaattggcagtggttttgatgttagtgctgctgtctatgggagtcaacgctatgtaaggttttctccagaaatactctcgtctcaggctacaggtgggactttcctcccagatgtagtatcagatattgttacacaaaggtgggatcatgagaataaacagttttattacctnctttgtgacccttttcttgggaaccggaaccggagatatctactccataatgg

SEQ ID NO: 19778 - DNA, 262 bp, Zea mays
  Clone ID: cC-zmle189095h10a1
attttttttttttaattaaatacatttttcttaattggggggtgttttattaaattatttttttgtttaaaaaacaagtgttaattataatattatatatcattttttgagacacccaaaaaaaggaaccccctccaatgtttaactcggggagaaaaaaaaaaatcgataaagaggatttttttcaagagaaaaacccataacggcccccgcccaaaaagaggaacttcctaaacgaagaaggggttgaatccacgttctt

SEQ ID NO: 19779 - DNA, 326 bp, Zea mays
  Clone ID: cC-zmle189095h10b1
gcagtacacctgcctcaagacgtggggcggcaggcccgagaacgttaaggcggcgcaggacgcgctgctgctgcgcgccaaggccaactccctggcgcagctcggcaagtacaccggcgatggcgaggccgcgacggcaaaggagggcatgttcgtcaagaactacagctactaattaaagactacggcgatacaccactcctgctgctagtacgatcctcgatcgggggcggtgccgttacaggtttcagttggaaaacatacactactgcaaattttactgctaccctgagtgaaaacatggaacggttcactggatttgggca

SEQ ID NO: 19780 - DNA, 244 bp, Zea mays
  Clone ID: cC-zmle189095h11a1
gaaaaaaaaaccgcctcggcatccactcaactcacaatccacggggtttgggcccatactttgggagccctgggcccccccgggttgaaaggctacatttgttttttgatttaccaccccactttaggaggccgggccctgatcttttttagggcttcctcgggggaataaacaccctttgaaacagcttggcgctcttccggaagcccgcttgctgaacccccaagtctcctctgggtcctgg

SEQ ID NO: 19781 - DNA, 384 bp, Zea mays
  Clone ID: cC-zmle189095h11b1
ctccctcgagggaataagcccgccgcgtgaagcttctttttgcatccgagtgcggattcacctccaatctgaccctagggccgccggcgccgatggagaaggtgaagaacatgcttaagccgcggacgacgccgaagtagcagttgcgcgagtggcagcgccgcctacgcaacgagtgccgcgtcctccatcgtcagatccgagatgcgcagagggaggagaagaacgtggagaaagccatcagggaggttgccaagcgcaatgacatgggatctgcaaaggctcttgctaaggaacttgtaagaacaagacgtgctgttaatcgtttttttgaaaacaggctcaacttaattcaaaattaaagcaccttgggaaaaatgccgc

SEQ ID NO: 19782 - DNA, 420 bp, Zea mays
  Clone ID: cC-zmle189095f11a1
ggtcaggagcagcattgtttgcgccagctccttcttgtatatccggttgtgcttctccttcttcttcgcggcggcgtccttcctcgacgccgccagctgctgctgctgttgctcctccttggcgacggcgtcgaggttcggcgcggagcccgtcctcgtcgcgtgcttcacaggctccttgggcggggccagcgcgatgaggtcgccctccgacgagcggcccgacttcttggtcaccacccactcgtacgcgctccccagctggaacagcccggagatcatcgcgttgaacttggtcacggacatggtgttctcgaagagcaggtacgggatgatgaaggggaacgacttgagggacggcaggatgttcagcagggacatcagggccgggacgtagcacaccacccaatcggggagctc

SEQ ID NO: 19783 - DNA, 428 bp, Zea mays
  Clone ID: cC-zmle189095f10b1
cggacgcgtgggcaccgaaccacaatggccacgttcctgggaagctcaccggcgctcctcgctcgtcccatcgccaagccgcacatctcctgcgcgcagaccccgcgcccggcaattgcccagaaccagacgccgtccagcgagcagccggaaccacagaaacagcggcactccgtgcaagcgcagccacagcaggcggcggcggcgaggccgaagcacgcgggcgtcgcggactccactgactggatagcctcgtcgttgacgcggcggtccggaatcggtgcggggctggcgtgggccggcttcctggccgtcggcgtcgtgtcggagcagctcaagacacgcttcgaggtcgcgcagcagcaggccaacaccaaggacgtggagcaagagcacgaggtcgtgttgcccaacgggatccggtacta

SEQ ID NO: 19784 - DNA, 421 bp, Zea mays
  Clone ID: cC-zmle189095f11b1
cttactcgtggggcagcatcggtggcattcgggtccaatgcagctattcaggctttgtttaccggacatcatcaaatgcaagattgcattttggaagaaggcgaacctgatattccttttcttcctgctccggaagctcatactgcctttctactccttcacgctgttctgcatcatcctcccgatgacgatgttcgtgccggaggccgagctccccgactgggtggtgtgctacgtcccggccctgatgtccctgctgaacatcctgccgtcccccaagtcgttccccttcatcatcccgtacctgctcttcgagaacaccatgtccgtgaccaagttcaacgcgatgatcttcgggctgttccagctggggagcgcgtactagtgggttgtgaccaagaagtctggccgctcgtcggag

SEQ ID NO: 19785 - DNA, 299 bp, Zea mays
  Clone ID: cC-zmle189095f12a1
aaaacaaaaaatggttattttccttcccgccaaaaatttaaagttcaatagttgcttggtgcttaaatcagagtctacgagataaaggtttaaaagcagtcttccgggctgcttcacaaggtcctaaaatccagcacacaacagtttcatgaagcattgcattgcaagggctttaagtcctattccagtttagatgtaaatataactttggcataaaccccaaggcggcagaggaagttctagcgggaaccaaggtaaaatcgctcatggtggtgcttactttcaagacaaaccctttg

SEQ ID NO: 19786 - DNA, 440 bp, Zea mays
  Clone ID: cC-zmle189095f12b1
ccatgcgctgttcagtagagaaaagcttccgcattgcttttctcccccacaagcagaaggctcgaaggaagttggcaagaaggaggaagatgaagtcaccacagtggcagttgacctcaacaagagtaccacaagcattgatcatgacctcgacacaattggtgagccaagggcttcctttcccaatgaactgtcgcccctgaagctgaaatcgcgccaaacaggcttcaaaccatacaagagatgttctgtggaagcgaaggagaatagggtgccggctagcgacgaggttggtaccaagaggattcgtcttgatagtgaagcatcaacatgagcgatttctacatggttaccgctcggactttctctgccgccatgaagtttatgacaaagttatatttacatctaaactagtataggacttaaagaccttgcaatgc

SEQ ID NO: 19787 - DNA, 243 bp, Zea mays
  Clone ID: cC-zmle189095g01b1
gctttttgatgcgaggtgtgtagggcccaacgttctcttaattgcttttgtgacatggggatgccaacaaaagagagatgttgaaaacttggggagatgcggacagtatgcggggacgctgacttggaatatgaaaggatccacagtgaactgatacaaaatctggacatttggtaaattaaggtgacatgaccacatcagctggtgcaggcttaaatgactaatgatggagctcgaagtcta

SEQ ID NO: 19788 - DNA, 88 bp, Zea mays
  Clone ID: cC-zmle189095g02a1
cggtcgctcttttttattttctttcttttttttaaggttattttttttttcattatttctttttttacccaccccaagttttcttttt

SEQ ID NO: 19789 - DNA, 450 bp, Zea mays
  Clone ID: cC-zmle189095g03a1
ctgtccttttttttttgtgtttatctccaggtacttcctttattccaagtccattccaaattacaagatgttgttttgggcccagcccaaccaaactagatgatctggcattacttacgtgtagaactgcagaaatgtttcagaaaactgatacagacaccgtacatgtacagtttacagagactcaaactagacaggtttcgtagccaagtaataacccagtagtctccttttgtaccgttatgtaccaaactcagcaacacacagaaattccgaggcaacagcgaagaccaagacataataggactactactagcagttacaggccactagtttccgccttcaaggttttggcgccgagaacaagttggggtaggagaaatacggatcgtccttcagagacggcgacctctgcggcacatgagacggcacatagtcctgtgtcttgtg

SEQ ID NO: 19790 - DNA, 442 bp, Zea mays
  Clone ID: cC-zmle189095g03b1
aatctttacttagcgggttgatgaattggccacacctccagtacctcccactgattatacgttcacaaaacaaccagaacaagtacggccaatctcttccgagagtgaggcaagtatcgacttggacgatgtactatctgctgctcagacagctgctgaatcagcggagcgagctgcgtccgcagcccgcgccgctgcgaaccttgtgcagctacgcattgcagacctaaagaagaattcaagggtctataacaagtacaccgacagtgctcaaaaggaaagccctcatcaggccgagggtacacagaaaccagtatttgatcaccaggacttcttcaccaacgagacacaggactatgtgccgtctcatgtgccgcagaggtcgccgtctctggaggacgatccgtatttcttctaccccaacttgttcttggcgccaaaa

SEQ ID NO: 19791 - DNA, 337 bp, Zea mays
  unsure at all n locations
  Clone ID: cC-zmle189095g04a1
cttataatcngctttatttaacaacttaagagacaaaaggttcatatttagctagcctcaaaatatgtttgccaggcacagataccgtatatgcatatggaaaggtgaaaatgggttgaactaaaactgagcaaagaaatgacattgacagattatacaacccatcatggaaaattcaactgcgacaagccgcagcaacttggaggacatcccatttagtatctgtgggaaagcttctcctgctctttgtaccacatggcgtattggtaggtgccgacgacgggggtgaggaggagcgtggcggaaatccagttctcggtgaccttgtggtggatct

SEQ ID NO: 19792 - DNA, 562 bp, Zea mays
  Clone ID: cC-zmle189095g04b1
ataatttcatatttctccagctgttccgccgagcgaacgacccactttccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctccttctcacccccgtcgtcggcacctaccaatacgccatgtggtacaaagagcaggagaagctttcccacagatactaaatgggatgtcctccaagttgctgcggcttgtcgcagttgaattttccatgatgggttgaataatctgtcaatgtcatttctttgctcagttttaggtcaacccatttttacctttcatatgcatataccggatttgggcctggcaacataatttgaggctagctaaaaatgaaccttttggctttaagttggtaaaaaagcaatatttggc

SEQ ID NO: 19793 - DNA, 277 bp, Zea mays
  Clone ID: cC-zmle189095g05a1
aattattatacctcagatctcgccgtcaagcgtacatgctttatcttagacttcgcagtggcgagctcgatcgatatatatgatgactagcatcagtactaaaataggattggatcagggacacacgtacggcatcgaccagagcaccatgcatggtccatggatcatatcatcattatcatggcttcatgggatgggaatggatcggagtacgtgcttaaccatgatcagtacacacgtatctcttggaggggcggtggtatcccgggtgaaggcc

SEQ ID NO: 19794 - DNA, 383 bp, Zea mays
  Clone ID: cC-zmle189095g05b1
gacgatttttatagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgtcgcgcccaggccgtccaccgtctacatggtcgtccgcgcctccgtctacgccgatgagctcgtgaagaccgtgaaaacgatcgcgtcgccggggcggtgcattctggcgatggaccgagtgaacgcgacttgcgggaagcg

SEQ ID NO: 19795 - DNA, 204 bp, Zea mays
  Clone ID: cC-zmle189095g06a1
ctcctctttttttaattttctttttcatataatccaaaccaagagcaatggtggggccactttaatgaaccgctaccatttagcacacaagaattccaagaaaagccgccaccaaaaataaaccccaaaaccaactgcccggcaaaccaactaagccatctacgggaacaaggcgaaatcccctcacccatcgacccacacaag

SEQ ID NO: 19796 - DNA, 175 bp, Zea mays
  Clone ID: cC-zmle189095g06b1
tctcctccttttgcatggttggaagggcctgctgctaagggcgcgatggcctggaatggatgctgttagcaaagatgctcaaaagatgacatttcgctagttatttaattaagtctttcaaggcgtcaatcttcctgacatgtatctttattcgaaaaaaacaaactggattatt

SEQ ID NO: 19797 - DNA, 368 bp, Zea mays
  Clone ID: cC-zmle189095g07a1
ggccgagaattttcagtttcctttgtgttcaaatttacatgagggactagtgtactgttggcccccaaattatccattcctttacatcaaggagcaatacctttgaagacccgaaataaggcttttcttcaaaatgcctatgcccagagagctaataccgacatagaagcagatccaagcaccaaggcaatgtaacacgccttcttcagcttcaaagacgctgacatcatcttgttgtggaaaaaatcaagagaaactaggtcgactagcgccatatagatgagaattccagccgaaagtgaaccaaggatcccttccattattaagggatttggattgctatcgtcgtagccagtcatgtggaacac

SEQ ID NO: 19798 - DNA, 248 bp, Zea mays
  Clone ID: cC-zmle189095g07b1
tctacttgtccgcggacgcgtgggcggacgcgtgggcacgcttattttggcgcccagcacgaaactccctacgcccggatcccgaagaaggtccccgcggtcgaactcggcggggaaatgagccctaagacgtccgctttcttgggcgacgacggacaagaggacctcgtgccgtacgccgtcaccaacggcgcagacccggaccgcgactacgtggcgctcttcgtacccgagaagggcgcccgcag

SEQ ID NO: 19799 - DNA, 269 bp, Zea mays
  Clone ID: cC-zmle189095g08a1
agtagaacgaagaagttttatcaagggaacgagcttattgtcagaattcgaacaggagctgcatgcgtgcacgtacgatagccaagtacgatgaccctgcacaaccagtcaaccacagacatacataaggcacgcaggcaggcactaacgggcgaggatgccggccgccgggcgggtcagttagccctggggaggaagctttccctgcgatcgtggaccttagcggtgcaagtgctgatatactcctcgaccctggactcgcgcaccca

SEQ ID NO: 19800 - DNA, 357 bp, Zea mays
  Clone ID: cC-zmle189095g08b1
tttagtaatccacacaagcacttcgacgtcgcacgggcgctgcactcagacacaccaagcgtcggcaccaatggcttactaccaggaggtggactactgctcggaggaggtgaggcccatggtccctgtcggcttcagtcgacacggaggcggcgtccaggagtacgtcgtcaaggagaagttcgtggaggtcgacactgtattacgcgccggcgccaaccaccatcaccaccaccatggtcaccacggcggacacggtttcgtggtgcgcgagaccagggtcgaggaggacatcaacacctgcaccggtcaggtttactgagcgcagggagagctttcttgccagggttaactgag

SEQ ID NO: 19801 - DNA, 384 bp, Zea mays
  Clone ID: cC-zmle189095g09a1
aattcttggttcttttttgtgtgttttgtgtttttttttttcttgctttttttgtctttttctcttgtcgttctttttttaaaaaccaaaaaagaatttgggattttttgggggaaccccggcccgtgtggggggccccctgtgcgggcccccttctttggtaacaaaaagggggcccccccccccgggggggggcggcccccccgggggggggctccaaaaaaaaacgggggggggggggaccattgggtgtggcggggggggggcgcccccccggggggccccccccctggggggaaacacacccggggcccgctgtgggggcccccccggacatttcccccccctctggtgtgaacagggaaaacttgtccggagagcccg

SEQ ID NO: 19802 - DNA, 346 bp, Zea mays
  Clone ID: cC-zmle189095f01b1
cggactcgtgggggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacattaccgttaacga

SEQ ID NO: 19803 - DNA, 464 bp, Zea mays
  unsure at all n locations
  Clone ID: cC-zmle189095e12b1
attcattccaggcatgaaaaagcctttaaagaaacgagtggcggcgatcttggagccggtagaagagagcctacctgaagaaaatggactagcatcagctgaagatgatgaagatggttcttctgatgctgacaataatgatgagcttgtgcctgctgactctacgccgaagctggacctgcaaagcgacaagaagaaaggaatccaagtgcagcttgacctgaagagcaatggggacggcccgcgcgggaagaaggcgcctgctgccaggtcaagagcaaccgggtcaggtgggaaggccgcggcgggaggaggttcggctgggaagaggaagaggtaaatgagacattcggcgcctgcccacagttggccggtggttagtttggacgcacagatcccttggtaataaggagcagggngtgtaagcttcaaaggtttgctcatctaatggcacatgtaagcac

SEQ ID NO: 19804 - DNA, 212 bp, Zea mays
  Clone ID: cC-zmle189095f02a1
ggatcctctagagcggccgtcctatacttactttttctgttcaagaattaccgggttttggatatagaaagagctgacaatatatactcaaatattacgcaccgaaggacacaaatagcgagattactgtatgaattacaaacaccgtgcaatacatttggtaaaagctataactaaaaacctcatgtctgtaaaattattacgataaaaca

SEQ ID NO: 19805 - DNA, 349 bp, Zea mays
  Clone ID: cC-zmle189095f03a1
gtgcttgtatatcgtcatgcgcatgtcccacgacgagacgggagtataccacggtgtagtagtattatattaatacgtaattaatatagtatgtccacctttgtttgatactactaagggctatgtattgaggcacgcgtcccattgttttgtttttataacacttgtgcgatggttgcagaggactagccctctttttttttggtaagatgtctgtattattattaaaaaaaaaaaaaaaaaaaaaaatttaaaaaaatagaaattaattaaaaaataataaaataaaataaaatttttaatccccggtattctcgcacccggttcctgatggggttccaatttttcc

SEQ ID NO: 19806 - DNA, 332 bp, Zea mays
  Clone ID: cC-zmle189095f03b1
aggataaacccagtccttgtaacaaagaaggggcggtctgtgactaagaggagcggccgtcaagggttcaaaaaccgaacaaaaggaaccgctgccgctatcaaaacggcttaatagggtcaaacaaaggggggcaccctattaattaaacgcgtgacacggacactcccccccccgggtattccccggtccgggatgggaaaacgggcttaagtagatacacgcccctttaaaaccgtgggcccccccctgaagggaccccagctttcctcccggggttggcgactgatataccttatataggccccataattaaacccccggcccatttt

SEQ ID NO: 19807 - DNA, 382 bp, Zea mays
  Clone ID: cC-zmle189095f04a1
ttttactagttaaaggtttaaaagcagtctaccgggctgcttcacaagttctaaaatacagcacacaacagtttcatgaagcattgcattgcaaggtctttaagtcctatactagtttagatgtaaatacaactttgtcataaacttcatggcggcagaggaagtccgagcggtaaccatgtagaaatcgctcatgttgatgcttcactatcaagacgaatcctcttggtaccaacctcgtcgctagccggcaccctattcttcttggctttcacagaacattttttgtatggtttgaagcctgttcggcgcaatttcagcttcaggggcgaccagtcattgggaaaggaagcccttggctaccaattgtgtcgaggtcatg

SEQ ID NO: 19808 - DNA, 442 bp, Zea mays
  Clone ID: cC-zmle189095f04b1
gcagcttcttttcagctggtgacactaaccaccgcagatttagaagcagtggaagcacgagtgattcatggaaggaagtttccgaagagggtcgtctggctttccatgcgctgttcagtagagaaaagcttccgcaaagcttttctcccccacaagcagaaggctcgaaggaagttggcaaggaggaggaagatgaagtcaccacagtggcagttgacctcaacaagagtaccacaagcattgatcatgacctcgacacaattggtgagccaagggcttcctttcccaatgaactgtcgcccctgaagctgaaattgcgccgaacaggctttaaaccatacaagagatgttctgtggaagcgaaagaaaatagggtgcctgctagcgaccaggtttggaccaagaggattcgtcttgatagtgaagcatcaacatgagcgat

SEQ ID NO: 19809 - DNA, 319 bp, Zea mays
  Clone ID: cC-zmle189095f05a1
atctgtgtgggttttttttttttttttggtggttttctttcttgacaaacaaagccccccgagggggggggattttaatttacttttcccaaaccccctgccaaatggccgattctttttttttccacatggtaaaattggcccagatctcccccttgggccggcccccgagggggaattataagggggcggaaatccccattgcttagggaaaccaaccccttcccttttggttttcccatccaaaaatgtaaaaacccccccctccggaagctgattattggggggcccctttcaggggaagaaaaagaaaccccct

SEQ ID NO: 19810 - DNA, 440 bp, Zea mays
  Clone ID: cC-zmle189095f05b1
ccaagtgtagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgcttattcttaccatgaagggcatcgccgccggcatgcaaaacactggctaggcggcttctcttcactcacctgcaga

SEQ ID NO: 19811 - DNA, 291 bp, Zea mays
  Clone ID: cC-zmle189095f06a1
gcgatatacacaaaggttgtttttctttatacacacaatttatactaacatacatacatgaacgtgcacgaaagggaaaccctgagcaaggaaaacacccaagaacgccattagttcacaaggagcttaaatcccagcagacaccagttataaaaaaggattagcactggaagggctctaagagctataccagtttaaatggaaagataacctttgtggtaaactttatggcggcataggaagttcgagcggtaaccatgtaaaaatcgctgatgttgatgctttacctat

SEQ ID NO: 19812 - DNA, 489 bp, Zea mays
  Clone ID: cC-zmle189095f06b1
agatattacttggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagcttcccgttgcagtcctgcgtgatcgagttcttgagcggcgacatctggtgcatgctcttgacgactgatggcgttcttgggtgttttccttgcttagggtttccttttgtgcacgttcatgtatgtatgttagtatgtattgtgtgtataaagatctgcgagctttgtgt

SEQ ID NO: 19813 - DNA, 366 bp, Zea mays
  Clone ID: cC-zmle189095f07a1
ctttttctctttttgccctatatggtttctaattaaggggggcattttttaaaaaaaattttgaattgcggggccaatggatcccattattccgttcattcaaaaaataagccggtcctccatccgaaagggcatgttttttggccaagggcacataacgctttcggcgtataggtacaggatttttttttttacgaacttttacattcattggtactagggctactttctgaagaagtatttgcagggtttctgctgatatggggactattatagcatacgggacagcagggggagtagccaacactggtttttgcattggagggggccccaaatgggctcttgcttgggaccaacgccaacccc

SEQ ID NO: 19814 - DNA, 391 bp, Zea mays
  Clone ID: cC-zmle189095f07b1
gcttgatgagcctacgaatcatgtcgatttgtataccattgagaggctggagatgtatctcaagacgcaggatgtgccgatggacattatatctcatgacagggcgttccttgatcagttgtgcacaaagattgtggaaactgaatttggtgtgtccaagacatacaagggtaactattcagagtacattctagcaaaggcggtagcagtggaggcacagtatgctgcgtgggataagcaacagaaggaaattgaacagacaaaggagctgataaacagacttggtgctggagttaatgcagggcgtgcttccagcgagcagaagaaattggagaagcttgaaaaagaagggttgattgagaaacctttccaaaggaagcagctcaagatc

SEQ ID NO: 19815 - DNA, 388 bp, Zea mays
  Clone ID: cC-zmle189095f08a1
ggatatagaaagatctgacaatatatactcaaatatcatgcaccgaaggacacaaatagtgagattactgtatgacttacaaaaccgttgcaatacattttgtagaagctatgactcaaactttggtttcaaaaaaataggtcgatgaaacagccaaaccagctgcatcgtaagttcggacaagccgctgcctctttccaggtgattccatccaacaaaactctaaatgaaaagaatctaattgggaaatagatttgctaatgtctgatggatatcccatgtacatcccaccaggtagcaatgttatttcatatcctccatcaaactgaagcaaggtttcatttgctgatcctgtccagttgaccgtttgtgttgtaccggttccgat

SEQ ID NO: 19816 - DNA, 467 bp, Zea mays
  Clone ID: cC-zmle189095f08b1
gaattgtgcacaatcatttaaacactattcagtttgtaccaagagtgccagcagtgataggataagtacagtacttggaagatgggagggtcattctgtgactaagaggagtggggtgtatggagcaacacttgctgaagcagatacagctgttgttctcaaaatgggctctaatggccaattgattcaggatactttatcaactaaaatcggaaccggtacaacaacaacggtcaactggacaggatcagcaaatgaaaacttgcttcagtttgatggaggatatgaaataacattgctaccttgggggatgtacatgggatatccatcagacattagcaaatctatttcccaattagattcttttcatttagagttttgttggatggaatcacctggaaagaggcagcggcttgtccgaacttacgatgcagctggtttggcttgttcatcgacctatttttttg

SEQ ID NO: 19817 - DNA, 371 bp, Zea mays
  Clone ID: cC-zmle189095f09a1
ctttttctctatatacaaacgcaccacacactaggggacgggttgtatttgaggaggtcatctcagcactcaccacctttaagaacttcatcacaaaaagcaggagggggacccagagggggcttggacttcaagccgtccccccacccaccttgatgggcaagacacagtcggaactaaaaaaaaggacgcccgcccaacaatgaggcagcggcgggccacaaacacttacagactaagggaaagcccccccggttagcacaaatcgggaaaggggaggaggaacaaagccccccccttgatgtagtaaaaaaaaaaaggggggataagaggaaaaaaaatggggggtccaggatgagaaaccccccccc

SEQ ID NO: 19818 - DNA, 402 bp, Zea mays
  Clone ID: cC-zmle189095f09b1
atttcttctagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgccttgagttcaaaaagctcgggttcgtgtaccgggagaacttcaccttcccgtgctactacgacggacgctacttgaccatgtggaagct

SEQ ID NO: 19819 - DNA, 450 bp, Zea mays
  Clone ID: cC-zmle189095f10a1
ttgccgtcgccgaacgtgttcacaaacgcctccccgccgctgccggccacccggccctgcaggtcggtcaccaccaggtcgcccggccgcgggacgtccccgccaccgacgcgcatctcgtagtaccggatcccgttgggcaacacgacctcgtgctcctgctccacgtccttggtgttggcctgctgctgcgcgacctcgaagcgtgtcttgagctgctccgacacgacgccgacggccaggaagccggcccacgccagccccgcaccgattccggaccgccgcgtcaacgacgaggctatccagtcagtggagtccgcgacgcccgcgtgcttcggcctcgccgccgccgcctgctgtggctgcgcttgcacggagtgccgctgtttctgtggtttccgctgctcgctggacggcgtctgtttctgggcaattgcccggcgcggggtc

SEQ ID NO: 19820 - DNA, 282 bp, Zea mays
  Clone ID: cC-zmle189095d11a1
gagagtaaccccggttacagcgaacggagttcctatataccgcacatgcccatcccatccggcaatagattgcaccatggccctcgcacctttccagcatgacatgggcaaaccgtatttggcataccggaccggtgaatgtaccctctatcgcaaccaactgtggtgacaccctccagttggaccaggggatcaatgcattcacaaagccccctaccggacaaagacaccacgtagaccatcgtctgatggaacggccaaaggtatttcaaacccccacct

SEQ ID NO: 19821 - DNA, 489 bp, Zea mays
  Clone ID: cC-zmle189095d09b1
gtccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttctttcattcaaccaactggctgcattgaactttgctgcttatttgcaacaacaactaccatttaagcagctagctgcttgctacccccagcaatttttttc

SEQ ID NO: 19822 - DNA, 233 bp, Zea mays
  Clone ID: cC-zmle189095d11b1
ttcactatctgatctacgccagagtgcacggagccatgggggtttcactacatcgcgttgcgaggattattacggatggagttgcagaagggccgccgaaccgtgccacaaagcaaggaccttcaggacatgctcatggcgcaacgctccaaaccggcctagaacgaaaacaggagactgtacacggacataaaaactgaacgcacaggcgacggaacctaccatgacgacac

SEQ ID NO: 19823 - DNA, 409 bp, Zea mays
  Clone ID: cC-zmle189095d12a1
ccaaatctctataaattgctataaattgcaggtacaaacagatggattaaagctgctgcgaacaagtaatgttaaagaaaagcaagtgttggcgtataaagatcaatcagcatgtcctaatctcttctgcccattgttggcgcagatcaaggtatctggatgttcaccaagttacggaagatacaaaatttttccgcctgagcatattgctcttgcgttattcaacggccaaaggaaaatgactatttctataactcgcgtttaaattattaacagccaaggttgggaaaaagcagcatttgtgaaaagcttcaagcagccttgttcttgcagtatttctccagccactccatggtaacactttttggcctcttaagtggcaagccaagggcacggtcccagatgagct

SEQ ID NO: 19824 - DNA, 447 bp, Zea mays
  Clone ID: cC-zmle189095d12b1
ttcactcgtccgcggagaattttcaagagtgggaaatcaatagaagccgataattctttggactatgcggcaaatttctcacacatgcttggttttgacgaccaaaaaatgctggagctgatgcggctctatgtaacaattcacactgatcatgaaggcgggaatgtcagtgctcatactggtcatctggttgggagtgctctgtcagatccttatctttctttcgcagcggctctaaatgggctagctgggccactgcatggccttgcaaatcaggaagtgcttttatggatcaaatctgtaattgaggaaactgggagtggtgttaccacagatcaacttaaagactatgtctggaagacactaaagagtggaaaggttgttcctgggtttggacatggaggtctgcgtaagaccgacccaaggtatttatgtcaaagggagttt

SEQ ID NO: 19825 - DNA, 578 bp, Zea mays
  unsure at all n locations
  Clone ID: cC-zmle189095e01b1
cgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagaagaacagagttttttaggttgctatctctctctgcatgtttggcgtcagtctttgtgctcatgtacgtacgtgtgtctacctgcatgttggntgatccgattgaatttgttgtaccatatattacttgtccacgatgatatgatttgaactatataatactaa

SEQ ID NO: 19826 - DNA, 132 bp, Zea mays
  Clone ID: cC-zmle189095e02a1
aaaaaaaaaaaaaaagaaaaaagaagagaaaaaagaaggaaaaaaaagaaaaaaaaaaaaaacaaaggaaaaaagaagaaaggaaaaaaaaaaaaagaaaaaaagaaaaagcaagaaggagaagaagagaag

SEQ ID NO: 19827 - DNA, 259 bp, Zea mays
  Clone ID: cC-zmle189095e02b1
tccactcttttgtacaagcgcggatggaagaagttctacgcgctctttcttgcagtatgcgtgtcacacatcgacggatggctcaagagatccaaacaccctattaacattataaaggttatgacttgctgtcacaagataggacattatgtacgttaacatcttttaaggttgacacatttagcaaaattatattcatgcacttttgttgttagcgccataaaactgtttctcctggtacgaagccatatatgtatta

SEQ ID NO: 19828 - DNA, 427 bp, Zea mays
  Clone ID: cC-zmle189095e03b1
tgttttttttttttatgcatggcgaaaaggagccttggaatggtcttaactgaatattcagaaaaaaaaaaaaaagaaggaaaagattccattgagacaattatgagtttgattgagtttccgttactcgaccaaacaagttccaattccgttatttcaactacactaaacgatctttcaaattggtcaagactctcaagtttatggccccttctatatggtaccagttgttgtttcattgaatttgcttcattaataggctcacgattcgactttgatcgttatggattggtaccaagatcaagtcctagacaagcggacctaattttaacagctggtacggtaacaatgaaaatggctccatctttagtgcgattatatgagcaaatgcctgaaccgaaatacgtcattgctttgggagcctgta

SEQ ID NO: 19829 - DNA, 447 bp, Zea mays
  Clone ID: cC-zmle189095e04b1
cccacttgttcgagaacacacgaccgcgacggaatcgcgaggggtttgcgaggcggcgaccgagggaggagcagtcgagcagagcgtagggggcgcgagggatggacgcgaacgggtgcggggagaatgacgacgcgcgggcgccgctcctggccgggcctgggcggcggcgcaactccgtcgcgtccatgcgcggggagttcgtgtcgcggttgcccaagaaggtgctcgacgccgtcgaccccgagcgcccgtcgcacgtcgacttctcccgctccaagggccttctcgaaggggagagagagtactatgagaaacaatttgccacattgaggtcctttgaggaagttgactcactagaagaatccaatgaaatcaacgaggatgaggagcttgcggagcaaatccagagtgaatttgctatgaaaatatcaaattatgcaaaca

SEQ ID NO: 19830 - DNA, 442 bp, Zea mays
  Clone ID: cC-zmle189095e05b1
acatgtttgtgcgccgtgcgcgtggaataatggaacagatcaagggcatggacgcgttccagatggcggagctgatgcggaagagctgccgggagacaaacgacaccgcaaaggcaggcgtccagacgaactactacggagtgaagaacgtgaccgaggcgctgctgcctctgctcctgcaggcctcctcctccggcggaggaagggtcgtcaacgtctcctccgacttcgggctgctacgctatctcaggaacgaggaggtaaagcatgagctggacgacattgagggcctgacggaggagaggttggacgagctgctgagcacgttcctccgggacttcgaggccggcgcgcttggagcccgcgggtggccgacggagttcgccgcgtacaaggtggccaagggccgcctgaactcctactcgagggtcctggcgaggcg

SEQ ID NO: 19831 - DNA, 366 bp, Zea mays
  Clone ID: cC-zmle189095e06a1
aaaaaaagaaaagaaaaggagaaaagagaaaaaaaaaaaagaaaaaacaacaaaagaagagaggagaaaagagataaaaaaacaaaaagaaaaaacaaaagaacaaagaaaaaaagaaagggaaacgaggaacaaagaaaaagaaaagaaagcaaaagaagaagacaagaaaacaaaaaagaaaaaggaagacacaacaagaagaaaaaaaaaaaaaaaaaaaaaaaaaaaaaagatgaaaaaagaagaaaaggagaaaaaacaaaaaagaaaaacaagaagaaaacaaaaaaaaacaagaaaaacacaacacggaaaaaaaataaagaaagaaaaacaaaaaaaggagaaaacaagggaagagac

SEQ ID NO: 19832 - DNA, 422 bp, Zea mays
  Clone ID: cC-zmle189095e06b1
cccactctttctgagcgctgaacgagaacgagcccaaaaaacgcttctttaatgattgcgatcacctgtgtgagcatggatgcgctgcgaagggggactgggaaaggtatccatactatctacagatgcttgatgagagcaaaagcatagacgaaatccagctactgacatttggaacaaaaagagaaggggatgtcacgtacaaaacaggtgtcatgggggagaagcaagcaaagcctttttttgaactcaagaagcacaggagggtgtctagaaagcatattaaccaaccgattattgactaagtcaaaaacgatgttgatgacctcgatgatgactaccagtttgacgtcaagcagcgaactaggaaatgataatcctttaaaatctgaagatctaacggaatgaaagaacctttgggt

SEQ ID NO: 19833 - DNA, 405 bp, Zea mays
  unsure at all n locations
  Clone ID: cC-zmle189095e07b1
gttataccggccacacgcggcctccgaagttgctacgctacgctagtgttgaatattcgtgaaggctagtgttgtgcagctggtggatgggtcgcacaagatgttggttgggaaattcggagcttttcttggtacagatacacgacggtaaaggaaatggatattcaattgtgtagtagtcagaaagccgtctctcgctggactcggaaaaaaaaaggagaagagaacttacaggtaactgtagctgtgatctcgtttcaagcctcccggttggatgagatcatgagaatgagatgaggactgcctcaggatcggaaatgcangcaagcgagagacggcggctggcgtctggcgcttgaaaagatctttggaaaacggcttttggagcgagcaagagacggcagc

SEQ ID NO: 19834 - DNA, 430 bp, Zea mays
  Clone ID: cC-zmle189095e08b1
cggactcgtgggcgagaacgtctacaactcgctcacgggcaccgaggtcgccaccgtcacctccgtcgtgcagctcgagtcgcaggacctggcgcagatcgcgcagcacgtccagaagatgaccggcgcccagaacgtccgcatcaagacgcagctcgacccggagctcatcgccggcttcaccgtgcagtacggccgcgacggctccagcttaatcgacatgagcgtccggaagcagatcgaggagatcgcgtccgagttcgagttgcccgccgtcccgctcgaagtctgaccggcccgaggcgtcctctatcctcgcccatgagatgctttggtgcttcctgctgcctctctccctgctcttcatgtgtaccattctttgattgaatatttgagtgaatggtgaatactgcatacctggatttcagga

SEQ ID NO: 19835 - DNA, 499 bp, Zea mays
  Clone ID: cC-zmle189095e09b1
ctatcttcgcgcgggtatcggagcatggcgtctgcggcggcggtggacgccggcgacgcgccggagcccacggtgcggaacctcctagaccaggagtccctcaagtgggtcttcgtcggcggcaagggcggcgtaggcaagaccacctgcagctccatcctttccgtcctcctcgcgggggtccgccagtccgtgctagtcatctccaccgaccccgcgcacaacctcagcgatgccttccagcagcggttcaccaagtttcccactctcgtccgcggattcaccaacctctacgccatggaaattgacccgaaggtagaaaatgatgatttagccaatgaaggaatggagggattcctttcagaactgacaaatgcgattccaggagtagatgaagctatgagttttgctgaaatgctaaaattagtccaaacaatggattactctgttgaagtttttgatactgctctacaggggatacattgcgggttgtttagtt

SEQ ID NO: 19836 - DNA, 390 bp, Zea mays
  Clone ID: cC-zmle189095e10b1
ttttatatgtacaacgagtggccattcttcagggtcaccctttacctgctggagatggttttcgccaagggagaccccggcattgccggcttgtatgacgagctgcttgtggcggaagaactcaagccctttgggaagcagctcacggacaaatacgtggagacacagtagcttctcctgcagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaac

SEQ ID NO: 19837 - DNA, 128 bp, Zea mays
  Clone ID: cC-zmle189095e11b1
atatatttaaaaaaaaaaaaaaaaaaaaaaaaaaaaagggaattatataaaaaaaaaatactatattataaaaaccaaatgggtgcggccgttctattggctctctgcttccgttctgtgtgcctgct

SEQ ID NO: 19838 - DNA, 423 bp, Zea mays
  Clone ID: cC-zmle189097a09b1
tgcgtgtcggcgctgcgcaaccggctggggcggggcggggtcaaggacgaggggctcacggtgccccgccggcaaggcgccgagggcgccatctgcaccaacgtgctctccgcggacacggactcgctctcctacgcccggacgcccgccgagctgctcagcatcctctacctcaccggcgacgagcgcgtgcccggcgggttctatccggagggtgccaacgggaggatcgccaggtccttcttggcaagccacatggaaactagccaatgcaagctgcccgaggccatcagtgccctgcgtagcgtactacgagtgctgcgtgcatgatttgaactacgtgtccgtgcagaaacccggagcatatatatggttggatgaacttgcaaagtttgctgaataatataacagtggattgatatc

SEQ ID NO: 19839 - DNA, 196 bp, Zea mays
  unsure at all n locations
  Clone ID: cC-zmle189097a10a1
ccanctctcgttttctttttcaacaccagcacgcacgcaaggcacgccgggcgacaataaaaaccacccccccattaacaacccgaccgaaagcgagcacgaaaaacaagacgacacaggaacaactaaacacaccccaaacaaaaaacacccacccccatcgtagccacacccaacacgctggacgagaacccca

SEQ ID NO: 19840 - DNA, 374 bp, Zea mays
  Clone ID: cC-zmle189097a09a1
ggatggcaatccattgttatattattcagcaaactttgcaaggtcatccaaccatatatatgctccgggtttctgcacggacacgtagtttaaatcatgcacgcagcacttgtagtacgctacgcagggcactgatggcctcgggcagcttgcattggctagtttccatggggcttgccaagaaggacctggcgatcctcccgttggcaccctccggatagaacccgccgggcacgcgctcgtcgccggtgaggtagaggatgctgagcagctcggtgggcgtccggccgtaggagagccagtccctgtccgcggagagcacgttggtgcaaatggcgccctcggcgccttgccggcggggcaccgggagcccc

SEQ ID NO: 19841 - DNA, 283 bp, Zea mays
  Clone ID: cC-zmle189097a11a1
atatgggggaggggagtcatatttggttattcttattaatatttgggacgaagcacgcacacaaatccagctacgtagggacgacgtatacgcgcgtacatacaaatgcgtgcacgtgtaatgcacgcttatatattattgggcaaatccaaatcagaattattcctgcaaaatccaaatcactagcccatgcaaatgcagagcctattccggccgatcacgggcagaaggggacttggtagttggtggtgccgccacatgcatggggcttcatgtcgggggg

SEQ ID NO: 19842 - DNA, 229 bp, Zea mays
  unsure at all n locations
  Clone ID: cC-zmle189097a11b1
ttgctctagctctatagctcgagaattgcagggggtccacaagaaacaaggtgagtgccccctctacgtccgncggctcctcgttctttgtccttcagatgaaactggacgccgacttggctggcatgagacgcaaagccggcacctttaccatcaccaacaactggggcttcaccgtgtggcccccggccacccccgtgggcggcggcacccaaatgaacccgggggg

SEQ ID NO: 19843 - DNA, 313 bp, Zea mays
  Clone ID: cC-zmle189097a12a1
agatgccaaaagaatcacttccaacattgaaaaggttacaggactctttgaatgacaacttacaaaaggggaaagtaactagaagtacttcccagccccagatccattatgccctagacgggttgatctgaaacaagttgaggcatttcttcagctaagaaaatacaacatctgaacggagtacatacttggcattctttttcacagcccgagcttaatgcagaatacatttggcgccatgtagggggaggagtgccataccttgcactggaacaacctaagggacaactccacctctttgatcataaaagac

SEQ ID NO: 19844 - DNA, 393 bp, Zea mays
  Clone ID: cC-zmle189097a12b1
ccacgcgttttccttccagcagcgccagaacaaaggttaggggggcacgaaggtcaagaagggcggtggcagcggtgggagatggccgtcggccatgcccaacaaggatctccagatcactagcctgatgggcacccacctactgaccattccagacttcttgacttctgctgaggcgaaagctttcattgatatcgctgagtcgatgggcttcacgcaccagggcagtttggggccactaaagggggaggcttacagagacaacgaacggatatctgtgacggatccattgcttgctcaagccatttgggaatcaggaataaacaggatttttacagacatcagcgtctctgttcaagtagcaccaggattgaatccaaatatcaggctcta

SEQ ID NO: 19845 - DNA, 451 bp, Zea mays
  Clone ID: cC-zmle189097b01a1
gcacattagactattggagtcgctgatcaatatttggcattattacacaatcgtacgtttgcaccaaggcattcattgaaaactctgcatggaaggcatcacattagccttcccaatcacacgacactagcaatgttcaaaaccccaactgatccaagctaaaaaataaaataaaataaaaataaaggatagcatcccaccacgcatgccaacattttatttgatgccccggggcgaaatctccacgaaagctaacttaattaacccaaacaaaccgtctcagcgtagaggcgcagagacggacgctaagactcgatctacctaatgaaccgaaaccgaggacgtcgacgacgagggggacagtgacgtggtggaacggcgggcgtgcggccatctagttggccttggcgatgaggtcctgggcggtggcgaccgtgggcagcgccgggat

SEQ ID NO: 19846 - DNA, 432 bp, Zea mays
  Clone ID: cC-zmle189097b01b1
cttacttgtccgcccacgcgtccgcccacgcgtgcggacttttccccgctggaaagatgcatttatttggtactcatatggaggaaagaatagacactacaaactaaaagttttgaaacacactatcagcctctaaacccccataagaaaataatctcaaaattgacgtctcggctttgactccgcagccgtgactcggatctgtctaccatccaagtcgatgccatcgaggtttgatatggcattgttgacctcttgggcggagccataggtgacgaaaccaaacccccttgacctgccgctatccctgtcgtagatgaccttagcatcaagcacttgcccttgctcactgaacaggttctccagagtcgagttgtcaacgccccacgcaaggttccccacgtagaccttgttagctgaatcgacaaagcc

SEQ ID NO: 19847 - DNA, 362 bp, Zea mays
  Clone ID: cC-zmle189097b02a1
attacataaactaacaaaaaacaatattttataaggaacccgggggcccccccggaaaatcccaaccggaaccgggagggcccccaactttcccaaaaggggggtgaaaaaaaacgggggaaaaaaaaggaaaaaaaaggaccccggggaaaaaggtaaaccgtcaaaaatcccaaaaaaaaaacaagccggaagaaaaaagggaaaagccgggggggcccaaagggggagcaactccaacataaaagcgcccgcccaactgcccccttaaaagaaaaaaaacaccgccccccacaaggaaaaaaaaaccccaaacccccgggaagagggactttaaaaatttgcccccaaaggggtttttt

SEQ ID NO: 19848 - DNA, 476 bp, Zea mays
  unsure at all n locations
  Clone ID: cC-zmle189097b03a1
gggcccctgccccgttttgtttcggccacgacgctgagcctcatgcccggcgcgttttttgcgccgagcaggagcattccgacgcgagggggcaggagacggccgggtccgcctccacggcggcgccgttcaccatcttctacggcggcagggtggtcgtgttcgacgacttcccggcggagaaggcggccgaggtcatgcgcctcgcagctggcgccgagcgcccggcggccccggccccggcgccggcgccgcgcgacgacctgcccatcgcccggaaggcgtcgctgcagcggttcctggccaagcgcaaggaccgcctcgtggagcgcgccccctacgcccgcccgttcccatccgaggaggcggagaaggcgaagccggcctcctcgtggctcgggctcggtggcacggacgccgagcgccttaacatcgngctgtgatttggatctcgcttgctacccacctggatcgac

SEQ ID NO: 19849 - DNA, 471 bp, Zea mays
  Clone ID: cC-zmle189097b03b1
ctgtcctttttttttttttttgacacgaattgtgcgtcctctatctttctattatcgaatcaattaacagccaaactctctcgtaagggagagagaaaaaaaacaagaatacgtttctacaatcctccgtctccgatctccacaccaaccccaatccagcagacccaaaggaagccaggaacccagccaatcaaatcgcccccggtcgatccaggtgggtagcaagcgagatccaaatcacagcgcgatgttgaggcgctcggcgtccgtgccgccgagcccgagccacgaggaggccggcttcgccttctccgcctcctcggatggggacgggcgggcgtagggggcgcgctccacgaggcggtccttgcgcttggccaggaaccgctgcagcgaccccttccgggcgatgggcaggtcgtcgcgcggcgcccgcgccggggccggggccgccgggcgctcggcgccagc

SEQ ID NO: 19850 - DNA, 378 bp, Zea mays
  Clone ID: cC-zmle189097b04a1
ctgacccgctagaaacctcccaggggggttttttttaaataacagaacgctccacccaccgccaacacaaaggaagggaccggggcaccgaaccagccacaaccacacagccgcggccgacaccccccccgggggaacacaagaggcacccgagaagacgaaccagggcctgaaaggcccacccaaggggggggaagaacccgaacaccacgaaacagcgaagaccacatgccggggaaaacacgcgccgggggagcaatcttaccgacacgccccccgcgggggaaaaaactcccccgcccgggcgggcgaccacgcgacaaacccccaattactgccggggccccccaggccccccaacaatcgaaaaccccccca

SEQ ID NO: 19851 - DNA, 56 bp, Zea mays
  Clone ID: cC-zmle189097b04b1
ccctctcgtccgagaaaaaaaaaaaaaaaaaagggaggattaattaaaacaccagg

SEQ ID NO: 19852 - DNA, 357 bp, Zea mays
  Clone ID: cC-zmle189097b05a1
cctctccctttttttattttttggtggggtttttttttagttttgcaaacggaccccacccccccagaccatctcatgggacccgcgcacaccccccgaaacaacaataaaggcaacggccaaaaacaacacacgggacctggaaggaacttaagaacaaaaacaccgcccctaaaactacactccatggcggccaagacaccgacacccattaaaaaccaacgcaccaaacgcgccccccccaaaccccgcggaggcaacagagacgacccggccccggaggggaaaaaaaccccccacccggcggggacaatgccgcccaccccccaactaccgaccggcccccggaggcgcccc

SEQ ID NO: 19853 - DNA, 349 bp, Zea mays
  Clone ID: cC-zmle189097b05b1
ctttcgtttgggggtagaagtggacgcaccacgacattgcatgaagattgccatcccacagcacgggctgctcacattttgtacattggtcggtaaataggataagcgtgttggcctacattagatataatgatgattgatgatatgaggaataggagaggcattcaagtacttgtatgtgtcttctatgccaatgctttatctatatagctgtatcagtgttccagtcaattgatatgagatgatgcttggagtcgttttgctatatgaagtgacggatacaatgggaatttgcagcctcaaaacgctggatttggctcggaggctgccacgaaggaagcccctgatg

SEQ ID NO: 19854 - DNA, 446 bp, Zea mays
  Clone ID: cC-zmle189097b06b1
ggttattgcaaggtgcagtggtgattgatgttgggacgaattcaatcgaggatccaaccagtgactacggttatcgcctaactggggatgtctgcttcgaagaagcagtgaatgtggcctctgctataactccagttcctggcggagttggaccagtaacgattgccatgcttcttggcaacacacttgattcagcaaaacgcgtttatggcctaagtgactgaaactgacccccctctgaactgtaattttgtcgtgcttgtcctttgtaaactagttctcttctcttttcaacctcccgtcgctctctattttagctgtaggaggagggctgggatgtaccatattcttgctcaataagtattgtattagctgggtccattaggtaagtttttttgtgtgtgaccatattagcctggtacctatataaccaacacacaatagca

SEQ ID NO: 19855 - DNA, 449 bp, Zea mays
  Clone ID: cC-zmle189097b07a1
tttttgcgaggaaataattacttaaaatatgtagtatttgattttttacaaactaggccaattaagctcagggcaaatataaagcaaggcagaactcggacaacctattccaggatgtcctcgtcaatctcgattgaaatgatctccccatcatcgaactgatccttccttggaggagcaggaggggcaaagagccgcgcaggcccagttcccttcttcttgttgcgcggcctcgcattgccatatgaatggttgaaccttttgccccttttcgttttcttgccccctctcccgcagtagacgtcaagaactggagtgacggtggccgacaagacggcgccgacggcgaacgcagcccgggcgcgggggaaggcggcggaggctgcgagcgcgtaagaggaggtggagacccacgatgagaccgcgccctggttgtgagatgggagggg

SEQ ID NO: 19856 - DNA, 471 bp, Zea mays
  Clone ID: cC-zmle189097b07b1
tctctagtctctcttccctgcgcttgctcgctccttcttgcccccatggcgctgctcgccgtccagggcatggccatgtccaccgccgccgcggccctcccatctcacaaccacggcgccgtctcatcctacgtctccacctcctcctacgcgctcgcagcctccgccgccttcccccgcgcccgggctgcgttcgccgtcggcgccgtcttgtcggccaccgtcactccagttcttgacgtctactgcgggagaggggacaagaaaacgaaaaggggcaaaaggttcaaccattcatatggcaatgcgaggccgcgcaacaagaagaagggaactgggcctgcgcggctctttgcccctcctgctcctccaaggaaggatcagctcgatgatggggagatcatttcaatcgagattgacgaggacatcctggaataggttgtccgagttctggcttgctttatatttgcc

SEQ ID NO: 19857 - DNA, 401 bp, Zea mays
  Clone ID: cC-zmle189095c10b1
ctcactcgtccgcggacgcgtgggagatacttggtgcagagaaggctttattcagagctctaaagacaaagcattctacacctaactcttgctatccggtatgatgcccttggtgatggtgaggacaactccattggcactgagagtcgacttaagcttgagacacggcttcaagttcttgagggtagagaacttgggaaatctgctggttccacaaaggggaagcccaagatagaagtgtatgaaaaggaccggaagaagggtactggggctttaacaactcctgctaagacatataaccctgcagctgatctggtactcacggaagaaacaccaaagaagtcagaatgggcttcaaagaagaggaaacataatgaggttggaactgaaccaatagcaga

SEQ ID NO: 19858 - DNA, 435 bp, Zea mays
  Clone ID: cC-zmle189095c10a1
ttttaatttccatcatcaccaggatcgagcaagtactggggtacattgtctgggtccaaaaaaactgatgtcgatatcgtttctacccgcaaatccattttacagaacagctgagtcccagcctttggtagtttggtacccgcatattttttttcagtgggaatggttcacttatcattagcacgcctttttcttctttatcttctctttcttacctgattcttcggtttgcattgcgacatcctcaccatcatgcgtcagacttctttttcttcttcttaacttccgaagcagcagccacaacaggcttttccttgaccttcttagacttatttttctttatcttttcaccatcaccttcaccaggaggagcctccttgctttccttgtccttttccttgttcctcttccgatcctcctggtcaccatcctcct

SEQ ID NO: 19859 - DNA, 442 bp, Zea mays
  Clone ID: cC-zmle189095c11a1
aaaccaaagttactctgctttgggagtatttagtataaactgatgcagacacaaagacttatttatgtacaaaaacttatgcataacttggaacacacttatatgagactgtcgttcacatcagccgcatggacttatatgttccgctcatctttgaactatcagtaccggatggacttatcctttatataagactgtcggtatgttctccactgctcccaccaaaagacatctctggatggtttggcagaccatccaaactgaccaaaggctcgtttgaagtatgtagcagatcaaccacatcagccggaggctcattcactgaagaagcatctatccctgaagggtttgtcaggtcagccatgtcaaccagaggctcgtcgctggggacagaaatatatggctctggtggcatagtcaggtcagcaacatcaactaaagg

SEQ ID NO: 19860 - DNA, 508 bp, Zea mays
  Clone ID: cC-zmle189095c11b1
gactagttccgactgtttagtacactctcatcttcagatgacgatgatgcttctgctgcagacgagcctttagttgatgttgctgacctgactatgccaccagagccatatacttctgtccccagcgacgagcctctggttgacatggctgacctgacaaacccttcagggatagatgcttcttcagtgaatgagcctccggctgatgtggttgatctgctacatacttcaaacgagcctttggtcagtttggatggtctgccaaaccatccagagatgtcttttggtgggagcagtggagaacataccgacagtcttatataaaggataagtccatgcggtactgatagttcagagatgagcggaacatataagtccatgcggctgatgtgaacgacagtctcatataagtgtgttccaagttatgcataagtttttgtacataaataagtctttgtgtctgcaatagtttatactaaatactacgaaagcagagtaacttttgttt

SEQ ID NO: 19861 - DNA, 348 bp, Zea mays
  Clone ID: cC-zmle189095d02a1
actcagttcgtattcatgacatgttggacaacccaagtccacaagctacaagcactggagaaattgtttgtacaatggcaggataaggaaaaaaactaggcaggaaaagtgaaaaaggataaaataaaaaaggatttctagtaaaacaaggcggcacacagatggagcctctggtttagaagcaaagtctcgtggttggtaagatgataaagaccacgggcaggggcaccggcgaacgggttgcaggcagcgcagtggacatggcatggctagatctactatatggcttcgtcccaagcggcccaattggcggcgctgccaacacggggcatggagttgatcttggtg

SEQ ID NO: 19862 - DNA, 445 bp, Zea mays
  Clone ID: cC-zmle189095d02b1
cccactcgttcggtcaagcgcggctgcggcaagtcctacgcgcccttccccgcgggatgcatgttccacagcgacggagggctcaagagcttcgagcaccccatgaacaggctcaaggccatgccgcgcgtcgacagcgagggcgccatgtgcggcgccaccttcaaggtcgacaccttcaccaagatcaactccatgccccgtgttggcagcgccgccaactgggccgcctgggacgaagccatatagtagatctagccatgccatgtccactgcgctgcctgcaacccgttcgccggtgcccctgcccgtggtctttatcatcttaccaaccacgagactttgcttctaaaccagaggctccatctgtgtgccgccttggtttactagaaatccttttttattttatcctttttcacttttcctgcctagtttttttccttat

SEQ ID NO: 19863 - DNA, 309 bp, Zea mays
  Clone ID: cC-zmle189095d04a1
ttatatttgttctgaggaaatgtactagacctactaaccaaggttagtgttgtatgtacatgtacatatagattcctaaggcttgggaaaaaaacagatacaatcagaccagacgtttgcagagtgatctattcaaacatccgagcagaactccatgctatccagatggtgctcaaacgatccagccagtctgttcgcgtcctggacccgcagtcgcgtgccttgctgcccgacgacgacagcagctacccgcgacgccaggagttctatgcctttcaggtcagaagcaccccggaggacgccgtacag

SEQ ID NO: 19864 - DNA, 379 bp, Zea mays
  Clone ID: cC-zmle189095d04b1
ggcgagatctacgacgccgtggagctctccgcggcggccgttgggccagagagatgggacgtgctgggcctcggccaggcgatggttgacttctcagggatggtggatgacgagttccttgacagattgggcatagagaagggcacgagaaaggtcataaaccatgaggagaggggacgggtcttgcgtgccatggatggatgcagctacaaggctgcagctggaggctccctgtccaactcgctcgttgcgctggcaaggcttggtagtagccagtctgctggctaccctgagcttaatattgtgatgggcggcagtgtgggcagtgacccactaggtagtttctacagggcaaagttgcgccgtgctaatgtgcact

SEQ ID NO: 19865 - DNA, 369 bp, Zea mays
  Clone ID: cC-zmle189095d05a1
ggcagacaggcggccacctttgttggcgcccctctccgagatgagcttggtggcgaggtcccagcctcggccggagtcgaggtccaggatctgcaggtcgggtctccgccgcgcgctctgccgccacctgttgaggtcgtagccggcggacctgagcttggcgtgaagttcttgagccccgactgcgttcgcagcgttcgtatggccatctgcatcagcactatccccgccgagtacatgtcgaacaggtccgggctgttcagctgccagaggatcggggagaggatggcggctatgggctccggcgggggctcgggcgtcttctcggggaggacgtatagctcgggcgggcagtagttcgggtcgagc

SEQ ID NO: 19866 - DNA, 437 bp, Zea mays
  Clone ID: cC-zmle189095d05b1
cggtgtgcgtgctcctgggcgtggacgcgtcaggcgcggtggccacccccgacgggctcctgagctccctgctgcacctggacgcgtccaacccggtggcgagcgtggcgggcggcgcgctgtctcgcctggacgcgctcacgtcggggttgtcggacgcgcagcggtgggcgctgttcgggttcctggccgcgacgtggctctacctgaccgcgcggcccggggtgctgagcggcgccgtggacatgtacgtgctggcgccgctgcagctggcgctggacagcgtgctgggccggcggagcctcaagatgagcgacttcgtcgtcggcgagcgcatcggggagggctccttcggggtggtgtatgcccgcgccgtggtgcccaagaaccgcgccgtcgtggaggagcggttcggcaatgccaagacgagccttcag

SEQ ID NO: 19867 - DNA, 427 bp, Zea mays
  Clone ID: cC-zmle189095d06a1
attattgggtttttttaaatatttatattcctttcacacaatcataatttttttaaaaaaattttttttctttctccaaaaacgaaaaaaaaaaaattttatcccctcccaaccaaacacctctttttttttagatcgctcaaaaattttcacaaaaaaccccctttaaaaaaaatacaccccaacccccaacgggaaaaaacccccgaaccttacatcttctagggggtgccaccaaaaaaaacacccccgaccaatattcccaccatcaaaaaaagctcaaacgtaaaaggcccctcacaaaagggggcccccccacccggtctatattacaaccccccgggcagaccctcaaaaaacaccccacccttcatagtttctaccaaaaaaaaccccccaatttaaaaagcctcccaatccccccacc

SEQ ID NO: 19868 - DNA, 400 bp, Zea mays
  Clone ID: cC-zmle189095d06b1
cccatttttttttactattgctcctaagttgctctttattgccctcaatttggctgccatgggattgggtatatggaagcttaatacattgggccttcttccaacaaatccatcagattgggtgtcttctctggctcctgctcgggaggttgaatatgccggaggagggctccccttaatttaatgtccatttccatttgaacttattttactagctgtaatattaataccgagtgacatttttaccatacacccctgaatacacgaagttccgggttttttcccctgtctggatttgaactactattttctagatgcgtttgtttgtatcgaatttgcgaacctgaagtatatgtcgtgtctggatggaaaaggattaaattattttctattccatttt

SEQ ID NO: 19869 - DNA, 448 bp, Zea mays
  Clone ID: cC-zmle189095d07a1
ttttgaacaaaactgtgaactttatgtttgcctttccaaagcaactgtattacatcatatacattttcacgtggcatcgggctgcgactttttgcagacaccgtgaattttttttcacttcactttccatcttttgtaaggcaaggggaaaaaacttcaagatcctatctttgtggtgaatttatcacccgttcaaatccagaactgaacaattatttaccatggcacagaacactttgtgtcgcaccacttttcttcacttgagactacacactacgctttctccagcagcgcctttgcacggcttcagagactcgcattttcacaaggtgatgattactgatgtgcagaacctttgcccaaacacatctataccggagagacttctccacgagcttcaaaaaagaaaattttaggcctgtaacagagcttaaatacttgaatatat

SEQ ID NO: 19870 - DNA, 445 bp, Zea mays
  Clone ID: cC-zmle189095d07b1
atttgttgaagtttatcgtgcagactggaatggcacggaggttgcagtgaagaaatttcttgaccaggatttatcaggtgtttcactagagcaatttaaatgtgaagtgagaatcatgtcaaggctaaggcatcccaatgttgttcttttcttgggatatgtgacacaatcgcctaatctctctatattaactgagtacctcccaagggggagcctatatcgtctgttgcataggccaaatagtcgaattgatgaagtacggaggctaaaaatggcattcgatgtggcaaaagggatgaactacctgcactctagccatcctaccattgttcaccgtgacctgaaatcccccaatcttttagtggataaaaattgggttgttaaggagtctgactttggcatgttcaggttgaaacatcatacttttctttcctctaagtcaact

SEQ ID NO: 19871 - DNA, 312 bp, Zea mays
  Clone ID: cC-zmle189095d08a1
gttcaatatgccagctatgattttatattttagtcctccgccattgttcgtgcgtgtggctactggttacacaattctactgagactcaacatatccctgtagagtaaggactcctctggatctaaataactggaatcagcatgccaaaatcttcagtcctgacgagacagccacacaaaaactgtagctggctgtcaggcgtagtatactggtcgatcaggggcgcgcttgggttttcgctctgcgtgcgtcctgatgctcgagctgtctacttgcttgggcagggaagaatgcgccatctaacttgtttg

SEQ ID NO: 19872 - DNA, 388 bp, Zea mays
  Clone ID: cC-zmle189095d08b1
gtttgttgctgaccaaatgcttgcagtggggtttgaggaagatgtggaaacaatattacaacagcttcctgcggacaggcaaagcatgctgttctctgcgacgatgcctagctgggtgaagaaactatccaggcggtacttgaacaatcctttgacgattgacttggttggtgatcaagatgaaaaacttgctgaaggaatcaaacttcatgccatcccactcacagcgacgtcaaagcgcaccattcttagtgatctaattacggtttatgcaaagggtgggaaaaccattgttttcactcgcacaaagaaagatgcagatgaggtatcattggcactgacaaccagtatcgcttttgaggcactttatggtgaaatttcacaagat

SEQ ID NO: 19873 - DNA, 149 bp, Zea mays
  Clone ID: cC-zmle189095d09a1
ataaaaaagtacctttttatttttgggaaggccccaaccccatccaaaaaactttatttttgaacttttacccctaagccacttaaaagagggcccccccaacgttgggttgttgggagaacaccggtgggtttgtcaaacccaggtgg

SEQ ID NO: 19874 - DNA, 400 bp, Zea mays
  Clone ID: cC-zmle189095c02a1
cgggaccatagcggggttttttttgtttataaatttggttacataccctttgaagtaaattcgtgattcaaccccatcacttgtatcttcaccgggggaaaaaagtttttttaaatgggaaaaaacctcgttacaaaacatggggaaaaaaaacctggggaaaacccccaaaccaaggccagggcttgggggggatacgcccccattttattaaaaaaaactttaacaaaaaaaggggccacaaatactgtacccggaaaccaaagggccccccggggaaaaaaatatatctcgcccccgccaaaaaaattaggaacctcccaaaggaaacccggggggggtgggagaacccctaaaacggggccccccaggaacagaaaaaaccccgccctcgggggtt

SEQ ID NO: 19875 - DNA, 434 bp, Zea mays
  Clone ID: cC-zmle189095c02b1
ggcaattgcactgtcaaccgggagccactgatctcaggtttccacatacgagccaggttatcctgtgaaagtactgaatattgatggcggggcatagataccgtataactacaggagcacttgttgtctcggaacaaattgttgtgaatcctgttttgtataatagttttcttgaatataagcgaacgtagcctaacaggccaaagtccatgtaatggggtttacaacagtaataacttgcagagtgatgtaagcgagttgttgagcagtaaataaaatactcttgtcccaaaaaaaaaaaatttataaaaaaaaaataataaaaaaaaaggttaaaccaaaaaaaataatacatattttctaaatcattcatgccactatataactcttttttttgtttacactaattctaatttactggggggggggctttt

SEQ ID NO: 19876 - DNA, 265 bp, Zea mays
  Clone ID: cC-zmle189095c01a1
attgggaacaatacttttttcttttcatttcaattgttcattcaggtcattgctcacactgacactgccacccatggtgatgcgtgacacattattactcaatcatcgccgcttaatgactcaactagctagctagccagcggctatactacagcacatagtttcttcagggggggacaccgccggcagcagcgtaggggcatggagccggctgctgcaggccgcacatcgccgtcagttgctgcgctatctgcgccgccaacag

SEQ ID NO: 19877 - DNA, 483 bp, Zea mays
  Clone ID: cC-zmle189095c03a1
gacttaaaactaacagcattgatcttacatgatgaacaagtttattgggcagatggcatgcttatagctgatttgtctcaacaaaatactagtgctgcagaagttggtgctcaagaaagtccaagttgattggaagaaaaacaaaggaaaagggacttaggagttgctatttaggtgtagcgaaccccaacaggaaaatgtatggtctcggaaatttggctaaaattcatcggatcatgcacaatactgggtccggtggcgccctagacctatgagttcaacagctagttggcgtgcaacggtcggctaaaggctaactgacgaggcgatcgatccaatgccacttaaagaaagaaggtgcccaaccaaatcatggaggagctgctacaaccgagggttcgggggggcctccatcttttcttggttcacccacacaaattgtggtttaaacataattcatatatgttttttaaaccctattta

SEQ ID NO: 19878 - DNA, 252 bp, Zea mays
  Clone ID: cC-zmle189095c03b1
cccactttgttctacttgatctacaagagaatacacaagagagagattgagaatgactacacacttgtttttacacttactttctgctttgatgtactgtttgtggacgagggtgggcctatttatagccctaagagctcccatagccgttggagctttcctaaaaaaccaatcttaggtggtgcaccagattaacacggtgtattagaagaccatgtgttacaacaagtgcttgttgagagcgtcttacaa

SEQ ID NO: 19879 - DNA, 379 bp, Zea mays
  Clone ID: cC-zmle189095c04a1
gttgaaactaaaaagtttttttttactggacatgttgccgtattggccatgccacgaaatgtaattacaagcaggattagctttatcattattgcaacaagaggcaccttattccttactcgaaaagtcgaaagtaaacgaagctagcgcacaagagcacgaaatacttcatggtagcacagctgcactgcacaggtgcatgcgcgtcctttcctaaacgcctcagtgccccgagagcacgcttggaatcgcatcacatactggcgtcgtcgtccgcgtcgaagagcatccagatctcgttgaccctgccggtgaactcgaagggcgagttgtactgcgcgacggtgtatggcgaggccgggtcggccctgcgcgcgtc

SEQ ID NO: 19880 - DNA, 301 bp, Zea mays
  Clone ID: cC-zmle189095c04b1
cccacgcgttcgctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctacttcgacggcgccaagcgcaccgggtttctacaggtggtcgactacattcagggcaagaacgggtacaacca

SEQ ID NO: 19881 - DNA, 508 bp, Zea mays
  Clone ID: cC-zmle189095c06b1
gcctttggtttctatggtcacggtggttacggccacgggtatggtggccacggcaagttcaagcatggtcacggccaccacggcaagttcaagcacgggcacggcaagttcaagcatggcaagcacgggcacggtatgttcggcggcggtaagttcaagaagtggaagtgatgtgccctccatggttgatcgtagctgaactcaggcttccaggacatgtgttgtcagtaatacctttttagcgttactcatccttcatctgtatttccagtaatccagcttgcggagagtgacataaagcttaataagtgacataaataaccatttggtgttctaaacaatctcaaatttattcttttaatacatctccctttaaatattatttttattaattaatatgttttactctatttcttttctacacattttcttttctttttgttaatgggggctgtccttttaagggtccaattttattatccggttttggaaataatttttttttttt

SEQ ID NO: 19882 - DNA, 58 bp, Zea mays
  Clone ID: cC-zmle189095c07a1
gtattagtattacgaagaggacatcaacacctgcaccggcgaggtccacgagcgcagg

SEQ ID NO: 19883 - DNA, 64 bp, Zea mays
  Clone ID: cC-zmle189095c07b1
tttgctctcgtggacctcgccggtgcaggtgttgatgtcctcttcgtaatactaatacctaaaa

SEQ ID NO: 19884 - DNA, 258 bp, Zea mays
  Clone ID: cC-zmle189095c08a1
gttcaatatgccaagaaagatctcattcaggagatttatgacatggagggaacacacggcaactggaggcaccctttttctgagacataccatatgcaagctaagagagggctcctccaactttaggttgctggctacagaaggcaggattcatcaaacctaactggacggatggacaaaatcggtgcttgtgtaggaagggggccaccatggggatccccactcccactggatgaagcaaccgtagtgcgtgctgaa

SEQ ID NO: 19885 - DNA, 445 bp, Zea mays
  Clone ID: cC-zmle189095c08b1
atttatataacacaccaagcgaagcgcactagcaacgacctaacaacaatggctaccaacatattagtcctccttgcgctttttgccctttttgtgagcgcaacaaatgcgtttattattccacactgctcacttgctcctagtgacattattccacagttcctcccaccagttacttaaatgggcttcgaacacctagctgtgcaagccaacatgcaacaacaagcgcttgcggcgagcgtattacaacaaccaattgaccaattgcaacaacaatccttgccacatctaacagtacaagccatcacaacgcaacagcaacaacagtttctaccagcactgagccacctagccatggttaaccctgccgactacttgcaagagcagctgcttgcatacaacccacttgttctggcgaacgtagctgcaaaccagggacaacaac

SEQ ID NO: 19886 - DNA, 422 bp, Zea mays
  Clone ID: cC-zmle189095c09a1
ggaaaaataagaacaacttgtagtccgaaagcatttacaaatttacagtcagatgatatcgccagggaaaaaaaggtactgctacatcgcaagctagcgctgctttcattcaggctacaatctaatgactcaagtttcgctgccgcatagcaaacacaccagctggataggggtagacaagtttggcttctgtatagtacttcttttcttccgactggttctcctagaagaaaacgacgaggccgactacctgccattttatgcgtacatccccaggatgctgctaccatggaatcaaccagggcaatttatctccatttttttatcacgtgcctatttacactgcccactcgttgggctttagctctgcccaccttcctccttgtttcggcgcgggggtttccaacaacagcggggtttga

SEQ ID NO: 19887 - DNA, 460 bp, Zea mays
  unsure at all n locations
  Clone ID: cC-zmle189095c09b1
ctaaatgctgttgagcttctgtgggtgaacctcataatggacacacttggagctcttgcattagcaaccgagcctccaacagacaaccttatgaagagaaatcctgttggtcgaagggaacctcttgttacaaatatcatgtggagaaacttgtttgttcaggccctttaccaagtagcaattcttctgattttcgattttgatggagtaaggattctgcgtctgcagaatgaaagccgatctgatgctgagaagataacaaatactttcatcttcaacacatttgtattttgccagatcttcaatgagttcaatgcacgaaaacccgaggaaaagaatgtcttcaaaggggtcacgaagaatcacctgttcatgggaataatcggtataacgacagtatttcagatactgataattcagntcctggggaaagtctttaaaatagtgaggcttggtggag

SEQ ID NO: 19888 - DNA, 424 bp, Zea mays
  Clone ID: cC-zmle189095a01a1
gcacgcacacgcaaggtaggatcctctagagcggacgccctgttcttgatctagtactagatctttgtaactcagtctctgcgaatggaacaagcggtcactcctatttgttaaagattgtatcctccagtattacatgttacaactttatatatatataaatcacacacccagacattgttcaagagtcccaatgaggcagaagagtttcaagctcgttatgggttgaatgctggaaccgatcggtcgaccgatctggcaaatcaatttacctgtcaatcccctcaatcttgtcttcaacctccgaatagagctccctgagcctgtccaggttcttctccgttgtctcccagtagcctctgccactggctttcaggaaggtctgcaccaacttcctgaacgaattggggttggtgtccatgag

SEQ ID NO: 19889 - DNA, 331 bp, Zea mays
  Clone ID: cC-zmle189095a01b1
cgcgtttattttccgacgagaagcagctccaggacatgtacctgagccgtaagtccttcgcgttcgacagcgacgccccaggggcaggcatgaaggagaagcgcaaggcgttcgagctcgccctggcgacggcggacgccacgttccagaacctcgactcgtcggagatctcgctgacggacgtgagccactacttcgactcggacccgaccaagctcgtgcaggggctgtgcaaggacgggcgggcgccgtcctcgtacatagccgacaccaccacggcgaacgcccaggtgaggacgctgtctgagacggtgcgccttgactcgaggac

SEQ ID NO: 19890 - DNA, 432 bp, Zea mays
  Clone ID: cC-zmle189095a02a1
gcctgtcctttttttaattttttttttttttaaactatttttatttatttttttgtgtttttttttaattttccccacccccaagtaaaaataggccttgaaatatttttgtcaaacaaggattagaggaagccaatgcagggccatgcttgcaacaagggtatcctcacacccaccaaaaaaaactggaaggcaagggacccagggccggggaaaaaaaaaaaaaagggaaaagggaaagaaaaacccaaccctgcaaagggtccggggaccccaaaaaaaaaccgaacgacaaaaacgacgcagggccctagcttgctcctagcctacgcaggaacttatatttgcccgggggggggggccggggggccccttttaaatctttcccgggggcttgttggcaaaaaaactcccccccctgtttttgttttt

SEQ ID NO: 19891 - DNA, 478 bp, Zea mays
  Clone ID: cC-zmle189095a02b1
gcaagtttgttagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaaccgctggataccctgcctagagttcagcaaggtcggcttcgtgtaccgcgagaactccacctccccgtgctactacgacggccgatactggaccatgtggaagctgcccatgttcggctgcaacgacgccacccaggtgtacaaggagctgcaggaggcccataaatcctacccggacgcct

SEQ ID NO: 19892 - DNA, 233 bp, Zea mays
  Clone ID: cC-zmle189095a03a1
ctgtcctaacaaaaaaatcgggtttaaagcgcagggggtccccccggaaatcccggaccggaacccggaggggtcccattttcccctataggggacccctattaatgcttggaaaacaaaggccaaaacggtcccccgggggaaattgttatccggtcaaaattccaaaaaaaaaacaacttggaaccaaaaagggtgcccccgggggggccttaaagggggcccaccccaaa

SEQ ID NO: 19893 - DNA, 85 bp, Zea mays
  Clone ID: cC-zmle189095a03b1
aaaaaaaaaaaaaaaaaaaaaaaaaaaaaaagaaaaaataaaaaaaaaaaaaaaaaaaaaaaaaaaaaaaaaaaaaaaaaaaagg

SEQ ID NO: 19894 - DNA, 254 bp, Zea mays
  Clone ID: cC-zmle189095a04a1
ttttattttggtttaaacccgaagctatcaacatgatctctgggggatcatttgatcaaagcacacaattcaaagtcccggtacgtattagagaaaattcactaagattgtctctaaacagggtgtgcgattagacgaacttcacatagatcaccagcccccttgttgctgcatcgagttgtgatttaaccccaggaccaaacagggatgtgaatttcgcctgtctcttctaaatgcccatagcttcactgctt

SEQ ID NO: 19895 - DNA, 292 bp, Zea mays
  Clone ID: cC-zmle189095a04b1
ccagtacgaggcgcacccggtccgagcactagccgatctaccggcgccgggccacaactgggcgacggacaagatcatgtggacgtataccttgcgagccggcggacaaagctcgagcgtccaccggtccgtgcggcggagtcaatgtgtgcggccacggcgcccgtctccgaggctcgaaaggcatgacgtcccggacaacgagttgtgcctacccaagtctgttgctgtgcgatctggctggggcttagcctctcgctccagacgcacggaatcacgatcgcatgtcaac

SEQ ID NO: 19896 - DNA, 284 bp, Zea mays
  Clone ID: cC-zmle189095a06a1
aatgcaacaagataatggactgacaacaccaagatatatcagacataaataagacgcaacctgatctcacactatggcatgcgaagaataatccgttgctgatacatcaacatgcaggcttataagaataccgggcttccaggcttggctgcagacgactctgaggggaaaggggaggggatggagcatacacgagagaaagaagatgtaggcatgcaagggtgactctattggctgcgacaatcacccagacttgaatagcaagacagctttagagtcgatgt

SEQ ID NO: 19897 - DNA, 337 bp, Zea mays
  unsure at all n locations
  Clone ID: cC-zmle189095a06b1
gacgagtccaggcgcgggcccgcgggcgccgcgcaggtggtgcttcgggcctcctccgaggaccgcaagccggtgggctcggggtctgcgccgccggcagcgaccgcgactgcggttgcgcacaagatccagctgaagagtgccgacatgaaggaggagatgcggcaggaggccttcgaaattgctcgcatcgcattcgagaagcacagtatggagaaggacatcgcggagtacataaagaaggagttcgacaagaaccacggnccaacctggcactgcatcgtcggcccgaactttggtttctacgtgacgcacgagacaaactactttgtatatt

SEQ ID NO: 19898 - DNA, 55 bp, Zea mays
  Clone ID: cC-zmle189095a07b1
attataaaaaaaaaaaaaaaaacaaaaaaaaaaaactaggtatagatcgagagca

SEQ ID NO: 19899 - DNA, 334 bp, Zea mays
  Clone ID: cC-zmle189095a08a1
gtaacacacggtatgtaataattaattaagggggagccatctcgaaacatgcatatatagaaattatttttcctcagatctcgccgtcaagcatacatgcattatctcagacttcgcagtggcgagctcgatcgatatatatgatgactagcatcagtactaaaatagtattgtatcagggacacacgtacgggatcgaccagagcaccatgcatggtccatggatcatatcatcattatcatggcttcatgggatgggaatggatcggagtacgtgcttaaccctgatcagtacacacgtatcttttggaggggcggcggtatccccggtgat

SEQ ID NO: 19900 - DNA, 444 bp, Zea mays
  Clone ID: cC-zmle189095a08b1
cccacttcgtccgggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctc

SEQ ID NO: 19901 - DNA, 323 bp, Zea mays
  Clone ID: cC-zmle189095a09a1
ccaataacatgcagtgtatcagatataggatgcataatttgatttcgtcctaacaatcagatcgcgtataaagcgaaagaagtcacaaagtcagatccaagacgaaagaactcgtctttcagatgcgcggtatcacgtcaccactgcgctgttttagaaatcgaagccaccgccgtcgtctaacccggtgttgtagccggtatcatacgccgacgaatccgagatcatgtccccgaccagaaggcccccgacggggcctcccaggagcccggggccgagcccccatccgaaagtgttcttttttttggcctggtggtgatacc

SEQ ID NO: 19902 - DNA, 389 bp, Zea mays
  Clone ID: cC-zmle189095a09b1
cccacgcgtccgcccgccgccgccacaggccgggtacgggtaccagccgccgcagaccgccgggtacgggtatcagcagcaggccaagaagaagaacaacttcgggatggggctcggcgccgggctgctgggaggcgccgtcgggggccttctggtcggggacatgatctcggattcgtcggcgtatgatgccggctacgacgccgggttcgacgacggcggtggcttcgatttctagagcagcgcagtggtgacgtgataccgcgcatctgagagacgagttctttcgtcttggatctgactttgtgactttttcgctttatacgcgacctgattgttaggacgaaataaaattatgcatcttatatctgatacactgcatggtatgg

SEQ ID NO: 19903 - DNA, 491 bp, Zea mays
  Clone ID: cC-zmle189095a10a1
gccggcgctcgcgatcagtttctccggcagctgcacgcgaggcacgctggacgagaagatggaccaggcgaactggacggccatgccgagcgcgagcatgaagcagaggatggtgaggaagtggtagtccagccactcgaagaacacccacaccagcgtcgtcacgcccagcacgctggacgagatcttcttgttccgccacagcagcacgtcggcggatttgccgccgcccagcacgtggtggaccgacttcttcctgctctcgccgccgccgaacagcttcttggcctgctcggagatggaggagccgtcgccgtcgtcgaaccgcacggacttctgcctcgggaggttctccgcaatggtctccatgatgttgcccatcaggtccgccgccgcgttctctgagtgctccggcatcctcgacgaccctgccccctgaatccccggaaccacgaaacacgtgcgtgcgcgtacaggttagatgcagagtc

SEQ ID NO: 19904 - DNA, 583 bp, Zea mays
  unsure at all n locations
  Clone ID: cC-zmle189095a10b1
catccttcgacacctggtccgtcgcgtgccgtgcccacccgctaaggccagggcgccccgactcgagctcaccgcgtcgaactcgaaccgctgctgttcctcggtaagctcatcgcttccctagtttcctccggtcagtttatgcaaaagcaagccccttttcagctcgtttttggccggccggccggccgcttggttggttgctttagccttttgtgcgtcctgaataaagaatccgccgtggaggtggacaaaaaggaaggagaggctgagctgttcagattccgattcttttggttagagttcgagagctgttcaggatccaggctattgattcagagtggagagaaatacctgggccatggttaatctcttgttcagctagtaatcgccccagcagctcctgggactgggagggagctatttttcatgtcaagggcgtatctgtaactctgtaagcttttttttttccggcctttgtgcactcagcaagcctgtttgtttgagaaaaaaaaatcacaggtagcagcangaagcttgagcatatcacggctctgactacnccacactgttactgactgac

SEQ ID NO: 19905 - DNA, 270 bp, Zea mays
  Clone ID: cC-zmle189095a11a1
atttttcttttttttggagggtgccatcatagaaatatatatgggaaagttggagtctaaatagaaatccataaaaaatacaatagattcagcaaccgtacaagtatagatagctgcacatggaaacacttcatcatcatcattgatacgaagccctaccttgagaagttttatgcaagcatgtcaactgcctgctgaaactgattccaggctagtggcctactaattaattatatatatatatatatctatatattgatatgtataaac

SEQ ID NO: 19906 - DNA, 267 bp, Zea mays
  Clone ID: cC-zmle189095a12a1
ttttatttgttattgcaaaatttcatgaccgtaaggcaaggatttgctgtattttatttcaacgtacaagacacaggaaaatagctcggcggacaggtatgtacagcctatttttttttacagctttcgttggttccttaacaatgataattttttaaaaattttcttagccgttattttcagcttactctgccggttgtattccaaaatttccgttccaagccggacgtcgtggtgcggtacgcgttgggtcgatcccgggatatg

SEQ ID NO: 19907 - DNA, 224 bp, Zea mays
  Clone ID: cC-zmle189095a12b1
tttacttgtccggctggacggaattttggaatacaccggcagagtagctgaaataacggctaggaatttctgagaaatttcatgttagggaaccaacgatgctgtttaatagaattggctgtacatacctgtccgccgagctattttactgtgtcttgtacgttgaaataaaatactgcaaatgtttgccttacggtcatgaaattttgcagtaaccaataaaa

SEQ ID NO: 19908 - DNA, 266 bp, Zea mays
  Clone ID: cC-zmle189095b01a1
ctattctttttttcttttatttttttttttttttttaaactggggggttttttttaaatgtggtttccaattacccaaacaaaatccaggtacaaaaccacttaaaaaaaaaacacgaaaaagaaaaaagggccccagttaaatacaaaaaaaaacataaccgccacactaaaaagaacaacaacataaacaaaaacataaccatactctaaaaacaaacccaatttccaggacaccacaccaccgcccccagccgcccgcccaaa

SEQ ID NO: 19909 - DNA, 172 bp, Zea mays
  Clone ID: cC-zmle189095b01b1
ataagttggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgttt

SEQ ID NO: 19910 - DNA, 241 bp, Zea mays
  Clone ID: cC-zmle189095b02a1
aactttttctcttttccgtactacaagctatcaccggggaagaattatttctcggactatggcaccacacgcaaccgatcaccaaggggattatcccactcttttacggcccaagactacatatctccgggcataccagagtccgtggccatgaatttaccaaactttacgagtaaaaaggcgactagccagcttggcatggcctgattatgtaaaccccgccgtctgtaacctgagaaag

SEQ ID NO: 19911 - DNA, 476 bp, Zea mays
  Clone ID: cC-zmle189095b02b1
caaacaaaaaaaaacacctgggaaatccaagcatttgttgcaaccggttccttcgaggagaacgtgagaaagaagcatgaggccccaggtactgctcgttgcactggccgttttagccgtcctcgtagctctgccactgggcaaagcgcacgaggaggaggaggaaggggttgaactcgaagccagcaggaggcggtggccgtgctgcgaccagtgcggcatttgcaccaggtcgcagtcgccgatatgcgagtgcagggacacgttgacgaccggttgccacccggcttgcaaggcgtgcgccctgtccatcttcgacgggcctattcgtgtgcaaggacaagaacgttaacttttgcaagcgccgcttgaccccgcgaactgatgatgattatgcgtgacttaaaaacacttaattagggcaattaccctgcccataaataattttctgttcgagcttcacttgcatttttttt

SEQ ID NO: 19912 - DNA, 387 bp, Zea mays
  Clone ID: cC-zmle189095b03a1
gattgaacaaggaaactgaggaacaattctttatatcactgctatggggaactattacaattacactcagctcagaagcgaacatcatggacttaaccacacattattgtcaatgcaatcattaaaactttcaatgcccattggcagggcgatacgatgggtacctgcttgatccattcgcgagatcccacacctgataggggtagccacttgtgtctgacccaaaactaggcatggagatgtcagtgcggctgtatggccactgactcatcatcagatcatcaaactggctgctgctggagtgtgatgggagatcaaagtgcgaatagctcaggtccctcaacctccgaggagcactgctcaatggactataaaaccctggaggct

SEQ ID NO: 19913 - DNA, 548 bp, Zea mays
  unsure at all n locations
  Clone ID: cC-zmle189095b03b1
cccacttcnttcgaaacattattgagatctgggtttacatttggaactgtgaagcccgagtcactgaacccatatcagggcagagaagagaactcacagcaagcgagcagcaacagcagtgattgtgcgccatcgagttcaaacatcagaagcgagatcgagaagctgaatttgagcggaagaccacgaagcaagcaactgttgtcagaaatttcgaccagatttactccctatcagccacaaggcttggtcgctgatgagttcccacacctagacatcatcaacgacttgctggatgaggagcagagtgacagaagaagggttcttcaacctgattttgttcaacagtcctatatgcctcatggtgccagcacacctgattatggtgagccatacttgtttgaccagtccgagcaatacttcgatgaggagccttcaggttttatagtccattgagcagggctccttggaggttgagggacctgagctattcgcactttgattttccattacaatccaagcagcagcagatggatgatctgatgatg

SEQ ID NO: 19914 - DNA, 333 bp, Zea mays
  Clone ID: cC-zmle189095b04a1
ttttatttattttgactcatatactcaatgacaaacaatcatggataaaatggcatggagagtatggcataaaataaacaggcattatctcaacgtccaaatgtacggaaaacaaatatcattgcatgacatcccgtgtctaagtatacctcagagttttaaacagatgactgatgagactgatattgcacaacccagaaccaacccaaaaggacacctagctgtatagatcgtcatcgtcagccgcggcaccggcagaagcaaacggatcggctgcagcagcactagctgtcgccgattgctctgagaagcggaactcactgccgaacccac

SEQ ID NO: 19915 - DNA, 332 bp, Zea mays
  Clone ID: cC-zmle189095b04b1
gtgggttctttagtgagttccgcttctcagagcaatcggcgacagctagtgctgctgcagccgatccgtttgcttctgccggtgccgcggctgacgatgacgatctatacagctaggtgtccttttgggttggttctgggttgtgcaatatcagtctcatcagtcatctgtttaaaactctgagtatacttagacacgggatgtcatgcaatgatatttgttttccgtacatttggacgttgagataatgcctgtttattttatgccatactctccatgccattttatgaatgattgtttgtcattgagtatatgagtcacgttttataaaa

SEQ ID NO: 19916 - DNA, 358 bp, Zea mays
  Clone ID: cC-zmle189095b05a1
ggggcctcaagggcaactgaagaaccattttattttgctgccggcaacaattgatttcatatacaaggcacaactgattcccgggtgaaccggtcccagtttttaccacttggtccggccccacttggaaggttgcatcaacttacaccggtttttctctccgatttaattgcttcgtaagacttgacaacccccttgaactttttttctggaggatctctattaatttgattttggtcaggaagcactttcatcgtttttgttctaaaagcagtcttcacttttggatttggatatgggggcgctcgggatctggcaagacctaaaactgctaaggatgggacataagataaaccct

SEQ ID NO: 19917 - DNA, 481 bp, Zea mays
  Clone ID: cC-zmle189095b05b1
atcggtttctctcaccgccagtttcgctattactcaagttcgcaaaagcatggactggttctacactcagttgaataaagtgcagtcaacatcatcttggacttggaggtatacacgtaataactcaagtcgtggaagcttcagtgaggaagctaagaaaagatattatcagcgaatgcagcaggaatatgaagaggaacacgagagagttcaaagaataaggcatatgcagagtgtattcaacagagagaggaataaatttggaccaggttatgaaagctggacggagaatggtcctcctcgtgggtacaattacatgcctcgggatgattggtattggcagaccgatacttatcactcagaacataaaaatgggcagccgtacacacccgcaggacctaaagtttatcctatgacgcatcactatgcaactctaggtcttgacagatgacgagcgacaccatagacagatgcataagtg

SEQ ID NO: 19918 - DNA, 425 bp, Zea mays
  Clone ID: cC-zmle189095b06a1
cagaatctatttcagtccaaatgaaggggatttccaaattaaaagctatgtttccttgttcgcagacaacaaatgaaggaaaattctacagcacatgacacattcctgccatcaatgaaagattgggcataggtgcacaacaaatttaactattacattagatgccaaagctgaggtttaaaaaatacatatttttagtacctaatgtcctgcaagaaccagccaaccggtacagcctgtcccttattctcctttggtttcaacaccaacagaaaatattcattttttctctgctactatttaacttggcacacgaccagagaagttcaatcatttgaacctactattgaacttagaaaagcattacaaaggttgattttaccgaaaggaaaaaagaaagaaaggcacctttagccctgggaaat

SEQ ID NO: 19919 - DNA, 536 bp, Zea mays
  Clone ID: cC-zmle189095b06b1
agaaatgtcttgactcatgtgttgcaagaaagtgggtacgcacaaaagattgacatttcaccctctgagactttatgaaggtaagcgtatttctcctttaagaggtaaatttactcagtcataactcataaacatgttatcaccattcataatctactttgggcacataaatattactttcatgttaccacaagatgttatgccaatgttcttacagatggaaagaagatatcaaatgcagtcaagctgtcaaggctagttcctgattgaatgatcaggtattgcgctattcttaatttcttttccgttgtgtttagttttggatatttttttattgggagtacaaaggggtcccaaatagcacatattctatcgtggttatatcattacctacttgcatggaattgcaatgtatgaataaaagaaatatcataaatggtgctgcaaataattcaatacggtaagcaggaccaaattgtagtatgttttacaacatctctgccttagtgctattatgttttaagtagtgaatggca

SEQ ID NO: 19920 - DNA, 395 bp, Zea mays
  Clone ID: cC-zmle189095b07a1
cgctgcacctggtggcttgagacgccgtcctgcagcagcagcgtgatggcattggggtccttgtggcccggcagcccgtaggtgagctccggctgcgggcacggcgggtagtagttcaccgccatgtgctgcgcgtgcctccccatggccgccaccatgtggctccgctccaggcccaggctctccgatatggcctccagcagcctcagcgccagcgccctggcctccgtcgcgtaggtgcccaccacttgcctgaaggacggcgggtttgacggccactggtcgacgaagctctggagggggtagcaatgcaggcgcaagaagttgcgccagttgctgaccttctccgtgcgcacgttgaagctggtggacagccggatcgccttggtggggtc

SEQ ID NO: 19921 - DNA, 327 bp, Zea mays
  Clone ID: cC-zmle189095b07b1
cgtttacttgtgtgatctacgcgggggcggacgcttagtgatgtattgctcggagcttaatttcacggtttaacaggggatctgtgaaccccaaggcgctctctgctcgactcgtggctcaccatggatgggctgagattaatgatattgctatgagaactgacattcccgtcctagacaatgttgacaacgagtccggcgccgggatcccgctcaattgacctcaagaagcttaacggcccggagcgccgtaaggtggtggaggccattcggaaggcctgcgaatccgacggtttcttcatggtacgtaacgggactgtacgacga

SEQ ID NO: 19922 - DNA, 426 bp, Zea mays
  Clone ID: cC-zmle189095b08a1
gggaggaacagaggtttgttatttgccaacagattacacacatgattggcattccacacgcaaccgatcgatatgacgattatactcctatttattagcaccagctatatatatatagccatgtctggagtctggactagcaagcaaccgagatcgatgatacagagatagattcatcggtttgcatgagcatgacttgttggcagccactatgttacaccaccatccaccaacgcatgtacaaagttctgcatcatcatcgcatcgcctccgcctgatgatgatagatcagtgcagcgccgtcaggacagtagacccttccaccaccttgaaagtggcaccgcagatctcttcttcgtcggcggggacagcggtgaccttgtgcttggggttctcgtagcacttgagccctccgagggcgttgga

SEQ ID NO: 19923 - DNA, 445 bp, Zea mays
  Clone ID: cC-zmle189095b08b1
cagcattttctgcttgctttgtgggggaaggagagagagagagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccct

SEQ ID NO: 19924 - DNA, 385 bp, Zea mays
  Clone ID: cC-zmle189095b09a1
gttggggacaaaatacatggcatattattttctctccccaccctttcatatacagggacgtaaacacaccacgaaagctttaatttcaggacaactagtttgttttcagaagtacaacccagtttagaggaccatgttttattgaaaaccatatatgtagtattcattattcaagcacacaaatgactaaacaaggggcgatctactatgctggtatttctgtcgagagtcatcctcggccgcaagctttaagcaatcccaagccgtttttttgtttgctcaagtaaaaactgggggtcccgtttaggctgggagaatgcatcaatcttgtcccggacccttgggcggacccctgggcggaccctttggcggacccctgggccga

SEQ ID NO: 19925 - DNA, 382 bp, Zea mays
  unsure at all n locations
  Clone ID: cC-zmle189095b09b1
tttactcgtccgcccacgcgtccgcccacgcgtccgcccacgcgtccgggacaagattgatgcatacacacagactaaacaggacccacagtttttacttgagcagacaaagaagcggcttgggattgcttaaagcttgcggccgaggatgactctcgacagaaataccagcatagtagatcgacacttgtttagtcatttgtgtgcttgaataatgaatactacatatatggttttcaataagacatggtcctctatactgggttgtacttctgaaaacaaactagttgtcctgatattatagctttcgtggtgtgtttacgtcactgtatatgaaagggtggggagagagaatgatatgccatgtattctgtcncaaagg

SEQ ID NO: 19926 - DNA, 352 bp, Zea mays
  Clone ID: cC-zmle189095b10a1
aacctatcttttttgttttgcctttcctctggggggggcccccaaaaaaaaaaaaaccccaaattttttggtgccacgaccctttttttgggtgggcaaaacgccccccaaaaccctttgggtttcccttccaaaccacgaaacttatccccgggggcccccccccccaaattcacccccgtttctagtcccccaaaaaaccccccttaccaggggggggggcctttaaaaccccctccctaaacccgcgtttgttaccaaaaactctgcaaaaggggggtaacccttttttttttttcctggggggggaccccgggctttggcaatcttcaaacccccctctttttttttt

SEQ ID NO: 19927 - DNA, 477 bp, Zea mays
  unsure at all n locations
  Clone ID: cC-zmle189095b10b1
ctttactttccgggtcgtagaggatggctatgagtttttcgcaaatcgccagcttgtaacaatattctcagcaccgaactactgtggagagtttgacaatgctggtgcactgatgagcatcgacgactccctagtatgctcgttccagatactcaagccttctgaaaagaaaagaaaagcaggagctgagaacatgccaaagcccggtacaccttccaggaagataaaaataagtgttacccgcatttagccagattctcgttatcaaactggatttgagaagttgtgattaaatgctccccaaacttgttatggtaggttttttggtgagcttaacacggtgttaaactgtggagtgtggaccaccgtgcttatgtcttgctgatctgaagtcatgcaaatgtatcctgtcngtttgccaaacaaaaaagatcatgcttacagaaacttctggattttttttttattgtggacctc

SEQ ID NO: 19928 - DNA, 360 bp, Zea mays
  Clone ID: cC-zmle189095b11a1
gaccacagtttttttttttttttttgaggaaacttatgatacatggattagggttacagcaatcagaaccagaacgggggagtttcagttttattacatgtcttgatgtactaagtattagacattcattgacgtcgatgcttggcggggttaaaaatccatgcgaggaactgctccgaattctaaacatcaccaaatgctttttgttgcaggatccatcgttacaaacaggcagcacttttgatctacttgctgcacttgcacaacttgtttttttttctttccgagcccactgcccacgcatgttggcctaaattaacccgatcaggccgaaatctttactaatacaccggccgatca

SEQ ID NO: 19929 - DNA, 353 bp, Zea mays
  Clone ID: cC-zmle189095b11b1
cctacttcgtccgggggtacgtgaccaagtgctccggcgagggcatctacttcgcggcgaagagcgggcggatgtgcgccgaggccatcgtggcgggctccgccaacgggacgcggatggtggaggagagcgacctgcgcaagtacctggccgagttcgaccgcctctactggcccacttacaaggtgctggacatcctgcagaaggtgttctaccgctccaacgcggcgcgcgaggccttcgtggagatgtgcgccgacgactacgtgcagaagatgaacctcgacagctacctttacaagcgcgtcgtgccgggcaacccgctcgacgacatcaagctcgccgtcaacacc

SEQ ID NO: 19930 - DNA, 337 bp, Zea mays
  Clone ID: cC-zmle189095b12a1
aaaaaaaaaacaacaaattttttttaattctcaaccaaaccatatgccataatttgggttccacatgataattttagaacgcgttcttccattaccaagggggggggaaggaaaacaacctggtggtcccaaccacacctagaacacgccccctaactttggggtgggggggggccccaaaaaaaaaagaggggctttcccgggggggggacccccccaaactggccaccgggcgtggccccccccgacacgagcagttcatcgttcgaacaaaaaaaaggggaggggcttttcccagcaaaaaaggaagggagccacccccccccttttttatttt

SEQ ID NO: 19931 - DNA, 536 bp, Zea mays
  Clone ID: cC-zmle189095b12b1
cttactttttccgcggacgcgtgggcggcggcgacgagaagtggcgagccccgagagcgggtttagttagaggctacgggcggtcgggcgcggcggcggcggcggccatgagcagcgggagcgagagcactaccgccagcaggtggctcgagctggccacgctgcgcgcgctggcgcgcgacgccgcggagcagcttcggctgccgcgggccggcacgtcggcgtcggcgtcgtcgtcgtcgccgtggcgcgggcgcgaggaccacctccacggccacggcaagacggccaaggtgatgcacctgctgctctggggacccaagtgaagcggcggcgagaggccaccgtaccgccgggctctcccgccggcgttgctcgttttgctctgcctgcaatccgccccgcacggactgtactgtacctatacacctatatactacgacgtgcacctgtactacgacgtgctgctgtaccatactaatactagtgcgctgctgctcccttggcttctttgtttgaccaaccactcccgtttt

SEQ ID NO: 19932 - DNA, 354 bp, Zea mays
  unsure at all n locations
  Clone ID: cC-zmle189097c04a1
ttttatttttttcgaaaaagatatcgnccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgttgatccttttttattacgtcttgttttac

SEQ ID NO: 19933 - DNA, 453 bp, Zea mays
  Clone ID: cC-zmle189097c04b1
tatgctttgtctacactaatggtgattccacctccgtgattgattcaggaatacccatgcaattatttagaattagagttagatttcttgaaagatcaacatgcttatgatgaagacatcccatctgtagtaaatgtgtccatacaggaaccagaaccatccaaacagacgccagagccagtggaacaatcgttgttgtctgcactttcttgtagacaggctgagaaccggctcaggatagcatcagaagcttgttatgatggtgaaagttctcattgggcatcatcagcttttcacataaatgatgctgcccgccacaaatctggttcaaagtctataggaaagcacatagccgcattggaatctggtagacttcttaaatccaaagttcagaagattactgaatcgcatcaagaaggggcaattgctatgagtagttttcttcgtatgcct

SEQ ID NO: 19934 - DNA, 478 bp, Zea mays
  unsure at all n locations
  Clone ID: cC-zmle189097c05a1
cgaaaaagatatcgnccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaacttttcgggtcgatccttatttattacggccttgcttttactcctatattgggaggtaccttacgtattgcttgaccgaaaaccaatagtggatttgtttctggcttttggtgaatcttcttcacggcttcggagagaaatttgttagcgcatgattttttttcggctttataat

SEQ ID NO: 19935 - DNA, 498 bp, Zea mays
  Clone ID: cC-zmle189097c05b1
cattgttgttccaaaagtaccttaccggattcccggagatgaagaagcgacttgggttgacttatacaatgttatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacaccagaatttttactagaagtggaagagttacacaaagttcgcgaaatgatcacaagggtttatgcactaaaacaagcaagcctttttgggtt

SEQ ID NO: 19936 - DNA, 342 bp, Zea mays
  unsure at all n locations
  Clone ID: cC-zmle189097c06b1
ctatcatcatcaggcggaggcgatgcgatgatgatgcagaactttgtacatgcgttggtggatggtggtgcaacatagtggctgccaacaagtcatgctcatgcaaaccgatgaatctatctctgtatcatcgatctcggttgcttgctagtccagactccagacatggctatatatatatagctggtgctaataaataggagtataatcgtcatatcgatcggttgcgtgtggaatgccaatcatgtgtgtaatctgttggcaaataacaaacctctgttcctcccaaaaaacanaanataaaaataaaaataaaaaaaaaaaacaaaaaaaaataaatcc

SEQ ID NO: 19937 - DNA, 402 bp, Zea mays
  Clone ID: cC-zmle189097c07a1
caggcaaatgcacaaatcttacagaagcaaacgggtccggaattcacggttacaagcagttcagcctgacggcgacgactgctggtccaaggaagcaaacgatgcgagcggcgccggcgcagcggcggcctgagacagtctacgatgcatgcacgtgcacgagagaaactaaacggcggcgagcggggagagagcgctggatgctagctgcgctgcgctgcgcacccctgggtcggtcggcttcggcttttagtagtcggtggaggggagctgctcgtgggtgtgggagatgaagagcagctcgtagatgacgccggcgaggccgccgccgatgagggggccgacccagtacacccactggtagccccactcccagctgacgagggcggtgccgaaggacac

SEQ ID NO: 19938 - DNA, 483 bp, Zea mays
  Clone ID: cC-zmle189097c07b1
ttctacaccgggcacaccccccgagctcagcgtagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgagggctcctgtactgggtggcgcaactgctggggtccaccgtggcgtgcttcctgcttcgcttctcgacgggcgggcagg

SEQ ID NO: 19939 - DNA, 401 bp, Zea mays
  Clone ID: cC-zmle189097c08a1
caggcaaatgcacaaatcttacagaagcaaacgggtccggaattcacggttacaagcagttcagcctgacggcgacgactgctggtccaaggaagcaaacgatgcgagcggcgccggcgcagcggcggcctgagacagtctacgatgcatgcacgtgcacgagagaaactaaacggcggcgagcggggagagagcgctggatgctagctgcgctgcgctgcgcacccctgggtcggtcggcttcggcttttagtagtcggtggaggggagctgctcgtgggtgtgggagatgaagagcagctcgtagatgacgccggcgaggccgccgccgatgagggggccgacccagtacacccactggtagccccactcccagctgactagggcggggccgaaggaca

SEQ ID NO: 19940 - DNA, 472 bp, Zea mays
  Clone ID: cC-zmle189097c08b1
ttttacaccgggcacaccccccgagctcaggttagctcctctccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgagggctcctgtactgggcggcgcagctgctggggtccaccgtggcgtgcttcctgctccgcttctcgac

SEQ ID NO: 19941 - DNA, 329 bp, Zea mays
  Clone ID: cC-zmle189097c09a1
atcagaaaacacagattccattgcagaataacagcatgctaactaacatacatgacatggcacatatgaatccagccatccaggtccagccattccattcacacatcacgaataccttggagacaaaacgcacaggatggatggccttggtacttttcaagcgtcagaaccactgtctgaatcagaatacaattcatacggcctattcctgttcgtgttcgcctcaagggggggaagatcgtcgtcttcttcatcggaatctggttcctcgtcaacctgggcaggctgtgcttatgctcccgcctctgaagcttcattcggagtcggag

SEQ ID NO: 19942 - DNA, 299 bp, Zea mays
  Clone ID: cC-zmle189097c10a1
gaggctgaaaaaggcaaatctttgttctcagaagcaaagatcaaggcatagcgttcttctaaactcaggtttgcacagaacgggaaaaatttcaacatgaacacacaataggttcatactactgctcagtgggagcaaaattgtacgcactagagtaacacagatgtagaacaggtagaaagaccaaacaaacaacctagtatcctcccttaagatcattgaccacatcgtacgggatgggagtgacggtctcgatggtagtcccctcaaccatgaagacaggcttggggcccaacggc

SEQ ID NO: 19943 - DNA, 454 bp, Zea mays
  Clone ID: cC-zmle189097c10b1
ccacgcgttttcctcacgcgtccgccccgatccatttcagccgccgccgtgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccatcccgctgcacagaagagttccgccctgagaaggtgaagaatgaccagctgaaggccgatgcaaaggaacgcggcgaggtcatcag

SEQ ID NO: 19944 - DNA, 213 bp, Zea mays
  Clone ID: cC-zmle189097c11a1
agggagatacggttgagctgttggttattgacgatctttctcccctcagtcgctatgacaaaaacatgaccatgatttgaagtcagatgtgtttgagtaggatattctccaccatccgaccaatattattgtaagatagcccccctggttgtgcactgacttgagccagcctcttccactgcagcgtcttctcccttgcgtccttccccttcc

SEQ ID NO: 19945 - DNA, 224 bp, Zea mays
  Clone ID: cC-zmle189097c11b1
ccacgcgttctgtttggggaaggacgcaagggagaagacgctgcagtggaagaggctggctcaagtcagtgcacaaccaggggggctatcttacaataatattggtcggatggtggagaatatcctactcaaacacatctgacttcaaatcatggtcatgtctttgtcatagcgactgaggggagaaagatcgtcaataaccaacagctcaaccgtatctccct

SEQ ID NO: 19946 - DNA, 337 bp, Zea mays
  Clone ID: cC-zmle189097c12a1
gacacgcaagaaaccggcacatgtaataacgcagaaaaacacaaatacatgcatataaatattaaatccggcacgagacggacatgaccgcgagcacgttacacagatgaacatgaaccccaggagcgaccatggatcgataatggcgggtgcagttgacaggatcttatttagacgctgctattaattatatttatacgcctcgtcgtcgtcgtcctctcgactctcgtgcgccatcgccgggccgggcgggccggctcagttgcagctgcagcaggagcagccgcagctggtgccgcagttgcaggtgttgcagtcgcagccgccgcccttgggg

SEQ ID NO: 19947 - DNA, 465 bp, Zea mays
  Clone ID: cC-zmle189097c12b1
ccacgcgttttgtcttccacacctcttcctcctcttcctcctcctagcacagttagcgcctgctccccttcgtctgtgatcatgtcttgcagcagcggcaagtgcaactgcggctccagctgctcctgcggcagctcatgcaactgcatgtcccctgacgtggagaccgccgtcgccagcagcatcaagaccatggtcctcgctgcgccgaccaccaaggccagcgccggcggcttcgaggcggccaccaagggcggcggctgcaactgcaacacctgcaactgcggcaccagctgcggctgctcctgctgcagctgcaactgagccggcccgcccggcccggcgatggcgcacgagagtcgagaggacgacgacgaccaggcgtataaatataattaatagcagcgtctaaataagatcctgtcaactgcacccgacattatcgatccatggtcgctcctgggg

SEQ ID NO: 19948 - DNA, 459 bp, Zea mays
  unsure at all n locations
  Clone ID: cC-zmle189097d01a1
gctcgnacaatccagcatcgccatgagcttatttttaaaaaatggtgatgcaaatgtcttcaattcggataagttcagaccagagtagaattactcttcgtctgcaaaatagcaatcctactctacaactcccagtggatctgaaccaaaattctcaaaccaaagttctaccctctcaacagatctgaaccgtctggacagcagcctcaagaacgttaagttttaaacggtaagggctccctccggtggctctgccacttgaggcttcggctttggcttctcaacaacaatggcctgcgtggttaggaccattccagctactgaggccgcattctggagcgcacacctggtcaccttggcagggtcgatcacaccagcctccatcaggttctcgtacttgtcagtcattgcattgtagcccacctcccaatcgctctccttgatcttctcgacaaccac

SEQ ID NO: 19949 - DNA, 468 bp, Zea mays
  Clone ID: cC-zmle189097d01b1
tttactcgtgggcggacgcgtgggtcaaagctgttgcatctatctctgctggcaatgatgaatttatcggatccatgattgctgaagcaattgacaaaggggggcctgatggtgttctatcaattgaatcctcctcatcttttgagaccactgttgaagttgaagaaggaatggagattgaccgaggttatatttccccacaatttgtgacaaacctcgagaaatcaattgtggagtttgagaatgctaaggctcttattactgatcagaagatcacaagcataaaggaaattcttccaattttggagaagaccacacagctgagagcccctctgttcattattgctgaggacattactggtgaagctttggcaactcttgctgttaacaagcttcgaggaattctcaatgctgcagcgattaacgctccaagttctggtgagcggcggaaggctgtacttcaagaca

SEQ ID NO: 19950 - DNA, 110 bp, Zea mays
  Clone ID: cC-zmle189097d02a1
cgcctcttgtttttttttttttgggtcttccttttttaccctgtcgccttgcttagccgggcaaaaaaaacacaaaaccaagtttacccaacctcgggcgcaaaaggggt

SEQ ID NO: 19951 - DNA, 425 bp, Zea mays
  Clone ID: cC-zmle189097d02b1
ggtaggtctatcattgttaacgaagcagcctatttcctatactttgaacaacattaaggtagttttttttgcatgttgcggtactgtggagagtaataagacaaaaagactctaggtttaaaccattttatccccgtattctgtattgattatatcttgttttttatccaaaaaaaaaaaaaaaaaaaaaaaaaaaaaaaaaaaaaaaaaaaaaaaaaaaaaataaaaaaaccaaataagagcccctctatggggggggcgttttatgggacccaatttttcggccgcttgcattgcaaccttaaagctttttatatgggggcacctaaattcaatttcttggccggggttttttaaaaacctctgtgttgggaaaaaccctgggggttccccactttattttgcttgcagaaaaaccccttttt

SEQ ID NO: 19952 - DNA, 433 bp, Zea mays
  Clone ID: cC-zmle189097d03a1
atcgacgtattatatatttttattggaacgcacgagtttaaagtgctcttattaaaattgaaacacggacaaacatgtaaggtctccgcgtcacttgaggcttcgtagctccgcatggaaagcctcagcgtgctcctgcttgacgcaaagcgccatggcggcgacgccctcggccttgtcctttttcccgcacaggaagcagcccggcaccaccttgcgcttcatgcacccgatgacgcgctcagcgccgccgctgccgaagtcaacgtcgtccaagccgaggttccaccagctcgtgacgtacagggtgtcgtagccgttgaggcccttgagcccgaccgccatcttgttggcgatgtgcgcggctcctcagcgaacgtgaacgggacccgtgccttggcgtccttgaccagcgtcacaaggtccaggatgt

SEQ ID NO: 19953 - DNA, 461 bp, Zea mays
  Clone ID: cC-zmle189097d03b1
ctttataaaaaaaatcacaatgagctcatgggggccaagtcgctgccttttctcgtggctccggcagtggcctcgcccactgccgccctccagctcacctccatggacagagctctggtttccctgcccgtgtcagcgatgttcgtctacgagaaccccatcgatcgtccggccgagaccattagaagagctctgtcccgtgcgcttgttccctactacccaatggccggccgcctcgccgtcactggggaccagctgaagctcgcgtgcaccggcgagggcgtagcgttcgtcggtgcgtcggcgagctgcaccctgcaggacgccaggctctgcgaccggcgtcccgtggtcagtgtcgaggacctcagtatcagctatgccggccagtacagcgaggaccctccacttctgctggtgcaggtgaccgagttttcctgtggcggctcccttgccggggt

SEQ ID NO: 19954 - DNA, 423 bp, Zea mays
  Clone ID: cC-zmle189097d04a1
ggttgaaactacatatgattttaactgcaatcaagacacagttgagagggcaatcattacaagttcacatgaaacaacagttctgaaaacacactggagggaagaacaaagcaggaactacattgcctttttcagcaactacaactagcagaatgtttcactagaagtcgatggaataaaaagttgcatcttgactaatatgcaatgcataatcttctctgtcttcagattatggttctgtggctcacttggccatcatgaccttgacaaactcctagtagttgatctggccatcaccattgacatcagcctcacggatcatctcgtccaccttctcatcagttagcttcttaccaagatttgtcattgacatggcggagctcggcggccgagatgaagcccgtctggtccttgtcaaacaca

SEQ ID NO: 19955 - DNA, 483 bp, Zea mays
  Clone ID: cC-zmle189097d04b1
cttacttcgtccgggatcattgtgtaccgaggtctttactttggtatgtatgattccctgaagccagtgcttcttgttggtaccctgcaggataacttcttgggcagcttcttgctcgggtggggtataaccattggtgctggccttgcctcctaccccattgacactgttcgccgtcgcatgatgatgacatctggtgaggccgtcaagtacaacagctccttggacgctttcaagcagattgtcgcaaaggagggtaccaagtccctcttcaagggtgctggcgcaaacatcctccgcgctgtagctggtgctggtgtccttgctgggtacgacaagctccaggtggttgtcttcggcaagaagtacgggtctggtggtggctaaggatgtataatgatgatgacgacgaacaacaaacatgatggtttaggtgccttctttaagtaaacatacgtacggaccctcgacaccattttaagt

SEQ ID NO: 19956 - DNA, 452 bp, Zea mays
  Clone ID: cC-zmle189097d05a1
ggttgaaactacatatgattttaactgcaatcaagacacagtagagagggcaatcattacaagttcacatgaaacaacagttctgaaaacacactggagggaagaacaaagcaggaactacattgcctttttcagcaactacaactagcagaatgtttcactagaagtcgatggaataaaaagttgcatcttgactaatatgcaatgcataatcttctctgccttcagattatggttctgtggctcacttggccatcatgaccttgacaaactcctcgtagttgatctggccatcaccatcgacatcagcctcacggatcatctcgtccacctcctcatcagttagcttctcaccaagatttgtcatgacatggcggagctcggcggacgagatgaaagccgtctggtccttgtcaaacacacggaaggcctccttgagctcttcctcagag

SEQ ID NO: 19957 - DNA, 491 bp, Zea mays
  Clone ID: cC-zmle189097d05b1
ctttcttcgtgggctctccgcttcccgctccgatcgacctgctctttccccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgt

SEQ ID NO: 19958 - DNA, 290 bp, Zea mays
  Clone ID: cC-zmle189097d06a1
gaagtgaacggtaacacgatactttagggggttttttaaaactcggccgaggtccaggttgggcccacaaaaaagtcactgcaggcgaacgggcgcgtcgataaaacaataaccccaccttttgtcgtacccgccaaaatctatatagactgggttgccttcgtcaccaccataggggactccgtcgtggaaaccctgggacagtaataaccaccaacacggtgggggaaatgggaggcgaccccaccaagaacggaggggaaggctctgccgtccccaacttctgggga

SEQ ID NO: 19959 - DNA, 484 bp, Zea mays
  Clone ID: cC-zmle189097d06b1
tagtgcttttagctccagctggacgcattccctaaagggcgtacatgtatagccttccagtcatcatatgctgggtatccgacctatagacacatacggcatgttgcagatcgatcgccaggctctcagaacaagacccttgtatagtagatgagtggaaacctatctaaataatgtgtgcggcttctaaaacatgtggtggtattggactgagctatgctcaatactaaacaatctactattgaaataacaccatgggaggagctatatcgaacatgaatggatgggggctcgacggacacaacatcactagtttgcaggacaatgcaccagggggtggccgttgttgaggatccaattttcagcccgacgaagcttcatcgtgtgcagcaagaaaaggttacctgaacttgactatcagttgccactagttcaggattcttgagtgggagaatattatcctatcctacggtgtaagcctaac

SEQ ID NO: 19960 - DNA, 308 bp, Zea mays
  Clone ID: cC-zmle189097d07a1
tttttgtttttcctggagtaaaaactgacatggggctggattgttcccccactatactggcgggatggtaatttacaagagcctatcttcctgtgtatgctgcaccattgaaccaaaaacaatgaactattcataagctacacatatgtggttaatcgagaagcgctacaaaatcgacaccttgaaatataatgccaaaacttttggacagcgaccttcttgccgacaggaatctgattggtttcttcaacaatcaacatgaaatggaaagctggtggttttttcaagaacataccttacctcacatg

SEQ ID NO: 19961 - DNA, 480 bp, Zea mays
  Clone ID: cC-zmle189097d07b1
tttgtagtctcaactgtgtctgaggataaagaggcaaaggttgatgctgatagcataagaaagatccagtattcatttggggttgtatctgttcccacattgagtgtgggtgattcctggtcatgcaaattagaaatcaaatggcatcgagcaaaatcagtcatgctttatgtttcacttggttactccctaggctcaagtgaagaagaagcattgcaccggcttaacgtccatagaagcttgcaaattgaagggcagatccccttattagttagtcatcagtttttgagaacatttaggcgagaaccgttgttgctatcagggatcaggtccttaggaagtgatgataaaaaatgttctcttgctatgaatgagtctaacatgctaattgtgactgcaagaaactgcactgaagtgcctttgtgtttgcattcaatgaccattcaacctgatggtgattcatagcagctgtgttcagtg

SEQ ID NO: 19962 - DNA, 102 bp, Zea mays
  Clone ID: cC-zmle189097d08a1
aacaccacaaaattttcccaatctacttctcgggggggcacccacataacaaagggaaaaaagagggccaaaaaaaaacaaaacaacaacccaaaatcaaaa

SEQ ID NO: 19963 - DNA, 409 bp, Zea mays
  Clone ID: cC-zmle189097d08b1
ttctagcgcgacttgagggcgagaaagaggtgactggaggactagtgctgtctgtttacgctgcatagaagtgttaattgtactcatctagctgttggaagcatgggccctaggccttgtatacatcatagtagtacatagcagtccctagctgaactggaaccgagcctgacagaaaacacagacataattgctcgagaccagaaatctctttgaaattggatggatgttcttgtaattatgagcaacatgtttacaatgaataaaatgcgatacatcaaaaaaaaaaaaataaaaataaaaaaaaaattaaaccataaaaaaaaaaaaaaatttaaaatattataaaaataataaattcccaaaaactaaaatatcattttttcaagggggggccgttttgaaggat

SEQ ID NO: 19964 - DNA, 416 bp, Zea mays
  Clone ID: cC-zmle189097d09a1
attccttatgatgttaaacatgaatttttttgattagggggcagcatgttcaaaatattcttcgaatctatcatttcatgccacgcagtacaatcgaatttttaggataagcaaccgtcccgagtttgtctaaagagacccaacaccactatacgagtgacaccgattgaaaaaatatacaggggaaagcaaaagaatgctgcaatgagataattggttgtgaattgcagcacaccgattgcagactcgttcaactcccccatgttcctccttcacagcatttcctgagacctgcggacacattgcctaaccttcttcttgaactcatcccgcttctctctccaatccttggcagcttcaatatttgctggagactcgtcattcggactagagagcattgaaatgatgctcagaac

SEQ ID NO: 19965 - DNA, 466 bp, Zea mays
  Clone ID: cC-zmle189097d09b1
tttttacgcgtgggggatgggcgtgtttgcattgctattcttcatccacctggtgaagatcccagtggttatgagcttgcaagcgaacggtggacaccagtgcacacggttgaaagtatagttctgagcatcatttcaatgctctctagtccgaatgacgagtctccagcaaatattgaagctgccaaggattggagagagaagcgggatgagttcaagaagaaggttaggcaatgtgtccgcaggtctcaggaaatgctgtgaaggaggaacatgggggagttgaacgagtctgcaatcggtgtgctgcaattcacaaccaattatctcattgcagcattcttttgctttcccctgtatattttttcaatcggtgtcactcgtatagtggtgttgggtctctttagacaaacttgggacggttgcttatcctaaaattcgattgtactgcgtggcatgaaatgat

SEQ ID NO: 19966 - DNA, 371 bp, Zea mays
  Clone ID: cC-zmle189097d10a1
tttttggctgatatatacagtttatataattcggattaaaccggtcctagtcatcatatactctaataataagaactgtatttacaagacaacccagaaacattctctgtcccaaaataaatcaatttctcagagttatcttaaatcaaactatttttaagtttgaccaaattcataaaaagagcacggcactgaattagtgtcactaatgcaccataaaataattttcataatgtactcatttggtgtcatagaaacatagacgacggtacctttcctataaaattggtcaaacttaagataatttgactttaagtgattctagaaattgacttattttgagacggcggacgcgtgggcggacgcgtggg

SEQ ID NO: 19967 - DNA, 373 bp, Zea mays
  Clone ID: cC-zmle189097d10b1
ttcttacgcgtccgcccacgcgtccgccgtctcaaaataagtttatttctagaatcacttaaagtcaaattatcttaagtttgaccaattttataggaaaggtaccgtcgtctatgtttctatgacaccaaatgagtacattatgaaaattattttatggtgcattagtgacactaattcagtgccgtgctctttttatgaatttggtcaaacttaaaaatagtttgatttaagataactctgagaaattgatttattttgggacagagaatgtttctgggttgtcttgtaaatacagttcttattattagagtatatgatgactaggaccggtttaatccgaattatataaactgtatatatcagccaaaaa

SEQ ID NO: 19968 - DNA, 506 bp, Zea mays
  unsure at all n locations
  Clone ID: cC-zmle189097d11b1
ccacgcgttttttctgttctgggcgagcagctttcagctgaggatgaagaagctgtcatggccgagtttgaaaatttggaagctcagcttgccgttgagtctttgccagacgctcctgctaccgaagtaaggcctgaagagaaaacgaaagctccggctgacacagaagctgctcctgaggacatcgatgacgttatcgagcttcctgatgtgcctacgaaagtgccagagaggcctgaagctccagaaaaaaacaaagttttggaggagccgctacctgcataagtggatggagctgagatgaatacggcacacttagtttgcaggaaattgtaacatacccaccatttcattgtactatctcattctcagccataccagaatttcatcgtgtacagcaagaaaaatttgttgtccttgactatcagttgtcactagtttggatttctcagtgcccgtttattatcctatcctacggngtaagcataatattttttcattgtgtt

SEQ ID NO: 19969 - DNA, 301 bp, Zea mays
  Clone ID: cC-zmle189097d12a1
cacagatgggttttatccatggcaggggaacccgaataataataatacagacattttaccaaaaaaataaacgagggctagtcgtctgcaaccatcgcacaagtgttataaaaacaaaacaatgggacgcgtgcctcaatacatagcccttagtagtatcaaacaaagggggacatactattttaattattaatataatactactacaccggggtatactcccgtctcgtcgggggacatgcgcatgacgatatacatgcccatccattcggtattattggttggtcattcattcgggcat

SEQ ID NO: 19970 - DNA, 403 bp, Zea mays
  Clone ID: cC-zmle189097d12b1
ccacgcgttttcttacgcgtccgcccacgcgtccgcccacgcgtgcggactagttctagatccccatcggatctgtcgtcgggccactcgaagctcggatgcacgaatgaatgaacaaacaataataacgaatggatgggcatgtatatcgtcatgcgcatgtcccacgacgagacgggagtataccacggtgtagtagtattatattaataattaatatagtatgtccacctttgtttgatactactaagggctatgtattgaggcacgcgtcccattgttttgtttttataacacttgtgcgatggttgcagacgactagccctcgtttatttttttggtaaaatgtctgtattattattattcgggttccactgacatggataaaaaccatctgtgaaat

SEQ ID NO: 19971 - DNA, 407 bp, Zea mays
  Clone ID: cC-zmle189097e01a1
gttcaaaagaacccctcctaattcactaatttgtaggaagatactgaacttttggatttgaaaaaagtttcagaagatatatctaaagtagatggtgattgatagagcaattcttgttcgtaagttccagtgtgagtactgcgccgaacataaagtttgtgacgggtagtaaaagatctatttttcttttgactttgacatagagttcgatcctcaattatttctcgcgctatcttcttacgaagttttgttagggcatctataacagcctctggtttaggcgggcaacccggcaggtagacgtccacaggaattaacttattaactcctcgaacagtactataggaatctgtactgaacatgccccctgtaatagtacaggctcccatagcaatgacgtatttcgg

SEQ ID NO: 19972 - DNA, 482 bp, Zea mays
  Clone ID: cC-zmle189097e01b1
ccttctcgtccgcattgagacaattatgagtttgattgagtttccgttactcgaccaaacaagttccaattccgttatttcaactacactaaacgatctttcaaattggtcaagactctcaagtttatggccccttctatatggtaccagctgttgtttcattgaatttgcttcattaataggctcacgattcgactttgatcgttatggattggtaccaagatcaagtcctagacaagcggacctaattttaacagctggtacggtaacaatgaaaatggctccatctttagtgcgattatatgagcaaatgcctgaaccgaaatacgtcattgctatgggagcctgtactattacagggggcatgttcagtacagatttctatagtactgttcgaggagttgataagttaattcctgtggacgtctacctgccgggttgcccgcctaaaccagaggctgttatagatgccctacaaaact

SEQ ID NO: 19973 - DNA, 458 bp, Zea mays
  Clone ID: cC-zmle189097e02a1
tagacagaaagaacagggactcattcaacacaagacacaacaagctgcagccgcggcaggcatggggcaccgcgcgcactgacaccgggccccaccaccattaccacccgacgcacactttatttagcccacgtcactcgcagcccgcaccggacacgtccacgcgacagtcactggtagctacgtaccgggctacgtacgacacacacacacacacacacagagagacgccagtaaccgtagcgtactgaacagcaaaatcccgtgtcatactgccatgtacgcgcgcgagagactaccccgccacgcgcgcacgccgatcccctggggcctgggccctggccgccgccgctgcgtgcgcacgggctcactcgctggccttttcgggctccttaggagcagcagcctccggctcggcgggcggctttctgggaccagcaggagcaggagcaggagcc

SEQ ID NO: 19974 - DNA, 419 bp, Zea mays
  Clone ID: cC-zmle189097e02b1
gttctttccatctcactctccgctggtcgctcactcttgcagcttcacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggcttctgctggtgcccaggagcccgtcgcgggcgaaccggccgccgaggcggaggctgctgctcctgctggtcccgaggagac

SEQ ID NO: 19975 - DNA, 500 bp, Zea mays
  Clone ID: cC-zmle189097e03a1
gctgtcgaacgacttttaaccaacactaggaatgccgaggggaagtagcaccctcgatcacattatcatacaatacaattacaggctccgtgccgctaatagcagagccctggtagttacgggtccgacaaatacaaaagcgcaacagcaatgactaggaaagaacgcaaaagaaaacacgacaagcccaacacaatcccacagctaatctcgcctttctagttcccttccagcagctaacctcgcgctgcagggcacgccacttggctcacttgtactccaggatcatgttgttctctggggccagcccaacgcaggccctcatgatgttctccagcatcgccctctgcttggccagagcgttcaccaccggtgtgccagggggaaccaggggtgccttggtgaggtagctcaggatggtggccaccgggtggaaggagtggaatttgtcctctcccttagctttcaagctgatccttgtgctgagctcagccaagagc

SEQ ID NO: 19976 - DNA, 483 bp, Zea mays
  Clone ID: cC-zmle189097e03b1
ggttgtttgatcttgctataaaaaacaactgcttgattggtggtgacgacttcaagagtggacagaccaagatgaaatctgtcttggtcgatttccttgttggtgctggaataaagcccacctcaatcgtgagctacaaccacttgggaaacaacgatggcatgaacctgtctgcccctcaaacattcaggtccaaggagatctccaagagcaacgtggtggatgacatggtctcgagcaatgccatcctctatgagcccggcgagcatcccgatcatgtcgttgtcatcaagtatgtgccgtacgtgggagacagcaagagggctatggacgagtacacctcaaagatcttcatgggcggcaagaacaccatcgtgctgcacaacacctgtgaggactcgcttctcgcccgacctatcatccttgatctggtgcttttggctgaacttaacaccaggatccagctgaaagctgagggagagg

SEQ ID NO: 19977 - DNA, 391 bp, Zea mays
  unsure at all n locations
  Clone ID: cC-zmle189097e04a1
cctcagcatcaacacctttgtgtccaatgtactacaactgcatgctaagtaatgctatttttggctttcgggctagtgatccaacaccccgtcaccattacaaatacgccataaaccccatgcaatagataaaaggacaaagccttgccaggctgncatgaagagagcggaatgccccaaggtgggtatcgaacaatcgaaaaggactggagtttttatgccggaaaacgctatgcatgaaaaataggacgaagattgcaagcagagacttgctagacgagattgcctgactctcctcatgtttacaagaggacggcgaagccgaagaagacgctgccgaagacggcggcgagaccaagaccggcgttaggcatgaagatggagccagcac

SEQ ID NO: 19978 - DNA, 486 bp, Zea mays
  Clone ID: cC-zmle189097e04b1
ccttactcggagcagtggacgcgcgagcggagggcggccgttgcgctggcggagttccgggcgaggttggaggaggtcgcgggcaacatcgacaggcggaacgcggaccctgcgctgaagaaccggacggggcaggtggaggtgccctatacgctgctcaagccgacggcacagcccggactggtgctccgtggcatacccaacagcatcaccgtttgagcagcagagcgccgtcggcagctgtcagctgtgtacagtacagaataataaggtggtcgtgtttggcgctatctccaccacataaacgtgaaaatgtttttttttgaattatatggacatgcagggccgcagcccgtaagcctggccccagtttcggttttctgtttttttttttttgcctcgatctggggatcagcaagccacgtcggtccgggtgatctcgctaccggagatagaatgtgtacacgaaacctaataggtttttac

SEQ ID NO: 19979 - DNA, 411 bp, Zea mays
  Clone ID: cC-zmle189097e05a1
cctcagcatcaacacctgtgcgtccaatgtactacaactgcatgctaagaaatgctacttttgcccttcgggctagtgatccaacaccccgtcaccatcacaaatacgccataaaccccatgcaatagataaaaggacaaagccttgccaggctgtcatgaagagagcggaatgccccaaggtgggtatcgaacaatcgaaaaggactggagtttttatgccggaaaacgctatgcatgaaaaataggacgaagattgcaagcagagacttgctagacgagattgtctgactctcctcatgttaacaagaggacggcgaagccgaagaagacgctgccgaagacggcggcaagaccaaaaccggcgttaggcatgaaaatggagccagcaccccctttggcggatgagccg

SEQ ID NO: 19980 - DNA, 487 bp, Zea mays
  Clone ID: cC-zmle189097e05b1
tttctcgtgggctttatatttgattgtccaccgtctgtcgctgaccgtctattattttaataccttcgctgcatctccgctaatactcctccaccatcaccaccaccccaaccgtcaacatgcgttccgtcttcgccctcagcattgccgccttcactggcctggtcgctgctcaggacgctccccagatgagctacccatacaccattgaccccgacaccgtcgaccagtctaccagggattactggtgcgaccagaacagggcacagtgcccgctcatctgcctccaacagcccggtgtcgactccatgaccaccgagcagaacgactgcgattccgacgctctgacctacacctgtgtctgtgacaacggtgtctctcccaacatcacccagtactcgcagaccctgccatactttatctgccaacaatggggaaacaactgcgtcgccaactgcaacggtgacagcacttgccagagcgcttg

SEQ ID NO: 19981 - DNA, 332 bp, Zea mays
  Clone ID: cC-zmle189097e06a1
atcacccaaaacgattgtaagcgttgcacaaatcatcaagccgttgattcagagaacatggcataacatctaacgagtatcccctttttacactggttacaacatagtacaaggacaccatgcatcgcactcgcaccacgagcattccatcattgacagtctactcagcagtccttccccaccaaaaaaaatgtgaagtttcatatatatcggccatcaacctgacgatgcatgtgtggtagcactcctcaaaatgctaataataagttcaactcctcatttgggggtgaaggcctggaagatggtggcgtggcccgggtccgcgaggtggg

SEQ ID NO: 19982 - DNA, 487 bp, Zea mays
  Clone ID: cC-zmle189097e06b1
cttactcgtccgcccacgcgtccgtcgggtaccctggtggcctctggtttgacccgctcggctggggcagcggctcgccggagaagatcaaggagctgcgcaccaaggagatcaagaacggacgcctcgccatgctcgccgtcatgggcgcctggttccaggccgagtacaccggcaccggccccatcgacaacctcttcgcccacctcgccgaccctggccacgccaccatcttccaggccttcacccccaaatgaggagttgaacttattattagcattttgaggagtgctaccacacatgcatcgtcaggttgatggccgatatatatgaaacttcacattttttttggtggggaaggactgctgagtagactgtcaatgatggaatgctcgtggtgcgagtgcgatgcatggtgtacttgtactatgttgtaaccagtgtaaaaaggggatactcgttagatgttatgccatgttctctgaat

SEQ ID NO: 19983 - DNA, 196 bp, Zea mays
  Clone ID: cC-zmle189097e07a1
atataagtggagtatttattattattttttggtttttcataaaaccatacaagatatttttacagttactcgtgctcgaccaaaccatacttgctcgggggcccccagggaaaaataacgcgggtgggcacaatcgcgtcgtgggcaaaacaatactattcccttccgggaatatacttgaacaaaaagggaaaaa

SEQ ID NO: 19984 - DNA, 362 bp, Zea mays
  Clone ID: cC-zmle189097e07b1
ccacgcgttctatgaagctctctgacgagcgcaagctacgcaagcgcaatctcgactcctactagcaagcttgaaggatgatgtcagcagagaagcttgaaggagccctagctgcacctacactagctagcaatgtgcctcacatagatgcatggtattggtagctagtcatttcttactttttataactatattaatcaggaaacaaacacatatgtcgaccaataaacatgtaagtccaatcatcatttgtttgcctatggtctcaaaaaaaaaaaaaaaaaaaaaaaaaaaaaaaaaaaaaaaaaaaaaaaaataaaaaaaaaaaaaaaaaaaaaataaaaaaaaatttaaaaataaat

SEQ ID NO: 19985 - DNA, 484 bp, Zea mays
  Clone ID: cC-zmle189097e08b1
tttctttcgcgtccgcccacgcgtccgcggacgcgtgggtctttgtaaacaaagagggacgtgtcggagaccgaagcgatgaactcgaggcggtgtaagtatgtgtcaaagcactggaaccatgcccaagagcctgctttggctcatagagggaattctgcaactgacaaacatgattagggccgaaggagtcgataaagccaaatagctgctgacaatagaccatctcctcgaggtggccatgaaggaacacattcttgacgttcaactattagatgggccaggcacgagaggtcgcaatgttgaggatgacacgaatggtgggaggttcgaccaccatgttgaaggcctcattatagtcgatgttgtgttgttgtgagaagccccggaccatccaacgtgtcttgtgatgagcaagtgtaccatcctagtggaacttgggcttgaagttccacttgcctgtaaccacattggtgccaggatg

SEQ ID NO: 19986 - DNA, 483 bp, Zea mays
  unsure at all n locations
  Clone ID: cC-zmle189097e09a1
agcgtatactcctagtgagaaatatccatttcctcgaaccaggatcatttgcttgtttgatcaataccatcctaccctagagtgcattgcagaaagcacattgtatttgggggcccatgatcaacaagaccctatctcgtgaagtagtagtaattgtacattttccattccgaacattaaccgaacacctggagagcaatgcgaacagacagagtctcgattccattcaagagggcaaatgtaaactggaccggtgaccacgcaccgggtgaggaagacggggagccatcaatcagttgtccccctcgggctcgaactccgggtcgccgtctgggtgcatctccctccactggtcctcgggccagtactccttgatgtggccccacttcttgcggaacttctcgatctggctgtccatgaccacgagcgccgaggtgtcgccgacatagtaggggtggtttcccgaccacacgtncaccgtgt

SEQ ID NO: 19987 - DNA, 475 bp, Zea mays
  Clone ID: cC-zmle189097e09b1
tacttaggcagccgaagcgactgtcgcgaggcaaggccatctgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactatgtcggcgacacctcggcgctcgtggtcatggacagccagatcgagaagttccgcaagaagtggggccacatcaaggagtactggcccgaggaccagcggagggagatgcacccagacggcgacccggagttcgagcccgagggggacaactgattgatggctccccgtcttcctcacccggtgcgt

SEQ ID NO: 19988 - DNA, 301 bp, Zea mays
  Clone ID: cC-zmle189097e10a1
agcaaccgaagggtagggggggataccatatatcaacatacgatccatcatattataaataaacaatacggcacaaacagatcagctcccgaaatcgacaagttccaatgcctattataacggcaagtgcgacagcaggtaccgtcttcggaagccaagccagcaacgaccgtcgaccatacatgacatccagataaaaccggattgggcggtttctccttattcttctacgtaacacgaagtacgttactactacagctcacacagttacgtcagttcactggctgctcggacgcgtggg

SEQ ID NO: 19989 - DNA, 322 bp, Zea mays
  Clone ID: cC-zmle189097e10b1
ttcttacgcgtccgagcagccagtgaactgacgtaactgtgtgagctgtagtagtaacgtacttcgtgttacgtagaagaataaggagaaaacgaccaatccggttttatctggatgtcatgtatggtcgacggtcgttgctggcttggcttccgaagacggtacctgctgtcgcacttgccgttataataggcattggaacttgtcgatttcgggagctgatctgtttgtgccgtattgtttatttataatatgatggatcgtatgttgatatatggtatcccacactacccttcggttgcttaaaaaaaagacacattct

SEQ ID NO: 19990 - DNA, 395 bp, Zea mays
  Clone ID: cC-zmle189097e11a1
aagaagagacttggtaataaaattacacaaggatcatcatgcacatctcaaatcatgccaccaccgtaccagcagccaaattacaatatactgtaattaatagaagaagaagttctttaatttggatcccggctggggcgtgcggcgtacgtgaagtgtgattagtcgaaggtggccttgccggtgaacttgacgtcgatggggttgacgttcttgccgatgctgcggaagttctggccgacgccctccctgccggggttgaccttctccgggtagacgccgtccttggggtggaggtactgcacctcgccgttggggaagacgcggtagaactggtaggtgatcttgtacttggagcgcaacctggtgccgagcgccaggcactgctccttgcg

SEQ ID NO: 19991 - DNA, 412 bp, Zea mays
  Clone ID: cC-zmle189097e11b1
ccacgcgttctttcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgccccagccgggatccaaattaaagaacttcttcttctattaattacagtatattgtaatttggctgctggtacggtggtggcatgatttgagatgtgcatgatgatccttgtgtaattttattaccaagtctcttcttataaaa

SEQ ID NO: 19992 - DNA, 430 bp, Zea mays
  Clone ID: cC-zmle189097e12a1
gtgtggctgggggatcccggttctctacagggatctccacaaactcagaaagaatcgcccggaactcgtctccggccagtgtctccttctcaatgagcacctcaacgattttgtcgatggcctccctgttgtttctaatgtgcctcaatgcgatctcgtaggcctcatctgacaactgcttcactgccgaatcaatgtcctccgcaagcttctctgacatggagttccttgccatcattcgcatgatgacgtccccactctgtgccccaccctccatcagagaccatggaccaatttcagacataccgaacgttaccaccatctgcttggctaagccagtaatttgctgcaagtcaccagcagctccagtggtcacctcaggctctccaaatatcacctcctcagcagctctaccaccaaggccgccaac

SEQ ID NO: 19993 - DNA, 432 bp, Zea mays
  Clone ID: cC-zmle189097e12b1
ttgttggcggccttggtggtagagctgctgaggaggtgatatttggagagcctgaggtgaccactggagctgctggtgacttgcagcaaattactggcttagccaagcagatggtggtaacgttcggtatgtctgaaattggtccatggtctctgatggagggtggggcacagagtggggacgtcatcatgcgaatgatggcaaggaactccatgtcagagaagcttgcggaggacattgattccgcagtgaagcagttgtcagatgaggcctacgagatcgcattgaggcacattagaaacaacagggaggccatcgacaaaatcgttgaggtgctcattgagaaggagacactggccggagacgagttccgggcgattctttctgagtttgtggagatccctgtaaagaaccgggttcccccagccacac

SEQ ID NO: 19994 - DNA, 156 bp, Zea mays
  Clone ID: cC-zmle189097f01a1
catcatatgttatatttcacttatgtgtggttttttttatttgaggggggaaaccaagctcaagaaaacggctttttgtttttagtagagggtagcgtggggaccacaaaacccggtgagaacgctaggagaaaaccccaaagcctggggaaattg

SEQ ID NO: 19995 - DNA, 354 bp, Zea mays
  Clone ID: cC-zmle189097f01b1
agttttctatagtgtcatccgcgtttcgtcgtgggagcactgagtgcgattactgttgctaggaacctgatgctgcggatgagggctttgtgcatatgtatgacaaattactccggtttctgtgttttttcctagtattctcatgtggttcttaggtgctcagtcgagacttgataaagaacataactgcgttgactttagcatggtttcaactcaaacagtgaaaaggaatagacgaccacattcgaaagcaacttttgggtgtacgaatacaaaaaattagggcggccggtctgaggatccacgcttacgtacccgtgcatgggaagtgaaagcttttctatggggtcacct

SEQ ID NO: 19996 - DNA, 291 bp, Zea mays
  Clone ID: cC-zmle189097f03a1
ccatgcctatatggatagaggacgtgtcatccatttgcaccacgggccgcgccataaaaaagcacgggccgagaggggtgaagtatacaaaccctattaccagtgaaggtcggggcgggaatatacagtgggattagttacctcgggcggtacttaatcaggggcaccacattccaagtaatttcaatttgcacgtgatgagaaataccatactactacacgggagtattatattacgtggccgtgagtccgcgacggctaaggtcacatggtattattgttcaggcaatc

SEQ ID NO: 19997 - DNA, 442 bp, Zea mays
  Clone ID: cC-zmle189097f03b1
cgactacgacgacttccaggcctgctttcacgcgacgctgccgtacgagaaggtgaagcctgacccggtgctcaggcagctgctgctttccctgccgcagaggaagatcatcttcaccaactccgacaaggcccacgcggccagagtcctggagaagctcggcctccaggactgcttccaagggatcgtctgcttcgagacactgaacccgtcaccaaccgagaagaacagtggcggcagtgctgggacgatcctgtgcaagccctcgctggcgtccatggaagccgtcatcgagatcgccaagctcgacgccgagagaacggtgttctttgacgacagcgcgcgcaacatcgccgcagggaaggccgccggtttccgcaccgtcatcgtggggagctcggcgctggtgccaggggcggacgtggcgcttgagagcattcac

SEQ ID NO: 19998 - DNA, 444 bp, Zea mays
  Clone ID: cC-zmle189097f04a1
cgactcgtaacctcaattgctattgctttgactgaatagtttggacttggtgatccgttattcgagtggtttccagtttgttgaatgactaatacatacatttacaactgccaactgggtgggcagtagtgaattttattctataagttactattgggtagaacgtggacttccaagtcctagtatcaggtcatggcttgaagaaccaacattggcatgccatggactctttctccatattcaggaacctgtacttggtatatcacttgcactagccccctttcagctcacatattgttttttgagcaacttggcgcagaaattcaaatcgaagcgcacttctggcgggttaccaatgcaatcgaacactgcatttgctgtctcgaagaccttttttgcagagtagccgctttttgttaccatacactttatgcccgccgtttt

SEQ ID NO: 19999 - DNA, 364 bp, Zea mays
  Clone ID: cC-zmle189097f04b1
ccttttctttcgtgctcagtctagacatcatcctcatgttgcagataaggtggtgtgctcttattacagatcagtatcagttgagaaaaatagatccctgcacatcccgagaaaggaaatggacgacaaagatccagcgacacagagaagtgtacgtaagcagaccgggcatgcttgtgctgctgctgcagccgcgccgccgggttagagccagctggataggttagaaatgtagcattattatgaggacaaagtgtacgatgaacaaggttcattctggcagctgtacgacgaacaaggttcattgtcgttagatgaaacgacaagaattcactgctgtttagtaacaagaattcttggtctt

SEQ ID NO: 20000 - DNA, 546 bp, Zea mays
  Clone ID: cC-zmle189097f05a1
cgactcgtaacctcaattgctattgctttgactgaagagtttggacttggtgatccgttattcgagtggtttccagtttgttgaatgactaatacatacatttacaactgccaactgggtgggcagtagtgaatttcattctataagttactattgggtagaacgtggacttccaagtcctagtatcaggtcatggcttgaagaaccaacattggcatgccatggactctttctccatattcaggaacctgtacttggtatatcacttgcactagccccctttcagctcacatattgttttttgagcaacttggcgcagaaatccaaatcgaagcgcacttctggcgggtcaccaatgcaatcgaacactgcatctgctgtctcgaagtcctcttctgcagtgtagccgctttttgttacgatacacttcatgccggcagcttttgccgctgcgagccctatagtactgtctttaataacaacacaagtttgtggatcaactccaagtgtagttgctgcttatatgtaaattgctgggtcaggttt

SEQ ID NO: 20001 - DNA, 466 bp, Zea mays
  Clone ID: cC-zmle189097f05b1
ccttcttcttgcgcggacgcgtgggttcagccacaggcgcgcgatatccccgctcaaaaaagccatgtcaatggcggcagccgccgcccccgccgcggcatcatccacgctgctgcgggcaagcaacttctctattgcgcgccccgtcccaagcggcgttgcctgctgcatccgcgccgtcagtgggcggagagcatcggtagtgcgcgcggcagcggctggcgacagggccgcgccggccggtgcccttccagcggcgctgttgttcgattgcgatggtgtgctggtggacaccgagaaggatggccaccgcatctccttcaacgaaaccttcgctgagagggaattaggcgtcagctgggatgttgaactgtatggagaattgctcaggataggtggtggaaaggaaaggatgacagcttacttcaaccagacaggatggccgggttagcaccgaaacagatga

SEQ ID NO: 20002 - DNA, 396 bp, Zea mays
  Clone ID: cC-zmle189097f07a1
ataaatgcagccaggtgatcaactgcctcaattgggctggagtatgcgtaaattatgacagcattgctactttgcacatgtcactaatctctggagcagcctttctgcttcaatgccaaatccaatcagacatacataccaaagcaagaggcacagagacaaaccaaacacatcaccacatagtctctagccaactgaacaaactattgctggactattttgcttcaactagcgccaaccctaataaacagtagcttaatgctgatttcctcccaactgcaaaactctcttattctgctcagtccacgttgccaagactccaaatccttcttggaccagtcagtctactttacactccccaatcttttccggtccattttccagtactgcctgact

SEQ ID NO: 20003 - DNA, 485 bp, Zea mays
  Clone ID: cC-zmle189097f07b1
cgctcatgcctctccacgcccgcgcaccgccggtccgccactcccaccttctactcaccgccgccaccgctcggctccgcccgtgcgcagcgccagcgaccaagccccgccgccgctccctcgtcctcgtccgcgcctccagctcggaccctccgcagcagcagctcaacctctccgtgctccgcttcaccctcgggattccggggctggacgaatcgtacctcccccggtggataggcctcggtttcggcgcgctcgtcgtgctcaaccacctcctctctgcgtccccgacgcccgcgcagctcaggtccgaggctgtggggctgtgcctggccgcgttctcggcgacgctgccgttcctggggaggttccttgagggcgctgatgctgccagccgagtgccgttgcccgaggggagcatccaagtattcgtcatgtctgagaacctgtcagctgtgcagaaggaggacatggcgtgggcgtcg

SEQ ID NO: 20004 - DNA, 436 bp, Zea mays
  Clone ID: cC-zmle189097f08a1
ccaacgtggctagtccttcaccgttgcaaaattttccgataatttacaggcaccactcataaacatccagaacaagcatccttctcttccctccattttcaccccaacgttcccttttctgttgttttacacctacaaatgtacacctaacaaacacgggaatcctcatcctcaccacacaaaggcaaaaaacagtctgagacagagcacgcacgggcgaaacagtctttggtgactgacgctacccgcctccggtcggagaatccaggctcccctgagcagctcgccgcttctcccgccagttctcgccccacatctttgcctctgccaccattcgctccctgtcctggcccctgttcgcagcccccgggaactgctctctgggggagtcggcccggtccttgctcggcgacctgtggccagagttgcctgcatc

SEQ ID NO: 20005 - DNA, 487 bp, Zea mays
  Clone ID: cC-zmle189097f08b1
tttacgcgtgggtgctgatggagatcaacgccttgtcgtgtatgagtacatgccacttggatcattggaggaccatttgcatgatctccctcctgacaaggagcctttggattggaacactaggatgaaaattgctgcgggtgctgctaaagggctggagtacctgcatgacaaggcacagccaccagttatttacagggatttcaagtcatcaaatattctattgggcgagggcttccatccaaagctatcagacttcggtcttgctaagttgggtcctgttggtgacaagtctcatgtctcaacgcgtgttatgggaacatatggttattgtgctccagaatatgctatgacaggacaacttacagttaagtcagatgtttacagctttggagttgtcttgctcgagctgattactggccgaaaggccattgacagcaccagaccagcgtcagagcaaaaccttgtgtcatgggcacggcccctt

SEQ ID NO: 20006 - DNA, 381 bp, Zea mays
  Clone ID: cC-zmle189097f09a1
ctcccaatatataaaaataacgaatccattctcttgacatggtagttaagagtcacaggtaactctgaacgaaaatgcaaaattaacccaggtactacaaaggtggctttggtgaggtctcagaatgacacttcgttccttttcagcgtttgccaccgccgccgcccaacttggggcccttggaacccttctggacagcgcccttcgtctgcgccttctgggacttggacacctcagccttcttcgccttcttctcatccttggccttcttaatgcgctccttgatctcacgaagagcagcttctttagcagcatcacggacttcaggcttctcagctctcttcttctggatcacttccaaggaagcacccacaatggacc

SEQ ID NO: 20007 - DNA, 490 bp, Zea mays
  Clone ID: cC-zmle189097f09b1
tgttctacttccacaaccgcctgaagcctgcaaagcttacctggacagcaatgtacaggaagcagcacaagaaggacatccatgctgaagctgtcaagaagaggcgccgcgctaccaagaagccatactcgaggtccattgtgggtgcttccttggaagtgatccagaagaagagagctgagaagcctgaagtccgtgatgctgctagagaagctgctcttcgtgagatcaaggagcgcattaagaagaccaaggatgagaagaaggcgaagaaggctgaggtgtccaagtcccagaaggcgcagacgaagggcgctgtccagaagggttccaagggccccaagttgggcggcggcggtggcaaacgctgaaaaggaacgaagtgtcattctgagacctcaccaaagccacctttgtagtacctgggttaattttgcattttcgttcagagttacctgtgactcttaactaccatgtcaagagaatggat

SEQ ID NO: 20008 - DNA, 428 bp, Zea mays
  Clone ID: cC-zmle189097f10a1
gaaaagtgacaataaacaggtgtgcttgtgttacacggcaagattttcatgagtgagacaacaagcccgtggacactttattacatcgagcattgtatgactatgattatttattatacatatggcttgggacatcagattacaataggatacactgaacaggacttgtcacggtttttctttatcaacagtcatgtctgaaaaaagaccagcgtttctgtggatctaaatacaatgacatcaacttttctaaaggctgcttgaaactggcatactttgcgccaaggaagagcctctgcacacagatcaatgcatttgtcctcacttcagtgttctcatgacttgatagagcgtgatgactcgagacttactcttgatgtctgccaccacaatttccgacagatggatggtactgaaagaattgtgag

SEQ ID NO: 20009 - DNA, 381 bp, Zea mays
  Clone ID: cC-zmle189097f10b1
cgtactcttacagatccttgagtgccatacatatggccacatcgtgggggctgacttcaggggtcaggaccacgcaatgatactgatgaatcattagaacactgaagcgaggaaaagggcatggaccggggatgagaggctagcgcttggagcaaagcatggcaggccactgcaggctcgagatatgctgcgacttgtatttagatacagagaacccgtggctattgatcactaatggttgttgagaaagaataaccttgaaccttcttgatgagtgtatcctactgcgatttgatcgctgatgccgattcataatacaccatcagaggcatctactgctcggagaagtagagcgtccacgtgcctgttgatgcatttatg

SEQ ID NO: 20010 - DNA, 259 bp, Zea mays
  Clone ID: cC-zmle189097f11a1
ggaggggccccccccgattttttttttgggggggaaaaaaaaaaaaatggggcccccaattctcctggctttctggcccccccaatttaaaaaccccagtttcaacagtgccccctggaacccaagaacccccggagccccccccccgccccgataccaaaacacaaaggggtgggggggcgaattcaaccccccaaaaggggggacgggggggggggggtcttttaaccccaaatcttttaaccaggatgcccccccg

SEQ ID NO: 20011 - DNA, 488 bp, Zea mays
  Clone ID: cC-zmle189097f11b1
tcttacgcgtccgggctgctgaggctggatttgttaacgcctatgcgcctgtcgctaaggttaaaccatcggacttcagacaagctgcggagcgcgcttgctcgttgagcgtgaagaacgccgaggccaccttccctggtgtacagaaggatagcattccatatatctgcatggacctcgtttatcagtacacattactcgtggaaggattcggcgtcgatccggaccacgagatgaccttggtaaagaaggtcccttacagcgacgcctacgtcgaagccgcatggccgcttggcagtgccatcgaggttgcatcttcgtagtaggaaggaaacacagtttagcaaggtaacatcggacggcattcttgtcatgaagttttgcgttgagagtccccactcctccactttctcctcttgatcgcttgaattcgcacactcaatccattcatcttactatacggtacgggtagcgtctctcggctctac

SEQ ID NO: 20012 - DNA, 316 bp, Zea mays
  Clone ID: cC-zmle189097f12a1
aaaaacaaaaaaaaagggggccttccttccaaattttgggtcccccaaagggagggaaaaggcctttcccacccgcttcctttttttccaaaaaaagggccccaagtgcccctttataaaccaaaaaggtggctttccttttaagaaaaaccccccaaagggggcaaaaacaggggggggtcacctgtttttaaggggctttatagccgggggggaacaaaaaaattgggcccaaccccccccttccggggacggggggggcaccccggaaattcccgcccggtccccgagggggacccctttttcccttaagggg

SEQ ID NO: 20013 - DNA, 355 bp, Zea mays
  Clone ID: cC-zmle189097f12b1
tttttatcgcgtgggctgcggctcaatgtcttgatccaatcactgctagaagcacttgaaagacagtcgagcagcacttgttcttgcctgctgatggtgattttgctgaaatgtatagcatgctttgtgtatgatgaatggtaacttggagccatgtcttgtgatgatatgtaatcgtgttgtacatgtcttttccttcctttgatgtatacagaaatttggaatgaagtgctcattgattgatgtttaaaaaaaaaaaaacaaaaaaaaagacaacaaaaacaaaatgaggcacattataaacaacaaaatagacatttacctagaaagaaaaagagacaaataaaaagggggg

SEQ ID NO: 20014 - DNA, 300 bp, Zea mays
  Clone ID: cC-zmle189097g01a1
acactcaaaagttgtggtgtggatataccaaacagccaaaaggacttgaccggctctcgatcgatcctgtctctctctctctggccgtctcacacgtcacacacacatacatggacgacgtcgtacgtacatgctaccatgcacatgcaagcgtacgtgtacacacggagagattttatttagtagtacatagcagcagacaagttgtcatcgatcttcacgcgtagattgatagatatcattatgacgacgatcgatgattcggccggcggcaaccgcggaatggttggtcgatcgatc

SEQ ID NO: 20015 - DNA, 369 bp, Zea mays
  Clone ID: cC-zmle189097g01b1
cgttgttgctgctggcagcggcggcgacgacctgggaggccttcatcacctgcgggcgggtgagctccgccatcgcgccctgcctctcctacgcccgcggcacgggggccgccccctccgcgtcctgctgtagcggcgtcaggaacctcaagagcgccaacggcaccgccgccgacaggcgcgccgcctgcaactgcctcaagaacgcccgcaggggccgacagcgggctcaacgccggcaacgccgacagcattccctacaagtgcggcgtgagcatactctacaccataagcaccttcaccgactgctccagggtgaactaaaacctagaccacgcgcgacgacggccggctgatcgagcgaccaac

SEQ ID NO: 20016 - DNA, 300 bp, Zea mays
  Clone ID: cC-zmle189097g02a1
ggacgcggggggcgcacccggaaaacaaaaaccagaacccgccgccctaccagtcacccaaatacaaaataggataaacgaatggcggaaacacgggcccaagggcacccccgggcgaaacgggaatgcgtccaaaacacaccaaaaacaacgaccaaaagagaaaaagacaaaaaccaagggcgccgaacgactaaacaaaccacactaacctgggtggggcccatggccacgataaaaatcggaaaaccagaccccccaaccgaaaaaacaaaatgagcacaaccgccgggggggggg

SEQ ID NO: 20017 - DNA, 68 bp, Zea mays
  Clone ID: cC-zmle189097g02b1
ataataaaaaaaaaaaaaaaaaaaaaaaaaaaagggaaaaattttaaaaaaaaaaggaaaaaaaacag

SEQ ID NO: 20018 - DNA, 271 bp, Zea mays
  Clone ID: cC-zmle189097g03a1
attacaagaaagactgatatgttcatataagtattttaagcaggcgcaggggcaggaatccctccccttactttacaacagaacaaagatttggccaaacaaatccatacaacaattcaatccgtaggtctggtgctatagtaaacagcggtggcggtggcggtagcgcctgaacgaacaaggcgaaagaaattattgtcggcgaaagggccgggacctggaccagacctttcctcggcagtctggcggatccggcgccgtctcaaccgag

SEQ ID NO: 20019 - DNA, 271 bp, Zea mays
  Clone ID: cC-zmle189097g03b1
cgcggttgaggcggcgccggatccgccagactgccgaggaaaggtctggtccaggtcccggccctttcgccgacaataatttctttcgccttgttcgttcaggcgctaccgccaccgccaccgctgtttactatagcaccagacctacggattgaattgttgtatggatttgtttggccaaatctttgttctgttgtaaagtaaggggagggattcctgcccctgcgcctgcttaaaatacttatatgaacatatcagtctttcttgtttt

SEQ ID NO: 20020 - DNA, 437 bp, Zea mays
  Clone ID: cC-zmle189097g04a1
agcaactgatgagaagatctttttcgtgttcttcttttgcttggttttttttgacatgaggattactcaaaagccactcagctgtcatgactcatgactcaccaggagctcaactacacgatcttcatcagtacttcacacgttcactcagtattacccaaacagattaccctatcaattcacacactatatacgaatatacatatattttgcagctgctactgctagcagaaagatgtaaactcagtaggtaatatacacatccggacggagtagctagttctactgtaacccaaggaacgacgagacccaaattcctattgagacaacccctacaagcgcgactgcttgacttagttccaagaacaagttcggcctttcatcgggcaacgccttccagtttgccttcccaaggcagctatgactatgctaatatt

SEQ ID NO: 20021 - DNA, 493 bp, Zea mays
  Clone ID: cC-zmle189097g04b1
gttttgttttctaatgtttgtattctggcttgctttgacagatcggtttacaaaactgtcccaaactgtgagccttgccggcctctccaaaggtcacctatcgaaggtttctatctagctggtgattacacaaagcagaaatacctggcttctatggaaggtgcagtcctatccgggaagctttgcgcccagtccatagtgcaggattatagcaggctcgcactcaggagccagaaaagcctacaatcaggagaagttcccgtcccatcttagttgtagttgcctttagctatcgtcatccccactgggtgctatcttatctcctatttcaatgggaacccacccaatggtcatgttggagacaacacctgttatgggcctttgaccatctcgtggtgactgtagttgatgtcatattcggatatatatgtaaaaggacctgcatagcaattgttagacctttgggaaagcaaaagcgataaagagatctcag

SEQ ID NO: 20022 - DNA, 449 bp, Zea mays
  Clone ID: cC-zmle189097g05a1
agcaactgatgagaagatctttttcttcttcttcttttgcttggttttttttgacatgaggattactcaaaagccactcagctgtcatgactcatgactcaccaggagctcaactacacgatcttcatcagtacttcacacgttcactcagtattacccaaacagattaccctatcaattcacacactatatacgaatatacatatattttgcagctgctactgctagcagaaagatgtaaactcagtaggtaatatacacatccggacggagtagctagttctactgtaacccaaggaacgacgagacccaaattcctattgagacaacccctacagtcgcgactgcttgacttagttccaagaacaagttcggcctttcatcgggcaacgcctttcagttttgtcctccccaagtcagctatgactatgctaatattgtcttgggac

SEQ ID NO: 20023 - DNA, 491 bp, Zea mays
  unsure at all n locations
  Clone ID: cC-zmle189097g05b1
gttttgttcaagttctcaaagagtgacatcatcgggtccccttcgattctgcctgcaaactttgcgaagcttggtgatcaggtaaaagctgtggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtgaatactgngttttggggccagagctttattgagagtcaagtaaagaa

SEQ ID NO: 20024 - DNA, 469 bp, Zea mays
  Clone ID: cC-zmle189097g06a1
tttttgttttaaagcccgaaagggtcgtaatattgttggttgcagcaatctattaggaacaagtaggcttttgagaaattcaacaggaactctgatccacggtaaccgccaggttcaggagctaagattgcaagtcaactctgatggtaacaacatcggatctgctccgtagaccactcgaagactcaggcttggaatcagaaacttacggcacgagcctctgcgggtcgcgcgggaacagggaggtcttcctgatgttgttcagggcacagaacagcatcaccaccctctccaaacccaccccgaaaccgccgtgtggcggcacgccatagctgaaggattcaatgtaggccgagatagtgctcacgtcgattccacactctgtcgcgcgcttggccagcagctcaggagtgtgtatcctttgagctccagatattatctcctcgcctcgaatgaagacatcaaaaga

SEQ ID NO: 20025 - DNA, 486 bp, Zea mays
  Clone ID: cC-zmle189097g06b1
ctttattagggctattgcgacccttccaattaacgttgaatatgcggctcggagtgaggcagattatgagaaggctgaattggctggagaaaagcttgatcgcgtgggccaagatacccgcttgaactacagagctattgatctacgaacaccctcgaaccaagccatattccggatccagtgtcaagttgaaaacaaatttagagattttttgttgtcgaagaactttgtcgggatccacaccccaaaattgatttctggatctagcgaagggggtgcggctgtattcaagcttctgtacaatggtcaacctgcttgtttggcacaatccccttagtatacaaggcaaatggctatctctggtggttttgagcgagtatttgaggtcggccctgtgtttagagcacaaaattcaaacacacacaggcatttatgtgagttcggtggtcttgatgctgaaatggagattaaggagcattattttga

SEQ ID NO: 20026 - DNA, 454 bp, Zea mays
  Clone ID: cC-zmle189097g07b1
ttgttgttggggatttgctaccacgaggacctagccatccgccaccaagggtggcgatgtcacctgatgttgttggggatttgctaccacgaggacctagccatccgccaccaagggtagcgatgtcacctgatgttgttggggatttgctaccacgaggacctagccatccgccaccaagggtggcgatgtcacctgatgttgttggggatttgctaccacgaggacctagccatccgccaccaagggtagcgatgtcacctgatgttgttggggatttgctaccacgaggacctagccatccaccacccttggaggaaatgatcgagtatagcaatgatgtcctcggtgcgaatgataaacttgttggtaatgtaaggatgaatacataaggataatgtgatgtaacttatagacaataacataaataaaaagaatactctgtgttgtttaa

SEQ ID NO: 20027 - DNA, 354 bp, Zea mays
  Clone ID: cC-zmle189097g08a1
gaacccccaaaattttcactttggttcagaccggcaaaattgggccggcgtgcaaaaagggtttccaaacaagaataaccccctgaaccgggttcagggatttggtaggttccaccttcttcccgatagggcttttggggaaagggccgaggcttgcccacctttcaaggccccctgcccctttggagaaaaaccccaagggttgggggggaaccgcaagagggaagtccccccggggcatgggcaaaggccccccccttttttcccacttgtccctgggcagggaggaccccactttcttgaggtttttgggccccattttggggaaagggtgtcccctgggaaagggaaaaa

SEQ ID NO: 20028 - DNA, 490 bp, Zea mays
  Clone ID: cC-zmle189097g08b1
tttccacgcgtccgcgagaaacttcgtcaagtcaaagcagtcctagaggagggtggacatttctctggcatttataggaaagtgcagctaaagccattgaaatggataaaagttccaaagcgtaatggtgatggtgaagaggaacgaccgattgaagccctgatgattctgaaatatggtggtgtgctcacccatgctgggagaaaacaggcagaggagctgggaagatttttcagaaataacatatatccaggtgaaggaactggtttgcttcgtctgcatagcacttatagacatgatttaaaaatatacagctcggacgaaggtcgtgtacagatgtctgcagcagcatttgcaaaaggccttcttgatttggaagggcagttgactccgatactggtatctttagtaagtaaagactcatctatgctagatggactaaaagaagcaagcaccgagatggatgaagctaaggctagattgcatgaga

SEQ ID NO: 20029 - DNA, 446 bp, Zea mays
  Clone ID: cC-zmle189097g09a1
ttttgtaatttgaacccaggtaacatacagatggtggtacttactcatgtacattactaatgctgacgcgtatacgccaaacattaatttagcaatccctacgactagggtacttactcatgtacatcaaaaccagaacgtgtcgacacaacattacccggtacgttttacagcacgcgtggtgcatcaacacaatatacatgcacgtcacgatttcaacagttcaacttccgaggaagccggccacctgggcattcaccgacctggacaagaacttcatgcagatgggcggcttcaccttggcaagcgcaagaatggactgcggcagggtccagatgccgtcgccgcagatcagccccgacgcaaccgctggcgcgaaggcgttggctttggccttgttgatcgtctcccacgcgaagaggatcacggtgccgatgaacatgtcg

SEQ ID NO: 20030 - DNA, 486 bp, Zea mays
  Clone ID: cC-zmle189097g09b1
gtttccggtttcaaacaatggcagccccatcgctgaaggtgtttccttcgatgacgaacgccgcagggacctgttcctgaaagaccagatccccagatcagttgcctacggagggtacgtggctgtcgctgccatctcaatcggcacccttcctcaggtcttcccgcagctcaagtggtactacatcctggtggcgtacatcttcgcgcctgtgctggccttctgcaacgcgtacgggactggccttaccgactggtccctcgcgtccacctacggcaagctcgccatcttcatcttcggcgcgtgggccggcgcgtcgaacggcggcgtcctcgtggggctcgctgcctgcggcgtgatgatgagcatcgtgtcgacggccgccgacctgatgcaggacctcaagaccgggtacctgacgctggcgtcgcccaggtccatgttcatcagccaggtgatcggcacggcgatgggctgcgtcatcgc

SEQ ID NO: 20031 - DNA, 355 bp, Zea mays
  Clone ID: cC-zmle189097g10a1
caagccaacggcacatttgggattattagctcccttcttccattcctttacaaaaaactaaacgatgctttatggggcaaacaaagggattaaggttctacaaggcctgtatcctttggatctgcgactcagctggcgcgtcgttggctgaactatcaacagggggctcgaggacaaagctttcgatcttatgaagggactcaattgcaatatcagggggggtcagtttaaagacataatcatgaccttgtttacatgcaatcttttccagagaaacccttacatttgcatttgcataagcatcacccctttgctgggcaagcatgctgggcttaaaaaaggccattgcgtacgg

SEQ ID NO: 20032 - DNA, 487 bp, Zea mays
  Clone ID: cC-zmle189097g10b1
tggttcaagctgttggaatgccatcagttgcccaaatattcaaggtccatagtgaagccttctttcgggataatgagagtagtgtcttgagagatttgtcctccatgcgacgattagttgttgccaccggaggtggtgctgttatccgaccaattaactggagatatatgaagaggggcctatctgtttggttagatgtgcccttggatgctcttgctaggcgtattgctaaagtgggaactgcctctcgtcctcttctggaccaaccatctggtgatccgtacgcaatggccttttctaagctcagcatgcttgcacagcaaaggggtgatgcttatgcaaatgcagatgtaagggtttctctggaagagattgcatgtaaacaaggtcatgatgatgtctctaagctgacacctactgatattgcaattgagtcacttcataagatcgagagcttcgtcatcgagcacactgctgatagttcagc

SEQ ID NO: 20033 - DNA, 88 bp, Zea mays
  Clone ID: cC-zmle189097g11a1
ggggggggacaaaccgatacccaattggaattcatttcggggctgttttggccacaaaggaaacccctgagggtcagatgggagttgc

SEQ ID NO: 20034 - DNA, 488 bp, Zea mays
  Clone ID: cC-zmle189097g11b1
ccacgcgttttccttcgcgtccgcccacgcgtccgcggacgcgtggggtcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgcccatctacaa

SEQ ID NO: 20035 - DNA, 460 bp, Zea mays
  Clone ID: cC-zmle189097g12a1
agcacttaaaacaatataccattatttctgacaaaaatataccaatgaggcagtgaagataatgtacaccacaatattttctctgattgatacatagcctagtactagcatacagaagtgatgtccaaaactgggatgtctcagttgtcgcagaatgcatgtagggtttcatcgagtgcattcccctcataatcccccgtaaatacacagcaccctagtggtcctttcagaaggatgagtctcaacagaccatcagcaaccttcttgtcaacagccatgatgtttttaaacttctctacggtcatggtctcaggaggtgcaatgggaagtttggcttgctttagtatgtcaaccacacgttttctgatggagtcatctatccaccccaggcggtgagacatgtcagttgccataactgttccagctgcgacagccttcccatggagccatgcttcatatc

SEQ ID NO: 20036 - DNA, 397 bp, Zea mays
  Clone ID: cC-zmle189097g12b1
tggtttccgcgtcctccctccttgccgcccgcgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctcctcgacgagccggacctgctgcagaggcatgttcatggcaagagggctctggtggtgaccaacacgaccgtcgcgccgctttacctggacaaggtgacatgggcactcaccaccaccac

SEQ ID NO: 20037 - DNA, 101 bp, Zea mays
  Clone ID: cC-zmle189097h01b1
ccttcgtgttcgtccacgcgtccgaaaaaaaaaagggaagttaaaaaaaaataaagaaaaaaaaaaaaaaaaaaataaaaaaaaaaaaaaataataaaagg

SEQ ID NO: 20038 - DNA, 133 bp, Zea mays
  Clone ID: cC-zmle189097h02a1
cacattcaagcttttaaacatgctgggtgggtttttttatgtttaccaattttaaggatcaccaaaaactctttgtaatagtatgttacataacaaaaaaaaaacggtctgccaggcccgaaaagaactaaac

SEQ ID NO: 20039 - DNA, 406 bp, Zea mays
  Clone ID: cC-zmle189097h02b1
ccttctttgtgcgaatatataaaaaaaaaagaagaggggaggttcttatgtcaccacaaatagaaactaaagcatgggttggattatcagtttgtgttaacggtgttccattgacttactggacctgcgaaatcgagtacgtggggattagctttgctttcaagtttccgagtaacagacaacagttggaacttgccatatccacaattttgacctggtcgtatttgcggtgatgttcatggacgctaatttgacaccctgcttggacttgttggactcacccctctttgatcgttacaaaggccgatgctatcacatctagcccgtttctggggacccagatcaatatatctgttatgtagcttatccattagacctatttgaagaggggtctggtactaacatg

SEQ ID NO: 20040 - DNA, 265 bp, Zea mays
  Clone ID: cC-zmle189097h03a1
gcacaaacaagctctgaaacatgcgggctggctttgtgatgttgccatactaaaggctcaccagctaccctgcaactgagggcattcagcagtacgacggtaggcctgacaagagctggtccttcccggatttgaaataaaagctatgcccatggtgtcaacaagggccatggaacatttattcgaccaggtgatgatcgtcatcaggggggggttgcgcactggcagttgcaagctcagcttcatgctgctgctgcatgggcat

SEQ ID NO: 20041 - DNA, 250 bp, Zea mays
  Clone ID: cC-zmle189097h03b1
agttgttagtccagagtccagacgccagacgcggtggacttgttttatctctagtggtacatttcaaactcttggccgacgcagcggtctctgttcaccgcgccccgccgcataaatggcgctgccgaatcagcaggttgtggataaccccagcttcaagctcgtcatcgctggcgacggtggaactggcataaccacatttgctaagaggcatcttactggcgagtttgagaagaaatatgagcccacc

SEQ ID NO: 20042 - DNA, 349 bp, Zea mays
  Clone ID: cC-zmle189097h04a1
gggggaaaacaaagctaatccgccaagaacttggtggtattgcaaacactttctaggtgggagaagctcctttaacagattgtttgtatacccgagaacaaaagtcgagaacatgataggggattggaaagataaccacacgttcgatcctttccatccagaacagtttgaaagcattcgattaggtagaagagtttggaaatccaacgaaccaccagcgtggaggggggctttaagccgctgagctccaagaaacgcctggccatcgggtgcttggcgtcggacaggttggacggtgcgagcacctccacgacactttcggggacgaacaggaacaccaggtcgggga

SEQ ID NO: 20043 - DNA, 354 bp, Zea mays
  Clone ID: cC-zmle189097h05a1
aaaacaaagctaatccgccaagaacttggttgtattgcaaacactttctaggtgggagaagcttctttaacagattgtgtgtatacaccagaacaaaagtcaagaacatgataggggattggaaagataaccacccgttcgatcctttctattcagaacagtttgaaagcattcgattaggtagaagagtttggaaatccaacgaagcaccagcgtggaggggggctttcagccgctgagctccaagaaacgcctggccatcgggtgcttggcgtcggacaggtcggacggtgcgagcaccttcacgaccttgtcggggacgacgaggtacaccacgtcggggatgcgctggat

SEQ ID NO: 20044 - DNA, 471 bp, Zea mays
  Clone ID: cC-zmle189097h05b1
ccttggccgaagtgaagagcctgctgcacctgggcgacctggaccctgctctgtgctgcaagccggcgtccgagctgtcggtcgggcaggcacagcgcgtcgccctggcccggaccctcgccaacgaccccgaggtgctcctgctggacgagccgaccagcgcgctggaccccatctcgacgcagaacatcgaggaggccatcgtgcggctgaagaagacgagggggctcaccacggtgatcgtctcccacagcgtgaagcagatccagcgcatcgccgacctggtgtgcctcgtcgtcaccggcgaggtcgtggaggtgctcgcgccgtccgacctgtccgacgccaagcacccgatggccaggcgtttcttggagctcagcggctgaaagcccgcctgctcgctgctgcttcgatggatgtcgaaactcttctacctaatcggatgcttgcgagctgctctggatggaa

SEQ ID NO: 20045 - DNA, 464 bp, Zea mays
  Clone ID: cC-zmle189097h06a1
tttttgtattacgaagaagttttattcaggtcacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggtgaccatggtggtggtggtggttggcgccggcgcgtgagaccgtgtcgacctcctcgaacttttccttgacgacgtgctgctggacgccgtcgccgtggcggacgaagccggccggggccaccgaccttaccttcttcgagcagtagtccaccttcttggagtaagccattg

SEQ ID NO: 20046 - DNA, 468 bp, Zea mays
  Clone ID: cC-zmle189097h06b1
acttctttccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactca

SEQ ID NO: 20047 - DNA, 481 bp, Zea mays
  Clone ID: cC-zmle189097h07a1
tttttttttctttttcttttatttttcttttttgggtgtttttattttattttgtttgtttctatcctttatctcttatttataaaaatttaaaatgactttttaataaaaaagggggcccaaccctactaaaaccaacaaaactagccctcctcaaaaaaaaaaaaaaggcggggggtgccaacccttcccacaggggccgcctattaaaagaatgaacacccccaaagaaagaacccccccccttttaacaggctggccaacaggttttaaaacacaccaaaaaaggcgcgcccccccgggctttcccccaagggaggccaaaagcccccccacaaaacgtaaacccccaaaacctcaaaaaaaatcgacacggcgggggtaacccccaaaataaatacccccccaggacccccctgtaaccacccgggaggagcccccccccctgaggaaaaaacaaccgcccgcaccccccattttc

SEQ ID NO: 20048 - DNA, 469 bp, Zea mays
  Clone ID: cC-zmle189097h07b1
tcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgcttggactgatggacttaccagtcttgatcgttacaaaggacgatgctatcacatcgagcccgttcctggggacccagatcaatatatctgttatgtagcttatccattagacctatttgaagagggttctgttactaacatgtttactttcattgtgggtaacgtatttggtttcaaagccctacgcgctttacgtttggaggatctaccaattccccct

SEQ ID NO: 20049 - DNA, 445 bp, Zea mays
  Clone ID: cC-zmle189097h08a1
ttttgtccacaaaaacggagaaaccgaaagggtaaaaaaaatgaactttcttggcagtacaaagttctcaacgctaattcataaaaatttaaaaagacaagtgagcccggctgagctgtgaatcaaactaacatcgactgtccttgccataatcaagccataatcaaggaccatggtgcccacgcttcgtacaagggtcgtctattaccgattgatgacgtggatagcaagagctcggaagcgtttcacagcctcgcgatgacggcttccacctcggcaggggtgtagaggtggtacttgggggcaaccttggcaatatcgacgttgtttggggtcaccttctcttccataacctgcttcaggatagaaagggctatggtctccgcctcctggagggtcaattccttgttgtactgttcctgcaaggaactatcagctccctcag

SEQ ID NO: 20050 - DNA, 407 bp, Zea mays
  Clone ID: cC-zmle189097h08b1
tgagtacataggctgtgccatgagtggacttattgctgatgctagaacactagtggaacatgctcgtgttgaaactcagaatcataggttctcatacggagagccaatgactgtagaatcttcgacacaagctatctgtgacttagctctgcgttttggcgaaggtgacgaagagtcaatgtcacggccatttggagtctctctcctaattgctggacatgatgagaatggacctagcctgtactacactgacccatctggtacattttggcaatgcaacgcaaaggcaattggatcaggttctgagggagctgatagttccttgcaggaacagtacaacatgggaattgaccctccaggaggcggagaccatagccctttctatcctgaagcaggttattggaaga

SEQ ID NO: 20051 - DNA, 350 bp, Zea mays
  Clone ID: cC-zmle189097h09a1
aaaagggaggaacagttaaaggaacatttaccccaccttttggaaacaaaaaaggccttttattaaatttggaaaataaaattaaaaaggggccttcctatgaataaattcgataactaaaaaaaggtttatggggggtccaaaaagaacagggggttataaatcttaaggctccaaaacttaaacttttttgcccatttaccccacgggctgttggaagaaaagactttttttttttttttgggccgcccaaagcctggctttttttgttggaaccttggaagcggaattttgggaaggggggaccgatttttggggggattttttttttttaattgaggccatttttt

SEQ ID NO: 20052 - DNA, 412 bp, Zea mays
  Clone ID: cC-zmle189097h09b1
tgtttagactgccagcgcaggacctgatgaagatacttctgctgcggatgtgaaggagcgcttgaagaagatggcatcaatgaagaagaagaaatcgagcagagagacggacacagctgccaaaattgccgctgccgaggctgcagcaaggagtgcaaggcttgcggcggccaagaagaaagaaaagagtcattacaaccagcagcccgtgcggtaaatgggcataaagttttgagtttggggggctgggagttggataccccttggttcgtttggacctcgaaataaaactttttggagtattcgaatttatgactgggaagtgcctttctgagtttcattttcagaatttaatgaagggcctttgtggttgcaaaacggtggtgtaattgtgctttaaattgttcatcca

SEQ ID NO: 20053 - DNA, 475 bp, Zea mays
  Clone ID: cC-zmle189097h10a1
gaccaacggaaattagtaagatttttattatatatgccaaagaaagtgtacatttacaagaactttatcctgttgatggattattcacttaacctaaccaaaagaatgacttacaacgacctcttgtgcaattcaggctggaaatcttgcatgcctataaacctcttttattactatgtacatgctcagcaacgttatttccactcggtaatataaaatctcttcaggctgaaagtcatgcacggggtcgggaggggggatcgtacaaccttaaaatgtctcaataatctgaacatgagtatatatcctcctcaggcttcactttttgttcaggttccttccgagttagtttcagtggaacatcaagctctgggggctccatgcaacggatgagtggccagtgtatatcttcaaaaaagggatgttgcttgatatcgtttgcagcagcacttgaaccaagtcgagaagagggatc

SEQ ID NO: 20054 - DNA, 487 bp, Zea mays
  Clone ID: cC-zmle189097h10b1
tatgctatccgggaacagaaagaaatcactggccagctaatcaactacaccaagagcgggaagaagttttggaacttgttccacctacagccaatgcgagaccagaaaggagagcttcaatacttcattggagttcaattggatggaagcgaccatgttgaaccccttaggaatcgtctctctgagaacactgaactacaaagtgctaaattggtcaaagctacggcagagaatgtggatgaagcagtcagagagcttcctgatcccaacctgagaccagaggatctatgggacatttactcacgatatgtttccccaaagcctcataaacgttacaactcttcttggattgcgatggaaaagattataaaatctggtgtgaagattggcttgaagcacttcaagcctataaaacctttgggttatggtgacactggcagtgtacatttggtggagttgcaaggaagcggtgaattatttgcaatga

SEQ ID NO: 20055 - DNA, 381 bp, Zea mays
  Clone ID: cC-zmle189097h11a1
gatgtaatctagatcagatatgcagcataaaagttagatcgagcttcgatctccaaattatgttgttttccatacatcaatgagaaatagcaactctgcaaaaaggatgtttctaaaatatgctaacagaaaccctactacaaatgtgaaaattcctgatacatatcaaacaacaacactaactcccccccatgagaattcctgccgcaacaacaccatcttatttcccttccctgatcaaatgttagcggaccgggaactgccacaagagaaggccgcaatttgctctaccaacctgggcagccagccgcaaggtgcaatttctccagaaaaaaactgtcccggtgtctgatgatgagcccttagtacatgggacctttg

SEQ ID NO: 20056 - DNA, 407 bp, Zea mays
  Clone ID: cC-zmle189097h11b1
tctttggtcccatgtactaagggctcatcatcagacaccgggacagtttttttctggagaaattgcaccttgcggctggctgcccaggttggtagagcaaattgcggccttctcttgtggcagttcccggtccgctaacatttgatcagggaagggaaataagatggtgttgttgcggcaggaattctcatgggggggagttagtgttgttgtttgatatgtatcaggaattttcacatttgctgtagggtttctgttagcatatcttagaaacatcctttttgcagagttgctatttctcattgatgtatggaaaacaacataatttggagatcgaagctcgatctaacttttatgctgcatatctgatctagattacgtctcaccatgtttggccatttcaatgg

SEQ ID NO: 20057 - DNA, 379 bp, Zea mays
  Clone ID: cC-zmle189097h12a1
gttgttatagctatttttttggtggggttatttaaattttccttgtcttttatccaccactatggagaaccagaaacaatagctttgattgattcacttagaaggcctcgttgggaaaagggagaaccagacctggcctccattgggtgggggagcacccggggtatgtgaaaaacggcccaaaccccccgagggggggggggcgccacaggttccaccaacgccccgcaaaaaacaaacaaggggcagcccggccgggacatgctggggaggaagatgttttttggggggggaaccccccccaaaacccggggggggacagggatccccaaagcaccggcccaccacccctatgggggggcccttgttggggccccca

SEQ ID NO: 20058 - DNA, 426 bp, Zea mays
  Clone ID: cC-zmle189097h12b1
tttttcgcgtgggcggacgcgtgggtcagtgcaggccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagcgtcagtgtgagcaatgacctgaatgaa

SEQ ID NO: 20059 - DNA, 457 bp, Zea mays
  Clone ID: LIB189-003-Q1-E1-E7-SP6A
aagccccgggggaaaaaaaggggggacatttttttcgcctttgccccggggtttttaaaagccgggccgggggaaaaaaacgggaaaagggggcccccagggggggggatttaggggaaaaaaaaagggggaagggggggttttcccaatttgggggaccccaaaaaatttttaaaaaaccgggggcccccaattttggcgggggttcccccccaaattgaaaccaaaactgggtggcaaaaaaaaagaaacggggcgggggttttttttggggggggaaaaaaccccgttttttaagggggtttccccccccccctttttttggggaaggggcccaatacttggggttccttgggggaaaaaaaagggggggggggggccccgggggttttttttttgtttggccccccacctgaaaaaaaaaaatttttttagggtttttccaaatttcacccca

SEQ ID NO: 20060 - DNA, 569 bp, Zea mays
  Clone ID: LIB189-003-Q1-E1-E7-T7A
agagacttcaactggccttggaagagcaaactgaaatggcaaatcatagccaacagcagtgtgataggctaagaaatgaacggatcttgtgtcgaatttgctttgaaagagacatatgcattgttatgcttccctgccgccatcatgttctctgcgagccatgctctaacaagtgtcagtcatgcccaatttgccgattgaccgttgagggcaggctatttgtttatgatgcagtgatgtcatccaatccatcatgttacgcagtttaaaagtgcacatgttgacagtatttgtagggacctacttctggtgttgacaaagatggcccacacctgtttcctggcagtgaatgacaggttgtgaaattcttggtatgaaattaggaagaaagctaagaaagtcttctattatcagattgcagcacaaacaaaacaaaagccacgatgcacatccgtctccaatgatatgacacagaggaagacgaagtatatggactcttgctcatatatatgcaagcgtgaataaccacttaaataactgagtttgttctctagccatatatgacatct

SEQ ID NO: 20061 - DNA, 309 bp, Zea mays
  unsure at all n locations
  Clone ID: LIB189-006-Q1-E1-D9-SP6A
cgacatcacgtctgggaccaggccgacctccgacgacgagccgctgtggcccagcgacgccgccgtgtaggagctgtaggacggctgcttggcggcgacggcgaccggcncacaagtcgaagtccacagcggcgcccagttggatccatcgttcggcacgacgctgtcggcgtcggggaacctggcgaagtcttgggcgaggaacgggtcgaccacgtcgtccgcgaacaggaggtccagcttactggcgtcgacgacgaccttggccgcgtcgcgccgtnctttcctttcgcggcaaggcgaacagca

SEQ ID NO: 20062 - DNA, 138 bp, Zea mays
  unsure at all n locations
  Clone ID: LIB189-006-Q1-E1-D9-T7A
cccacgcgtccggtggcggnccacttgccgggacgtgcccgggcggcgcgtacctgtgcggggggtgcgacgggggcacgccgggcggggcacgagcgggtgtgggtctgcgaggtgtgcgagtcccgccgccgcgtg

SEQ ID NO: 20063 - DNA, 68 bp, Zea mays
  Clone ID: LIB189-006-Q1-E1-G12-SP6A
cgtaagctcggaatctgtatagaggcctgtcatttaattattcagctatagccggccatgagcagacc

SEQ ID NO: 20064 - DNA, 382 bp, Zea mays
  unsure at all n locations
  Clone ID: LIB189-007-Q1-E1-A12-SP6A
gtagcttggatctctagagcgccgcctttttttttttttttattttttttttctttttttttttttttttttttcttttattttttttttggattttttttttgtttatttattaaaaagaagaaataagacgagtagaggcagacttgaaaattagaggaaaagaagtagagcttagatagaaagtgaaaagagcagctcaactgaaaaatgaagctcaacaagaagccgaaaccgaacccagtcaaaagcactcacgccgcaacaaaaaaaaaaactacgcacaacagaaggagattacatatctgaatnntccccaaggtaggggctccagaagggagggcgccgtaccacaagaccaggaagagcaagacgtatgcct

SEQ ID NO: 20065 - DNA, 565 bp, Zea mays
  Clone ID: LIB189-007-Q1-E1-A12-T7A
taattgtttaccatggaccagattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggctaggagacccgaagatcaaagaaggacgaggcatccgtctctcaccgtcgagcacacaaagtggctcgatagctgaagagtcgctccggatgatacaatatgcagtaaacttaatacttaatacatgattcagtcctagttcattggtagataaacatgctatatactatcca

SEQ ID NO: 20066 - DNA, 501 bp, Zea mays
  Clone ID: LIB189-021-Q1-E1-E11-SP6A
tttggaacaaatggggtatctgattccatactaatctccaatccatcatttacaataagcttatgatacaaaaccactaattcaccaatgatctctggtaatgagaaccaagtgtgtatgaactgacagctaataaggatacaagttctactcttccacaggaataggaagacctataggtacggtattgtattggtatgtatacgatgactatgcatcttttctcgcactcggtactgtacaagaggagcagccacaaaaatcaaacaatagcgctactggcaccatacgaaatgaatgaacgaatagtgtgttccacttccaccgctgaactcggcagctgcagaccaaaatcttggacgggtgatgagatgagatccgccgcccgcgcgcgccgggtttcacgcggtcatgaggaggcggggcttcttgaaggcgagggggctctgaccttctcgtgcttcttccacatattgccgggcttgccgcaccggaacacga

SEQ ID NO: 20067 - DNA, 194 bp, Zea mays
  Clone ID: LIB189-021-Q1-E1-E11-T7A
cccggcagcagtgcccgtcccggaggcccccgccccgatcaccgtcgtcgtcccgccgctgccgccagtcgaggtcggccgcgagccgcacgtcatccaccgccgcgtcctccgacgggcgcctcgagcagagtcaccgtgctcatctgcacaagagttccgacgccagcgctgcggccaagaggagcctatga

SEQ ID NO: 20068 - DNA, 566 bp, Zea mays
  Clone ID: LIB189-025-Q1-E1-G11-SP6A
ttttagtcaggggggcacacatcttcaaccatagtagattacagtaagtatgtgattacgtttcatccacagtgataaaatcacggctgcgaacaagattcaaagggacagctacgccggccatgtgggttgttgacccagcgatgcgcaacgtggaagttgccacaacagcaaagactcatggaatgaactgaatctagacaagatgagggccaataaacggctgggagtcttcaagtttggcaagcacgcacgccccgaaacaatgtttcctcctccggttcttcaatcatattggctctgtcaatggtttcttctctatatgttgttgtcggatgagtctgttgaaggtgagctgcttccggataaatctgcagggcgcgatgttgttcgggtgttgtacgatctgcagtggctgcacttgtggccaatcacgtgaaagttcacctctgagaccttgttgcaatcgttgcaaagcacccaaatcttgtagcgatacacaagaggcatgatcgtggcttcgatctcttgatccaacatttcccaatgatgtgtcaaatcaagag

SEQ ID NO: 20069 - DNA, 543 bp, Zea mays
  Clone ID: LIB189-025-Q1-E1-G11-T7A
cccacgcgtccgcccacgcgtccgaaattttatgatgatgatacagacaaagggcagtaccattgcatcgattgtggcatatgcagggttggtggcaaggaaaacttcttccactgtgtgaagtgtggatcctgctattctgttatactccgtgataaccatcagtgtgtggagaactcaatgaggcagaattgcccaatctgttatgagtatctatttgactcattacaaggaacaagagttcttaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacaacatcgcgccctgcagatttatccggaagcagc

SEQ ID NO: 20070 - DNA, 597 bp, Zea mays
  Clone ID: LIB189-028-Q1-E1-F5-SP6A
tttttaaaaataattatttattatttatattaaaccaataattaattaattatctggacaatttaagtatcttgtccatgtatggcaatataatgagatttaagatttgtcttccttttaaacattttgctgcaaacttcacatcgaaatttcggctcgacaccacaagtgtagttaacatgatggtaaaggacggtgctgttcttcaactttttaccacaacggaagcacatgaataacccatctataaaaaaagaaggaaaaaaattaaaaacaaaattttaattaaaactaatttttgtttgctgaaaatcaatggaaaaaatgagagggtttaaaaaaaatgaaaatgttcaaaataatttattggtgaggatagtgttgaatagagtgggcagtaagttggtcttttcttttaaaggctttcccacaggttgagcagacgaaacgtttttcttgaccgcactcgaattttttatggcgagtcaaattgccgagatggtgatatttcctcccgcagacacacagaaatggtggcttaactaaaaacaaaagaaaaatgtcaaattatttgatttaaaacaaaaacattaccgg

SEQ ID NO: 20071 - DNA, 584 bp, Zea mays
  Clone ID: LIB189-028-Q1-E1-F5-T7A
ctgccctcctttttctttgttttaggtcaacggtttttctgtgatttatgtgggaggtcttacaagtacaagcagaatatgaccgctcataaaaaatacgagtgcggacgcgagcctaaatttcaatgtgtcgtctgctttaaaaaatttaaagtcaaaagcaatttaaaagcccatttagccgttcatggattagcttcttattctttttgattcctaattttttaaaaaattatgttcctgacattttgcttccgtttactccgaaataagcaaaaaaatttttcgtcccaagggtctaatttacgaaaaaaccaaattttatcgtccaatgtatataaagactgtaaataaaaaacattttttaatgaatttgtttaaaaaatacattttttctaacattgtaaataaaccatattttccttcctccctttccttatttggttatctttattattatttttttttattatttattattttttttaggtctctttgtatgccctcagtgtggaaggtcttatcgaaagttgggcactttgagccgccatgttaaattcgaatgtgggcgcgaacgtcaattt

SEQ ID NO: 20072 - DNA, 576 bp, Zea mays
  unsure at all n locations
  Clone ID: LIB189-031-Q1-E1-F6-SP6A
ttttatataaancttacatttatttcaaaagcaagcttgagttattttattacagaccagagctaaaagtgagtgcagagtagtaatattatacaaaccatgggaggcacaaactcctcccgataagctataagcaaaagaacctaagtggaggaccgagtcctcccgcacttcagtcttgtttttcctcatttggtaccaccttggagcaaaagcaacaaaagtttgtcgcttcctcacctgagtaacactaggttagtgttattaggtgacgtccgcttgacgagtatccttcgaccgagcacttgcttgatttaaccgtcttcaggttgattcatcagcttcagcttgcagattagcccacgcttggggtcggcttggttcttcttccgcgtcacacgattatttatcgtacctcatgagatgcatgatgcacatgtatgagcacatgtataacgagtataatatagataatctacgctaaaaagcatgaaacacttaaaaccaagcattaagcaccatggatatcacagcaggacatcgactatatccattaatcaaattgacatattacac

SEQ ID NO: 20073 - DNA, 537 bp, Zea mays
  unsure at all n locations
  Clone ID: LIB189-031-Q1-E1-F6-T7A
cccacgcgtncgcccacgcgtncgcccacgcgtccgcccacgcgtccgcccacgcgtccggggctgcctgtcgcacatgctggcggactccatccacgcggacgtgaccatcaacacgacggacggggtgctgaaggcgcacaaggcggtgctggcggcgtgctcccccgtgttcaagagcatgttcgtgcacgacctgagggagaaggagtcgtcgacggtggacatcggcgacatgtgcgtggagtcgtgctcggcgctgctgggtttcgtgtacgggacgatcgagcaggggcagttctggaagcaccggctgccgctgctggcggcggcggacaagtacgggatcggcgacatcaaggactgctgcgaggagagcctgctggaggacataggctcgggcaacgtgctggagcggctccacgtggcgtggctgtaccggctggagcggctgaagaaagggtgcctcacctacctgttcgtgttcgggaagatctatgacgtgagggacgagatgcacggnttcttccaccacgc

SEQ ID NO: 20074 - DNA, 470 bp, Zea mays
  Clone ID: LIB189-013-Q1-E1-E5-F2A
caaaggccgaacatgatagtgtcaggaaccatataatcaactttttcacacgaattattaattattttgcagggcactccgtcacaatcaccatcattattgacccgagcaccaatctccatgcaatccctactactagggggggatcatcgacaacacctgtgacccggagattaaacacatggcaatcgcaggatggccacatgcagctgcacgcacactgattttgatttgcctttttagagggggggcctccagttccgttccaccccggccgcgctgcgctgcgctggtcactcccagatgccgacctccatgaacccgtcctcgggggcgcagccccggaacatgccggtgcagttgaatccgtacgccacctccccggtgccggaaacggagatgaggccggcgaatccctggtcgaggcgctccttgacgcagtagtcgacggcctcctgcaggggcaggcc

SEQ ID NO: 20075 - DNA, 490 bp, Zea mays
  unsure at all n locations
  Clone ID: LIB189-013-Q1-E1-E5-R2A
ccacgcgttcggngcgcgcaggcgctggacgtcgtggaggccgtggtgcgcgagctggagacggaccccttcttcaactcggggcgcgggtccgcgctcacccgcgccggcaccgtggagatggaggccagcatcatggacggccgcggccgccgctgcggcgccgtgtccggcgtctccaccgtcaagaaccccgtgtccctggcgcgccgcgtcatggacaactcgccccactcgtacctcgccttcgacggcgccgaggagttcgcccgtgcgcagggcctggagaccgtggacaacagctacttcatcacggaggacaacgtcggcatgctcaagctcgccaaggaggccggcagcatcctgttcgactaccggatcccgctggcagggacggacacgtgcagcgcgctggcgggcgcggcggacagcaacggcggcggcgtgcacaaggcggngatggtcatgaacgggctgcccatcagcgtgt

SEQ ID NO: 20076 - DNA, 365 bp, Zea mays
  Clone ID: LIB189-026-Q1-E1-E9-F2A
ggatattaaatcatctattcaatatatatatgcgtcatccttacatacatggataataattctctgaaaatgaaaaaatactagctctggctcagcattccaccaaaaggaaaggaaaccgtccgctctcaagatcaccgaaaaaatgggaggggctggaaacacacatgagaagcccttttgcggggaccgccgctgtaacagccagcgcagtgaacccaagaacattgagcccgtgccatgatttctggatggcacccagcttaggccccttcaccatcaggtacatgtgatttgcgagcacaaacgtcaacgggaaagtgctgagggcgcccgtcaggctcatgaagtcgccgaggaatggg

SEQ ID NO: 20077 - DNA, 452 bp, Zea mays
  unsure at all n locations
  Clone ID: LIB189-026-Q1-E1-E9-R2A
gttgatccttggtatcaagttggcttcgtcctcacaaccggggtcaacagcgcatacgttctaggatactctggatcaatcatggtccctctaggctggatcggcggcacatgcggcctcctcctagctgccgccatatccatgtacgctaatgctcttcttgcacggcttcatgaagtcggtggcaaacgccatatcagatacagagaccttgctggacacatatatggaccgaaaatttacgggcttacatgggctctgcagtacattaaccttttcatgatcaacactggctntatcatcttagctggacaagctctcaaggccacgtatggactgttcagtgatgatggagttctgaaactcccttactgcattgcgatatcaggattcgtctgtgctcttttcgccattggaatcccttatttatctgccctcaggatttggttggg

SEQ ID NO: 20078 - DNA, 116 bp, Zea mays
  Clone ID: LIB189-004-Q1-E1-D1-47Aa
acaatgtaaaatttctaatgctgaaccaaggagtgtttttaagaaataatgcataggccatatggatatatttatatatatatatatatatacctgtatatgaataaatgaaaata

SEQ ID NO: 20079 - DNA, 575 bp, Zea mays
  unsure at all n locations
  Clone ID: LIB189-015-Q1-E1-E3-48Aa
tgacgcgggcccgcagtgcttgaggcccacgtccagcacgacgagcttgcccttgtcgccgcggtgctcgtcgatgagcgcctccacgtcctcccgcgagtgcagctgcaccaccgccgagtggctgtcgccgtagtagaggacgtcgcccgcgagccgctcggggccgatggcctcctcctcgtgcaccttctcggcgcccttgtagaagttgaagtggggcaccttcgtgacgccctcccggcggaacagctcctcggtggcctccgactcgtcgtcgcgcaggaccagcaggaagtccacgtcgccgcaggtgcggctgagctgcaccatggtcgggtagatctggctgctgtcctcgctgtcgctcgccgcgaactccaccaccaccagccggttcttggcggccttgagcgcgtcgtcgaactcctgggtgctgtgcaccctgaccacgcgctcgtgcttgctcgacggcgccttctcggtgcccgacaccgccgccctcggcgtgggcagnaccgncgcgcgccgnctgcgggtgatctgcgcctgcgcgggcaagaacctgacgatct

SEQ ID NO: 20080 - DNA, 299 bp, Zea mays
  Clone ID: cC-zmle18900001a02a1
aaaatacaattgtgttatctggatccaaacaaaatctatttgggatgaaaattgcaacagaagaaaacaacttatatcacatgttcgacagaaacagcaagattgccagtttgccacccaatactagtatcaggttatgcatgtggggagaacaatgtttgcaacactacccatgaatagtatctatcaaaggcaacagtatacatacaagcagggggatcgggatgcacattgtgcaatggatttttgcttattgatttatctccttgctcttttgctcaatcatataaaccttcttc

SEQ ID NO: 20081 - DNA, 458 bp, Zea mays
  Clone ID: cC-zmle18900001a03a1
ttttaactgaaactctaaccctacactagggtgggcttgtatattaataactgagttgggcctggcccattacaaatacaggggtacaattctaacaaagcataaaactttcagcatccaggtggtgtttactagctcgacctcggatagaatccccgaattgggcatgctgcgctcagggtcccatggcaagcagtggccgattctcgtccaagtttgtgtctgctctctgctgtgcgtaagtctgacgaacttcaaatgggctgcgaggagcgagtggggaacagaaatcaacatggaaacaagaacggaaggacaagaacaaattaagaccaggtaacagctacatcactaaagtcaagctagtccatcggtacagacatcttccagggaaggacctaagtcccttttgtacatggcttactttgaagaagattagaggtatccattgtttcgat

SEQ ID NO: 20082 - DNA, 424 bp, Zea mays
  Clone ID: cC-zmle18900001a04a1
ataaaaggaccagttattaaagtattggcggcgcctcggcagttttgcatatatatctattacacattacacatgtatgggagccggagcttgcattcacatatatgttcctcacccaacgaatcgacagtcgttgcactacgtacgtaattgtagatggatgatgccatgctggatacatcaacaggagaattgttggaagcaaaaggaaccattgcatgcaggagaaaagaaatgatgagataaagggaaaaaaaaggagggagagagagagaggaaccaatgcaagaaggtgatccgatcaacaggcagaggcatggccatgggtcgatctagccacgggctctactcactgccggggggcttgtaggcgaagaaactgacgcactgcgtctgcctgacgttgtctaaccccatgacgcgg

SEQ ID NO: 20083 - DNA, 386 bp, Zea mays
  Clone ID: cC-zmle18900001a05a1
ataaaaaaaccgcacttgtgggggtcgtaaaaaaaagaagaaatcgttgacacaagtatgaaacgaaatacaacacttttcaaggcagtttttattcaatctgacacccagcgttcggctctaaaacgcatatatcttaggcaggggaagggctgaaatccttttgtcggctacaaatctgtgccagcgaaagccaaaaacctggcggggggcgcgcaacgagagcagccagccagcggcagcgtgttttttaatccggcgtggccacaccctggttaagctcggcgaacctcatgccgaccctcatggagtgctttaggaacttctccgcgcaccgggggacgcacgactccttttgcttgtccaggttcttgcgccggaacgtg

SEQ ID NO: 20084 - DNA, 378 bp, Zea mays
  Clone ID: cC-zmle18900001a06a1
ggtatggggtttttatttctttttctccatcccaccttatataaataaacattatttataaaacaacttaacaacacacaaatcatccctacctaggaagcaaacccacaaaaaaccatacataaaacgtgcctaaaaaaaaaaaaaaaaaaaccccatcctaccccccaataacaaaaaatcccccccaacccaaccaccctacagtccttttggtttcaaacacccacacccacacaagcccaaaaatacccaccaccccgggggccccaaaaaataaacctccatttaccaccccaaaaccctttcaaaagggtgggaccccaaaaagccccaccttcccaactattcaaataaaatctcctcttcgaacccccc

SEQ ID NO: 20085 - DNA, 427 bp, Zea mays
  Clone ID: cC-zmle18900001a07a1
cagccatgctttcgtcgtgaactacgggaccgggtgatcattctgcatgcaggggggctctaatcatgctggctgttggcggcctaatgccatgctgcgtttttctcatgcgctgctcttcatgccgtcagcagctgtgttgccagggaaagcccagtgcggcttggccagggtgcgcttcgtagccttcactgacagtgacagtgggctgtccttgcccatgaggcaggttccctgcttgacgttgcagacggggtagtcatgggggcagcagctgtagtggtcgtcgcagcaggtggcgccctcgagcgggcagcagccccaggcgaagcagtacttgccgtactcgtagatgcagcagcaggtggtgctgtcggggcacgagtagtagttgtcgcaaaccgtgggcggcggtgtgggggaaggc

SEQ ID NO: 20086 - DNA, 325 bp, Zea mays
  Clone ID: cC-zmle18900001a08a1
gcaagggggacgaaaactggttcagcggtggaatttaatggaagggggactgcacctacagacagattgctagggaaataaaaaacatactgcatccttttgggtacagacacacttattcacacagattatgatatatttcattgaccggggcatggctgagacatgggaccctacagagtggcacccggacattgttaaataacttccaagcagcttactgagattcttgtaaaggctcaaacgcgaaaaggttggatcgtaacgatccacaacacataccttcttgtggaacaacaatgcggaaaaggtgcacttgatgctg

SEQ ID NO: 20087 - DNA, 467 bp, Zea mays
  Clone ID: cC-zmle18900001a09a1
ttttataggcacatccgctgatatatattccccgatcctgcagcgttccaaacggattatgaatacatgcatctggcaacttgacattcctaactgtcagaccaacgatccaagaccgtgaatgggacccaaaattcttactagacatccctaactgccagaccaacgatccaagacagcgaattggacccaaaattctctgctaagttctcgtctacgctagttatcttcactacgacgtaaatggaacattactgtgcaaaatccaccaattggtacgatctatacctaatctgccctctcgagtaatctatacaagtttaactgtacacaagtttacagcaagatgccctcaaagctgcacggatcaactgctgatgccattctttgaggagacataaccgctcccacgttggacattctggggttctgcttgccccgaaacttctgccgggagtgtcttgggg

SEQ ID NO: 20088 - DNA, 298 bp, Zea mays
  Clone ID: cC-zmle18900001a10a1
aaaagaacccaagggaaaaacataaaaattatttttttccgcccatttttatgaattccaacagatggaaaaacttcaaccggggaaaataaaaaaaaaacccttttggggataacattactgatttactggacacagcaccccatattcaggggtcgctcactttttggacacctaggggtaatactgggccatgggcaccaaaacgggaataaaaaacaggcccccaaaaaaaagggggaaatgcccgggcttttcctccggtttctctttgggtttgaagagggactcccgcttg

SEQ ID NO: 20089 - DNA, 109 bp, Zea mays
  Clone ID: cC-zmle18900001a12a1
ggggttcttataattccggaccaatacccgcccgggcaccaacttttcatatcgggagttgaatttagccccggccccggcatgggcaccccttttctcggtgagaaat

SEQ ID NO: 20090 - DNA, 404 bp, Zea mays
  Clone ID: cC-zmle18900001b02a1
ttttgccatttatataaccgataattgatgatggggtgagggacagagttttgaaccatggagcagtttggtagttttacatgactggggaaaaaaaggacatgggattgtagtttttattagcactgctactagtaatgttcacatagcatgggtctgtaataattctgtggataaccatattcaccatcagcaggcaattcggttgccaatgaggaggcagccttagacaagcacctgagctgcagctagtctagcaaacggaacccttaaaggggagcaagaaacgtaatccagcccagccttcgcgaagaaggccacagaggaaggctttccaccgtgttcttcacaaatgcccacctttaaattaggcctaactttgcggcccctttttgttacaagct

SEQ ID NO: 20091 - DNA, 363 bp, Zea mays
  Clone ID: cC-zmle18900001b03a1
gacgttgcatgcacacgctcgtatgcttgaaagcggtacagcctttcttcttttttttttgtatagccatgtggttatctggattacttgaagggagacaggactcaaatcttctacatcgtgcgtcatgggcggtttataacactgggcaaaaagcaagcaatgtaaatgtatctcatgtgatacagggttctatccatattcataacaaccggttttgccaaaactctgagaccctccacatgcatctcagcacgtgaaccagatggcaaagaggatgcttgctgacacactcacctgagcggcagctggcctttctaacacagccacgcctggggacactgaagataccaccgctccaga

SEQ ID NO: 20092 - DNA, 336 bp, Zea mays
  Clone ID: cC-zmle18900001b04a1
gggggggaacggggcgccctcctagagcccgaagcaccaaatttccaaatcatttttgacatcaacagccaactggagggttagttgggccacaactacaatttcagggggattaagccgaaacaaagatcaacaggtttaccttacttgggctctcccttgtgattcagcatgaagccactccacaggggggggggctcattttttgtattgggtgaaggaaccataggcacattgaaaccttggatgggctcaaatatcttgaaatgggcttccaattctggagagaactcacagaactccgtttccatgaagaactttacagcgggcgcgtgg

SEQ ID NO: 20093 - DNA, 492 bp, Zea mays
  Clone ID: cC-zmle18900001b07a1
tacaaccgccgcatgagccccgtcgtggccgcagggcagtggcgcaagggctgccagtggttcgacctggaccggaccctggccgccgacgtggtcgccgaccgcgtctacttcccgctcttccgccgcttctgccgccgccgccactgctacgccgacgagcactacctgcccacgctcctcaacatcgtccggcgcccgtcggcgggggccaaccggagcctcacgtgggtcgactggtcccacggcggctgtcaccccgcgcggttcacgaggatgaaggtcaccgtcgacttcctccggtggctcagggaaggcagcacgtgcacgtacaacggcaggaccaccaccgtctgcttccttttcgccaggaagttcctgccgaactcgctcaccaggttcttgaggttcgcgcccaaagtgatggggtttggttaaaaaccatcatgcatcgacgacggggtacatattttaaggatcaacatctgacgt

SEQ ID NO: 20094 - DNA, 361 bp, Zea mays
  Clone ID: cC-zmle18900001b08a1
atatatatagtatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccgccgcagctgcagccgtgggcggcctcgccggactccgcc

SEQ ID NO: 20095 - DNA, 365 bp, Zea mays
  Clone ID: cC-zmle18900001b09a1
aaagcccgcaaataaaatttctggggtctaaacgtaaatttttatcgcaaaaggggctaaaaaaacaaaaaattcggacagaacgcgctatcggtttcactttcactcacagctattacacatgccaaaatgcatacaggaatttttttttggcccgagatttggcggtcggcccccgcgggaagattgctctgttagttccacatccaccaccagctgacctggccggcgtccttgtcgtcgccgtccgcgtggtgggtgtgttcggagaggaacccggcggcggcttcttcgtcggcgttagagctgcatccctcgtcgttgccggcgccctcgtcgttgtccgactggatgcctccagcgcc

SEQ ID NO: 20096 - DNA, 348 bp, Zea mays
  Clone ID: cC-zmle18900001b10a1
aggtattaaacttacaaaaaacttttattcttgggacgagcttagggttcacatatgtacaggatctgagtgcgtcacttgcgatagccacgtacgatgaccttgagcagccagctaacttctgacatacgtaacgcactcaggcaacctcgaacgggcgtgggtgccagacgacgggacggttcaaatagtcctggggaggagagttgttatgcgatagcggacctgccccgagcaagtgttgatgtatctattagaccctggtttcgagcaccaccaaccccggggcgccgttgtagaccataggggctgtggtgttttgctccagggcatgcgatcgcttctacc

SEQ ID NO: 20097 - DNA, 220 bp, Zea mays
  Clone ID: cC-zmle18900001b12a1
gggtattgggggttccttttatttctttaaaaaaaacggggacggaccccccttctgtcttaagaacccaacctcgacaaggaaaacgttaaaggccctcaccgctcattaagggaataaggtgtagccatcctgttttaaaaataagatgaaggatttctctttgtggaagaaatatttgttaagaccgatatgactacccccaaacccctttgaaaaa

SEQ ID NO: 20098 - DNA, 218 bp, Zea mays
  Clone ID: cC-zmle18900001c02a1
agaaatagggacagggagggatcgttacaccctggaaaagcctgcccttaagcgttttttggaaaccattttaaactaatctgacggagttgggatcgagcaacacacacgtgacgacgtgtgcttttatttacttacacccacccacgtgttcggggcttggggccgggtatttatcgaggtctgcttgcatatatcaaacggggacgcctgggtac

SEQ ID NO: 20099 - DNA, 312 bp, Zea mays
  Clone ID: cC-zmle18900001c03a1
tgcttgcgtgcgtaagctcggatcctctatagcggtacagccgtcgacctttttttttttttttttttttgggaccatctaattaccacagtttataagggccttaaaacagaaaatgggcctgatgggtgtgtgttcttaagagcatcatagaaataagtgtgaactataataaattactcgttgctaggaaagatatgctggcttcaatggccatacttaataaaacgtataaaagggttactttgacttatacgaaggttatttcttccggcccttaacacacaatgacagtcaggtgtctcctaacct

SEQ ID NO: 20100 - DNA, 482 bp, Zea mays
  Clone ID: cC-zmle18900001c04a1
attattatttatttttttcttttcattttactttgtttacatcattcttgtgcgtttggtgatattttaacattccatttctatttgcttcgtcattgcttcctctcagcacccctgaccctatacgtggagtaaattcaatccccaaagagtccttccatggagaaaggcccacccccccccctcggttataaaagcccgcgccaaaaaatcaacgataaggttcactatataaaccccttaacaaaaaatgaacatgtaaaggggtggctataaaaaaaacctaatgaagacttttcttctaataaaaggggagcagcaaaacaaaatctaggggcaaatcacggggcgggccttcacaaacaaaaatctatgggtggctgggataagaggggtaaaaaaaacccccagttaaacaatggggatccgggggcccccattcgcagaaaaagacaaaaaaaaggtccgaaacaaatgggggg

SEQ ID NO: 20101 - DNA, 497 bp, Zea mays
  Clone ID: cC-zmle18900001c05a1
cggcaaaaaaaaaagtctaaattgctctccctgctggtcacttgatcagcagatggcagagaaagtctatatttgattccagcagatttcagagtgttcaaaaggttatagtgaagagatgacaaacagctgtgttcttgtttcatgcagggtgtgtaatatatataatttggaggcaagaggcaagtgaatttgtagcaacaacgccctcggagaaagcctatgagcactgagcaccgcttgtatcggatgatcctcctcatgcactccaccacgggtcctggccggtcctgaagtcggtctccacccacgggacgaagaggaccttgccgtcgtcgacgtcggcgtgaaccagggccagcgacagaggcgccggtccgcggaccaccttgccctggttgttgtactgggatccatggcaggggcagatgaacttgttctcggcgcctgtccaaggcacgacgcagccgaggtgggtgcacacggcgttgatcccg

SEQ ID NO: 20102 - DNA, 367 bp, Zea mays
  Clone ID: cC-zmle18900001c06a1
aggaaaaaaacgccggttttagtatatatatagtataaaatcattttttgggggaccaaataatatatgggtaccggagatgccatgggataaaccaacatggggggggacccccctcccttcatgagcacaaaaactggcgccaaacatgcgggggggggtttccaaccgaagaactttgttttttttttttttacacacaccaaacgattcctttggtgggcagccaactcgggcttgtttttttttgttcaaccgccaccccaagctagagagaaaataatcatatcccggggcgcccatcgaagggaacaacccctgcagggggtgcatttgcaaatggcaccggagctgcaaacgggggggg

SEQ ID NO: 20103 - DNA, 280 bp, Zea mays
  Clone ID: cC-zmle18900001c07a1
cacgaggggaaccggctttcttggaaagaaacccaagggacttggaaaaaaccgccccgccaaattcagggggggctcaaattacaaatttactttacaaaaccccgcaaaatttataaaccctaatagggttaagcccgggggggccctcccaaaataaattttacaagggccgggaattaattcacaaacggggaagaacccccccgcgaaaagaaacaccccccggggggttttggacggttataaaccaaccacccgacccgggggtcgaccccgg

SEQ ID NO: 20104 - DNA, 321 bp, Zea mays
  Clone ID: cC-zmle18900001c08a1
aggggacacggtgggtaaaaagaggccctcttcaaacagccgctgaggagggggtcaccaccgggggcgtcggctgctactactcaacgtccctccgccaatagtaatccgaccaattaaaacaccaccgcctggggcgcccccccgggatttgcccggggcatcccggaggcccacctgcccctctaataggtagccttatagggggttggattaaagctggtcatagtctccgccggggaaaagttgtgggccaacaatttctccccacaaactaccagccagcataaaaaccggaaccggggggggcaaaagaggggg

SEQ ID NO: 20105 - DNA, 467 bp, Zea mays
  Clone ID: cC-zmle18900001c09a1
aatcaaaataacttccatttttttccgaagagccgacagctacaatatatactgtaaaatatatattgtaggagtaagtacactcgaagcttggcggtgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctccgtctcccttccggcggggccagacggtctcattgccgcctctccatgtaatccagctatagtttcatattatatcctccttgcaagtcaacaatggcggctcgcctgagtcaaagcccacaccgtgcggttgcattgcattgcgct

SEQ ID NO: 20106 - DNA, 280 bp, Zea mays
  Clone ID: cC-zmle18900001c10a1
aataataaatatattccccattaattatatctttctttcataaaaaaaaaaaaaaaaattttattttttttaaaaaaaaaaaaaaaaaaaacacacccccataaatatttggggaaaaaaaaaacccccggaaaaaaaagagagattttaaaaaaaaccccccatacaaaaaaaaaaaaaaccacaaaaaacccaaaaatattaacccgcgcactaacaagaggcatttttttaacaatggcacaaaaaaaaaaaaaatatatttccctaggcggggggg

SEQ ID NO: 20107 - DNA, 337 bp, Zea mays
  Clone ID: cC-zmle18900001c11a1
aactaaactttattttcataacggagggaaacaagaaggccctggcgatatttcgggaataccagactaaaattttttttaaaagcatggcctcggggttgggttggaaataccaacccgggtggtggaaccaaaactgcgctggaacaggtggaaaaactaccctgcggggggggggagagctccggccgacatgggcgaatcccccctatcttaaatgttaaaaaatggggctacaccaaaaacaatgtgcccttggttgggggtacccttggccatcccaacgcgggggagggggaggtcccccagggcccaggggctggtttatcttaaccag

SEQ ID NO: 20108 - DNA, 96 bp, Zea mays
  Clone ID: cC-zmle18900001c12a1
ttttacaacttttcacacccatcacatgaggtcaacacaaacggtccaatgatgtctgatgattcccagttgtaaataatggtcaatactgaaatt

SEQ ID NO: 20109 - DNA, 346 bp, Zea mays
  Clone ID: cC-zmle18900001d02a1
ctgggtcttgggttttttattttttattcatttaataatccacaaaagacccgaacatgcttccaaacaatctcagactacaaaaccttgggtccaccaaagggaacccaacaactttcctacagttcaaagactatgaccaagggaacttggcgctacaccccaacaccttacgccttgagcttaccaaaaaacctcctattcaaaaaggaagcaaaaaaacgaccatacccaaatggggaccatgtggacaacaacataaatcttaatttcctaaccgccaccccgaaacttctattcaagaaagacaggaggacggccaccccccctcttttttggacccccc

SEQ ID NO: 20110 - DNA, 425 bp, Zea mays
  Clone ID: cC-zmle18900001d03a1
aacattgacacctctttttttatggtttacacacacacaaccaaccaagttgatgtgaacttacagatgctggtcacgcaattaatttacaaccggtttacagggctttacatcataaacgacatggactttacaaattaccagggagcgcccaccgagtgcttttattgaggattcggggggaccgctcgactggctcccaagctttcggcgcgtgtcatgcctcggctgtttggaccgaccactcggagggatccgatggctgggacttgtgctttgccgcgggctgaagaacccggtttttcaccgccgtcgtggaaggagacgttggcaggcccaccttggttggctctatcttcttagctgcccatgacaaggcgtttgcgcctacttttactggagacagcaacaggtttaggtctttt

SEQ ID NO: 20111 - DNA, 217 bp, Zea mays
  Clone ID: cC-zmle18900001d04a1
acagaacacatattctgtcgggaaatggttgttccaaaacactaggtgagcttttaaacgcacacaatgacgactgaaaaaaaacagcatgctgggtttattttataccatcccggccatcatatttacagaactgaggcacgcctctcaggaagcttggggggcccagaagtgccttttagcaacagactcgcgccagaagctgcttccacagctg

SEQ ID NO: 20112 - DNA, 525 bp, Zea mays
  Clone ID: cC-zmle18900001d05a1
ttttaacacagtactgtctccatcaataagagaaaagaaaatacgcataaggtatcatgctatacgagaccagtttaggcaagaaagggaaagacggaatctactcctcgtcatcctcatcagaggccttctgctgcaggaggtagcgaccctcgccgttgggggtggtctcgtgctgcagagtaagcttggtgaggtggccgatgatgttctccatctgggtgtcgtggtggctgcgcttcttgcgaccgatgtcggcaagagaggggatggagttgaggaggtagtagacgatggcgatgacgatggtaacaccgatggagtaaccccagatgacgacaacggtgacaatgtcagtgtggccgttaagggtctgggtccactgggacatggggttgttgaggggaatctggtaagggttgccggcgagccaaccgaaaacacagaagagggtggcaagaacgtcgacggcaccgatggcgatgatgagctgccacgaggggaaggtctgaccaccacgggtga

SEQ ID NO: 20113 - DNA, 292 bp, Zea mays
  Clone ID: cC-zmle18900001d06a1
aactattcaactctccaattatatatactggtatggcagtagaatcaaatggcggactttttattcaataaacaataatccccgcacaatctgcttttcaagggagttactttaactatgccaccttcaattactactctgttatgcagatctggagaaccttggtagcgctcctgctcaaacacgggacgtgtcccaggacagcttcttccatccaagcggggctcccgcgcaggcctcttctcgagggcagtcaacacattcccctcctgacaggctgtgagttcccatg

SEQ ID NO: 20114 - DNA, 479 bp, Zea mays
  Clone ID: cC-zmle18900001d08a1
actggaaaagagggtacccctgattcaaggtaccgacattatttatatgatatataacaaccgtagcaaagtatgatcaactggctagtaacatatacatgtatacataattttttttgtcaaagataataagtattcaattaaatacccttacttgcatgtaggcccgccctacttaagaggacatagcatctaacgaccatcgcatttttacattagttacaacatagtacaagtacaccatgcatcgcaccacgaacatttcatcatcatcatcattgacagtctacccagtagtccgcccgcaacaaaaaaaatgaagttccatatcggccatcaaacctaacaatgcatgcatgtgtggtagcactcctcgaactgctaagttcatcagagctcctcatttgggggtgaaggcctggaagatggtggcgtggccaaggtcggcgaggtgggcgaaaaagttgtcgatgggtccg

SEQ ID NO: 20115 - DNA, 203 bp, Zea mays
  Clone ID: cC-zmle18900001d09a1
atatatcttgggtttggggttttttttttttttttggcccccccaaaaaaccacgccaagaaggccactccctcctcaaaaaaaaagccccgaaaaaaggacctaagagaaccccctacaaaaaaaaataaaagagccccccaaggccgggagggaaaaccacccacaaacaactaaaccaacacaaaaacccgggaaacccc

SEQ ID NO: 20116 - DNA, 393 bp, Zea mays
  Clone ID: cC-zmle18900001d10a1
ggaccactatcaaaactggcctattttgggcagtcaacgaaaagggtttaccccgcccactacaacgaagtaggggtaccatggggctaagccttggattcacattggtccaatcacaaagctcaggtcttatacaggagagagggaagggccccaaaatagcatttctaatttggggggtggggcaaccaaatgaacatttccaaaacataataacgaaaatccgggaaaaatccatgttgcagctgcaggctgcaacaagcaaatgagccctccgaaaacttataacaaaaatcccatgcataaaatttattcagggacctttccatcggaagaccctacctgagcttgggatagacattgaatccaagccttttttttacccctttgcca

SEQ ID NO: 20117 - DNA, 449 bp, Zea mays
  Clone ID: cC-zmle18900001d11a1
ggaaagaggatctgaaaatagccttagcagggaaggaaatgattcgactcctaaacgcctacaaagggactcccaatcgtatatgcatagaacctttcgttcaatcgggcacacaacaagctttatactggtacatgtcctgtgcttccaattggatggggagtataaatgaaactgcaagcaccattgaacttctgtttaagtataatgggtaaatagaaagcttaaatcaaagagtaatccagcagcagccacgcatgagttccatgggcagggcaccagtttctaccaccaatcagcagagcttcattgaagcaatgctgttcgcaagggccattgcttccttgagctgagaagcgtcacttccctggccctgggcgacgccgttcttgccggcaccgcctctttccttgagtggcgcaattgaaggtggtagccaatccaacacc

SEQ ID NO: 20118 - DNA, 268 bp, Zea mays
  Clone ID: cC-zmle18900001e04a1
gggtaaggggttatttttaaaatttatacgtgaccaattccaaaacaccatttgaacaatcatagcaacaggggtaaaaaaaaagaaacgaacaccaagacacaaccggttatcgggaaaacaaaaaaaaccacggatgatcaaacgaacaaccgagcagatacaacggtaaactttttgttgactatgaataagcgcacccagtgaagacacgcggcccggacgaaacaaactgaggggaaaaacaaaaaaaaaacagaagaactct

SEQ ID NO: 20119 - DNA, 520 bp, Zea mays
  Clone ID: cC-zmle18900001e05a1
ccatgtacacgcgcagttgcaccactggttgggattaaccaatccttgagcatcagatatatggctcaacacacacggagtagaatacaggcaggctcaagaacatgcccgcagccggccgttcaaaaaaagttggggtcgtatccgttgctggaggtggcgaggatgtagtaggcgacgatgtggccgagcgagccccaggcgaggacgtcgacgaggttgaagcccacggggtcgttggacttgagcaggcccgagaactccttggcgcgctcgtcgccggcgtcgaagtgcgtcttgccgttctgctcgggcacctgcttcgccacgttctcccgctggaagttgaagaagacgaagcggcccaggaagagcgacacgcccgtgctcaggctgatcaccagcgacgggctcaactccgggcgcgccgtcacggaccgtcgggccggggccgtgcggaacgccacgcgcgcccggggagacggcgccaggcgaaacccggccccggacggtggggaca

SEQ ID NO: 20120 - DNA, 419 bp, Zea mays
  Clone ID: cC-zmle18900001e06a1
aggcaaatggaacattgattaacgtggactcaaaatattgtattttttttcatctgagacaaacacacgatccagaaacaccacatcaaactccaaatatacttgtccatccgtttccagttcacgtacgctttacgacattggtacctttttggccaagaactttgatcattcaacctttttcttgtgatcctctccgccgccgggtttgacctcctcctcctcatcctcctccttggcgacgaggatcttcttgcacgcctcgtaacacatgaaggcgatgccggcggcgggcatgagcttgatgcagctagggccgagaccttggtacaggccggcggcgccctccttcttgaggatgcagtagatagcgtggaggacgttctggtacacctgccttccgcccacagcgcccacct

SEQ ID NO: 20121 - DNA, 447 bp, Zea mays
  Clone ID: cC-zmle18900001e07a1
ttttgccacgtatataatcgataattgatgatgtattgaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttctccacaaatgcccaccttcaagttaggcctagctttgcggcccctctctgtagcaagcttcaccagctcgcccactcccctctggtccaagacctcgaaggg

SEQ ID NO: 20122 - DNA, 528 bp, Zea mays
  Clone ID: cC-zmle18900001e08a1
gggaataagtaggaacaacagcaaagatttgtgtttggccatctcaagtcgtgcgcatttagactccttatcagttaagctcaagaaggacaatcaggactgcttgtgtgtcaccccagatggctaccttccccccaagaacctacagagctttaaattgtatggccttgcagacagttttccaaaatggatcaatcaacttgaaaatctcaggaagttagttttggagatgactatattaacgcaagatactatcaagggactcaaggatcttaaagtatgtattctgcgtctaattaccaagcagcttcctgatggtaagctcaatttttgtgtcatgttgcatgggcagcaattacgttgctatgaaacagtgaagatactcgagatctcttgcagctccagcttagatgtggcttttggatcacaatcactgcaaaatcttgagctgctgaaagtttcctgctgtagtggttcagggtcggttatgaagctttctgggctagaaaaactgtctgaatctgaact

SEQ ID NO: 20123 - DNA, 168 bp, Zea mays
  Clone ID: cC-zmle18900001e10a1
aagcaaacatagctaaactaaaaatgcacagggcgctaaaacccaagccaaattcgatcaagtaaaaaaaacatttgggtctttagctccacaaacacaaaatacattctaaagcaacaatgagaagccacaccatcgttctataaaacattgttacccacgcgtccg

SEQ ID NO: 20124 - DNA, 462 bp, Zea mays
  Clone ID: cC-zmle18900001e11a1
ttttattagggagggatggggtatatatatatagcatcaaaattatgtaatgaagagtagcactgattattgttacatgacgaaggttgagcatccatggaggctagattatagacagacaccctgattttacacgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttggcgggcttgatcttcttcttggagc

SEQ ID NO: 20125 - DNA, 393 bp, Zea mays
  Clone ID: cC-zmle18900001f02a1
gcctgtcttcttttttttttttttttttttttttgctctaaaccttgtgattaaatcttgggatttataatatactcagtttggaacagggaaaagtacatgcatgcatgcatatatatatatatagctagaattattgagacgacacgttttatttcctgcgcgggcggaactgtatgtggggggacaagatgaccggccctggcggtgtatagctagctagaattataggaggacgtcctccttgtgcgtctcgatgacgacttagggggtgggggacacaacgctggtgagcacccaaccattagacacctgttttttgtagaagaaactctggtcggactggtctacggacccaaagactaacttgtcggctcaggaggagcaagaccc

SEQ ID NO: 20126 - DNA, 328 bp, Zea mays
  Clone ID: cC-zmle18900001f03a1
ctactaatttttctgcccaggggacgaacactggtacagaaggggcatttaatggataggggtatgccccttcacacagtttgctaggtaaatagaaaacataatgcatccttttgagtacagccacactctttcacacggtttatgatatattgttttcctcagggcatggctggtacctgggaccctactgagcgccacccggatattgttcaataacttccaagccggttattgtgcttcgggtcaaggctcaaaggtgctaaagttggatcgtaacgatccacaacaccttccttcttgtggaccaacaatgtggaaaaggttc

SEQ ID NO: 20127 - DNA, 476 bp, Zea mays
  unsure at all n locations
  Clone ID: cC-zmle18900001f04a1
acagaattatttctatgttcacatatatttgaagtttatcagttacaccatatgtgcataacaacatgggccatttacaatgcctgctttagtttgaacaatatgtacatagtaatcgtagataacaaaaaagggattgatcttgggttgtagatgagatgctaaaaaaatccccatcttctagcagtgaaccaaaaagaatagttaaataaaaattaagcagggaccgaaaatttctgcacctatggctttacatgagtcttctaatggttctcgcgagagcccgagataaaatacgattggttaaatccgctggcagaagaagcaactgctgttgggactccggtggaagctcaggaatgacagaaagaactggaagaaattctggcagagaggtcattccatacagcgcaagagcaaggtcatccgngctaccacctttcttcttttggcactgttatattcaggaattggag

SEQ ID NO: 20128 - DNA, 398 bp, Zea mays
  Clone ID: cC-zmle18900001f06a1
aacgggggggaaaacgagatttttacatttttttcacccccaaaaaaaaaagggaaatgaatggcccagggcaaaggcccattatattgggccatacatgcttacacaaccattaattgaacgggggggggggcaaaagcaaacgacgacgggtttgaatcccttcttcccaaggggggaggggggggggaataaattaggggtaaccctggtcccccacctggtgggaggagcccccaatgaaaactttcccctaaaccaggccagggaggccccccccgacaagggggcccacccaataaacccaattttcggggaaatcccccccggggaccggggggcccaaagagcgggcggggtttatggagcccccccttaagggccccccggggagggtg

SEQ ID NO: 20129 - DNA, 497 bp, Zea mays
  Clone ID: cC-zmle18900001f07a1
gcagcggaaatcttattaccaaattttataagggacatcaagttttacaatgtacatgatcggagtgattacaaaagtgattcaaagaaataactttgaactattataaattatttgtagttttgaaatatatgctagcttaagtgaccatccttaataagaagtatagaagggttacttagacttataagaaggtcgtgtccaccggcgcttaacaccaatcacaatcaagtgactcgtaacctgggataaacagtacgttagtgtttgttagacgtcgatcacttgacgaccatcctttgttctgatacttgtttcgtctgtccatcttcaattccgttcatcagcaccatcttgtggtcaactcaattttggttctccgcatcacgtggttaattcacgtaccgttccaacaactgacacgaatccgcccgattcttgggatttcttgatgacacacggaatgacgaccagatcgagtctggagcgagcgcaca

SEQ ID NO: 20130 - DNA, 349 bp, Zea mays
  Clone ID: cC-zmle18900001f08a1
aaccaaaaaatttcatgcctaaattgatattaattaaaggtacccatgaaacaccttaaacattcatgggggtacatttacaaaagttgtctttaggaataataaaaaataaaagcccttggccttagttttcatcggcatcatataaaaaataaaaacttagatttttttttgatttcacaacattggatacaaaacaaaacctaaaaacatttgccatgctttggggccctataacttattgatctggagggggttgtttccttggagggaattggggaaaggagctgttcctgggcagcaacggggcggggattttggcccccggttccaccgttttggaaaaggc

SEQ ID NO: 20131 - DNA, 452 bp, Zea mays
  Clone ID: cC-zmle18900001f09a1
ttttaacacgtcaataacaatatttagctttaacaagcagggcaatcttggacagttttttcttaaaaaaaacctgagttcagttcaggcagggcagctatagttgtggctataacaatagaacatatatagtacccaacatgggtaactaatctagcacttgatctccttaagaccatgagagaaatagaggaatgtcggattagtggcaccatccttgtaataggcgaataccacggacgcttcgtccttcatgctctcaccaacaaaaaattgaaggtccttcagcttgctaaggagaaacttggttgcaccctcgacaccctttttgaactcatccgctttctctggctccaacacagcagtgagattcttgatgtatttttttatgtaagagacacatgatttcttgtcaaaggaggttgctcctgtagacggaatgtgtcaacaat

SEQ ID NO: 20132 - DNA, 313 bp, Zea mays
  Clone ID: cC-zmle18900001f10a1
aggattacgaagaagtggtattcaggtcacgagcttattggcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcaattagccctggggaggaagctctccctgcgctcgtggacctcgccggtgcaggggttgatgtcctcttcgaccctggtctcgcgcaccacgaagccggggccgccgtggtgaccatggtggtggtggtggttgg

SEQ ID NO: 20133 - DNA, 304 bp, Zea mays
  Clone ID: cC-zmle18900001f11a1
ccctaaaaaaaaaaaagggccccccccccctttggatcgattcttcccctaaggactaacctggggggggggattaatttccatttccccgtcatcagagggccctccttgtattggggggggaacccccccctattctttttaccttcccccgggggggacacctcccccccccatctattggaataaggggggtccggggaaaaccatcttttttatttttcggacgtagggcaggacggcaatatggggggccttaaagtttaccccattgccgggggtccctacaattattattccccgg

SEQ ID NO: 20134 - DNA, 329 bp, Zea mays
  Clone ID: cC-zmle18900001g02a1
atgaaacccataataatataaaataaatcatggttctctcactaatacaacatgtgtggcctgattcactgcaaaaaaacatgtaaaacaacaatgttcttaaattctgcaatcaaggcgatagtcttcgaactgcccgaattctggctccatatcacttgcccagcaactggtgtccacactgattcacgcctttcagtctaaaattcagttcagtgatgtcgtcgctgaaaggaaccaacgctttgttttgcctgtcaatttctatgtccatatccactgccatttcttgagttgtcccaacgtgctacacaggttcggacccgtgg

SEQ ID NO: 20135 - DNA, 401 bp, Zea mays
  Clone ID: cC-zmle18900001g03a1
caaaaaagaaacaagttttaattctgtaggcagggctaaccctcattagttctttttggaaaacaggtattaaggaagataatcaaattccaaggaatggtaatgcatcaattgtttattcacacaactcctatcacctaatgcaacaggttagtgataaaagttttttaaaacaaaaggaggtggcaaatgcaccggggcttggctgggataaacactaccttagggttgttaaatggccaccacttggggagcatctttcatcctggtacttgatcagatcatccaagcttcaggttcattcaccagcatcattttggatcaactcgggtcttggccttcacatcacgggattacttaaagaaccgggattcgacgaggtcacaactggggctgccaaa

SEQ ID NO: 20136 - DNA, 413 bp, Zea mays
  Clone ID: cC-zmle18900001g04a1
gggaggaaagccagctttttatttattaaaccatccatccccttagcttaggcattcactgggatatataaaacagaggagctgcgtcgtttatttgcaaaagctcgtcgcacaaatcgctggggcgcgcccgcacagaacaaaagggaagcgagctactactagatcaaaacaagtccttggggggggggagcttgaactccccggagggggaaagcgggatggtgaaattccccaccatggggaggtcgacggggagtcccacctggagctcgtagtcgatgttccagtcccggccgacgtccctgacgagggagaccaggaagtcgtagggcaccttggcggggatctccagcgcgggggagccgctggcggagatccaaccggggtccggcatggggccggaccccacc

SEQ ID NO: 20137 - DNA, 493 bp, Zea mays
  Clone ID: cC-zmle18900001g05a1
agatccaaacgaaacgattatccatgcaaccaaaataacagagtcaagacaaaaccaacccctagtaataggagcagctaaaactccaacaaaccaagtaaacaaagtcattacactctagatagggtagtattcaagcaaaaactggcagcacttccgaaacatcagaaacattaacgttcagctggagacgacgccatcattcaatgatagattagccagctgctgctcagtagaaacattgctctgctggagatgctgggcagagcggaggacctccatggcttcagcaaccttggctttcagagcatctggcgactccagcaggtgaagaacctccgtctgatccatctccaaaagcatgccagtgaccttggcagcctgctcacgttccagctgttcaacaagaagatacaggttctcaccaagcataagtctctgctgatctggtggggcgttagcaagtgcagtggctagcgccccaattggaaca

SEQ ID NO: 20138 - DNA, 585 bp, Zea mays
  Clone ID: cC-zmle18900001g06a1
ttttgtatatagttcttgatacaattccgtatttttttatgttcctgtagaccttcagaataattttttggttgtgcgaaccaaaaggaatggtgattttgggttgtaccaagtctgaaaccgagtggatttattttttgtcccatatttttctattatatttcttttttttttactgggaatcgaaatcttagattgatctaaagattattttgatttctttactatatttagtacaattgttatattacacatcgttttttttatagaataactacgtcctcgagctcgaggtctgaattttttcataatagtactcctactgacttcggctttagtgatgaataaattcgttttgtcgaaatccctataatgagtagcatttgctgctgccgaataaaccaactttaaaatgggatacgatgctcgataaggcatgagattcaatattataacggttttctcgtagtaacgccagcgaatctcatctagaactttttgtgctttgaaaacagacatatgtatgcgtttttgtgctttgaaaacccgttccaattaagtagacaatcgggttgaaattttttt

SEQ ID NO: 20139 - DNA, 405 bp, Zea mays
  Clone ID: cC-zmle18900001g07a1
gatcaaacaccaaaacacttgcaagggcgctgcagttctgaagcgttagaacaatccacagaagaccagaacatgctcccaaatcatcctgctacaaaacttggtacaggaaggtaacaaacaaaagtttcacagtttgatgattttgacaaatgggacttgtcgctgcaccgcagcaccttacgccttgagcttaccaaagaacctctgcttctcatcggaagtctggaagcgaccatgcccaaatttggacgatgtgtcgatgaacttgagcttgatctcctccagcgccagccgggaagtctgcttcaggagggactggcggagggtcaccacccttttctttggacccacacaccatcccttgatcatcaggtagtcacccttcacgataccatagtgggg

SEQ ID NO: 20140 - DNA, 467 bp, Zea mays
  Clone ID: cC-zmle18900001g08a1
ttttgactttatacagctccctagattttgcccagaaagggacacgctggtcgtgaaacccacagtgaagtatagatcaatcatgcaacctaatctgatgcaggagcaggatttagaatcgaattcatcattcgtatgcactggccattacactacatacatgaaaaacaaggcatgctattgccggctgtcagtccatggtgatcctgcccggacctcccttgagtgagctgtacagcggcctcgatcgtttgaagccgaatatgtctgtaattctgtacattttgggcgggttggcttacgtgattgccttcttgaactctaccaaatggttgccgccgaagacttgcacgcttagtgttctcctttgaggcgcgtccacttttatatactgggtgaagtactcgatgaattcttcttttttgagctctcttagcatagcgaccctagacttcgccctatcaaac

SEQ ID NO: 20141 - DNA, 530 bp, Zea mays
  Clone ID: cC-zmle18900001g09a1
gatcagtggccgcccgcgctgacggcgcggaactggcgcttggagatcttgggcagcaggaacacgcccacgacgccgccgatgagggcgaaccccgacgccacgccgaacgccgggatgttgcccttgccgaacagcgcgttccacgggcccgcgcccagcgcgatgatcacctgagggatgacgatggagatgttgagcacgccggtgcacagcccctgcccgccgcccttcgtggccgccagctgcgccgtcaccgcgaacgggacgctgtacaggatggcgagagggacacccaggaacgcgaagaggacgaggcagacggccttgatgctcgtgctggcggtgatggcgtcctgcacgtatccgtggtagtccttgagcgaccagaagctgatcagcgcggtggccgccatggcgacgcagaccatgaagttgcttgtcacccacaccacccttgggccgaccttacggcacatgggctcgatcaggaacgagctgaatcctagaacgatcgagttgagcagcag

SEQ ID NO: 20142 - DNA, 325 bp, Zea mays
  Clone ID: cC-zmle18900001g10a1
catggttatacacaagcccgactaaccacccaaacaaccgacattgaagacaagccttggtgccctctcctgacatacaattttggtagaaagggcctagcatttgacatttgcctaacaaactttggaaatcgattccaattgggaaaatcaaacaagcttttggtcatcctaacatagctaaaggaaaagggtgtttctgaagtacggcctgagtatagccttgagctttttatgacttggttcagggatgcattatccagccttggcatagaatttttaccattaagaggaagggcgcacattttagcagcacccgcaagct

SEQ ID NO: 20143 - DNA, 406 bp, Zea mays
  Clone ID: cC-zmle18900001g11a1
acgcaagaagaaaccgttctgaagaattttcaagacgaaggggaatacattattcacaaaagaggggggaagtttcagttatacaaaacttcttcatctaatttctttaaggacaacagaccacttccatttcttcctcctacaccaaaaggcatgtttcccacgttcgaagactgcccaactcgtctgcagggatgtgcaagcacaggtgcagcagctaatattagccgatgtccttgttatctactacgagggttttgttgataaactcccggtaggccgcgacgggccaaatgaaccccctggggaggaggcgggtggcaaactccacgtcaataatgatctcccttatggggggctttttttctccgctgagggcgatgaggaaacttctgccggacccgtg

SEQ ID NO: 20144 - DNA, 502 bp, Zea mays
  Clone ID: cC-zmle18900001g12a1
gcgcaagcaaaaagaaagttttccaggcgaggagaaagatggaggggaaggagcaggatgtgtcgttgggagcgaacaagttccccgagagacagccgattgggacggcggcgcagagccaagacgacggcaaggactaccaggagccggcgccggcgccgttggttgacccgacggagtttacgtcatggtcgttttacagagcagggatagcagagtttgtggccacttttctgtttctctacatcaccgtcttaaccgttatgggagtcgccggggctaagtctaagtgtagtaccgttgggattcaaggaatcgcttgggccttcggtggcatgatcttcgccctcgtttactgcaccgctggcatctgagggggacacataaacccggcggtgacatttgggctgtttttggcgaggaagttgtcgttgcccaaggcgattttctacatcgtgatgcaatgcttgggtgctatttgtggcgcttgcgtggtgaaggg

SEQ ID NO: 20145 - DNA, 422 bp, Zea mays
  Clone ID: cC-zmle18900001h03a1
ttttaacaatggaaattgaggctttattggatttggatctaaatatactacaggtacagcatccatatgcaactaacagcaacgatcttttctaccttgaagatcagcaacggtatagatgattacagcaccaagtcagtggttaatcatagagagccaagcgcagtacgtgcacacgagcttctgagagatgtacacgtacacggcgaaggagaagctcatgagcgtgacgtccttccagtcccccttctgcttggggctcaggctctcccgcgctgccatcccggccttcaccacgtcgccgcgcagcctctcggccgtggcagcccaccacggggtggtgtttttctcaccaccttctcccccgccgccgtcgattgccggcggcccggacgggaggtgactttggcagacgaggtagg

SEQ ID NO: 20146 - DNA, 421 bp, Zea mays
  Clone ID: cC-zmle18900001h04a1
ttttttttttttttttttattttttttttttttttttttgggtttggggttttttttttttcttcttttcaacatcccccaaaacacacccatcccgggcacccaaccaagaagaaaaaagcccccactaacaacaaacaggacgtcaaaaggaaaaacaaccccaaacaaaacaacaaaacctattaatcaaaaaaccaaacattaaaaaacaaaaacccccaacaaaaaacattaatctcccggagaaaaaaaaacaaaccaccatacacaaaacacaaaatttttaaaccccccagaggcacaggcccaaccccctccgacccggaaacaacccccctcccccggggcccaaaccaacaatatgccgcaaaacaattaaatcaaacataggccccaaagaaaccccccttgcccaggc

SEQ ID NO: 20147 - DNA, 486 bp, Zea mays
  Clone ID: cC-zmle18900001h05a1
ttttgcgaacaaaaaccttgctcattcttctctcgtctcggttcatagcgggagcaaacaaagggaacaacaggggtaccaacacctaatccaaaggtagaacggacactaacacggtgacagaagcgaacggtaacacgatactatagatagataagataactcggccgaagccaggatgggcccacacatcagtcccttcagccgccgccgccgccgccgtagccgccaccaccaccctcgcgccgaccgccgtagccgccaccgtcttcgtagccgtcgacaccaccctcgcgccgaccgtcgtagccgccaccgacgccataaccgccgtcacggcgcccgccaccatagccgtcgccgtcgcgaccgtcgtcgtagacaccgtcgtcaccgtcaccgacacgggactgggcctggttaacggtgatgttacggccgtcgagctccttgccgttcatgttctcgatagcgtcgagcatggag

SEQ ID NO: 20148 - DNA, 457 bp, Zea mays
  Clone ID: cC-zmle18900001h06a1
aagtcaaaatctatcatatttttggccattcttatccaatccatatgccataacttggtatcgacatgataatttcagcacgcgttcttacatcacagagggggtggtaagtaatacaaccctgctgctccgaaccacacctagtacacgtccgctaactttggcatgcagggagtacccaaaaaaggagctttacaggggagtggacacacccaaactgacgaccggccgtggcccgacgcgacacgagcagtcgatcgttcgagcaaaaaagcggagtggctggtgcaagcaagaaggcaagggagcagcagcgcactagtatttagtatggtacagcagcacgtcgtagtacaggtgcacgtcgtagtatgtaggtgtatatataggtacagtacagtccgtgcggggcggattgcaggcagagcaaaacgagcaacgccagcgggagagcccg

SEQ ID NO: 20149 - DNA, 467 bp, Zea mays
  Clone ID: cC-zmle18900001h09a1
gaaataaaagtgctccaggaaggggaggacatactgcatatgcaaaacatcgagtcaaactataataacccctcgtttaactacacgacacgactcaaaacctgatttttactgtcatagtacatcagaagattcagtcaaacatacatgggaaaattacatgatggcaagcctacaactagctgctgttatgctgctgatgccggtgctcagttaatctccggcatgccactcgccagcagtgctgcaaggtcagcgcagccatgaccaacaacagcggggtaccaatgagacagcctcctggggcgaggttaacaagtgtcatcgcagcagcagccaaatgaattactggaacaaagacttgatcacttttctttccctcggcatatgcattaaaagcaataatcattgagaaagtatggatgaccaagaatcccaatgctataagggctgacgcaaggaaaaat

SEQ ID NO: 20150 - DNA, 129 bp, Zea mays
  Clone ID: cC-zmle18900001h10a1
ctgctttttattttttttttttttttttttttttttttactacttctcttttttgggtatttggggctttgtgtctcgctataataagatcaatgatgctttcctgaacatgtattatatttcgggcac

SEQ ID NO: 20151 - DNA, 423 bp, Zea mays
  Clone ID: cC-zmle18900001h11a1
ggcggcggaaggcatggccgccgccaccttccaggcgaacgagagcgtgagcagcgtggcgagcggtcacacggtgcgccgcgcccggtcccgggccggcgacccgggcgccgcccgctcgtaggcgcggaggcaggcgaagaggaggagcagggtggcgcaggaccccgcgacgaagaggacggcggccgtgtcgtccctcgcgcggtagatggcgaggcccgagttcacggcgagcaggcccaggcccgcgccggcgagcaaggtctgcccgtggttccgccggttgttgttgtccgccatggcttgggttggagggcagggtcggccggtgtcagagactatacttgagtagcggctcttgctttgctgtgctgtccgagacttcgagtccgatagagccttatctttggtgacttgacg

SEQ ID NO: 20152 - DNA, 431 bp, Zea mays
  Clone ID: cC-zmle18900025a01d1
gactagttctaggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaagagtttgggagagaccttatctaaaaa

SEQ ID NO: 20153 - DNA, 618 bp, Zea mays
  unsure at all n locations
  Clone ID: cC-zmle18900025a02d1
gtggaggagcgtgtcgaccaggtgctaagcgaggctgccgactctgacgtcgccttccttgttgttggcgacccgttcggggcaactacacatactgatctggttgttcgtgccaagaaaatgggagtagaagtgaaggtgatccacaatgcatctgtcatgaatgcaattggagtttgtgggctacaactttaccgctatggggaaactatctcaataccatttttcacagacgaatggagaccagatagtttctatgagaagattcagaacaatcgccagcttgggctgcacacactttgcctgcttgatatccgtgtcaaggagccaacatgggaatctttagccagaggaaagaaagtctatgaaccaccaagattcatgactgtaaacactgcaataagtcagctttttgaggtggaggaagcacgtgggggatatgcatatcgcagggaaacattgtgcatatgagtggcacgactcggaagtgatgatcagaagattgctgctgggcctatggagaagctactagatgttgattttggtccaccccttcactggctgatcatagtgngagagactcatncttnggaagaagagatgctaagagtttacatg

SEQ ID NO: 20154 - DNA, 302 bp, Zea mays
  Clone ID: cC-zmle18900025a03d1
cggacgcgtggggtcccagctttccttctatcgaaattctggtctttgctaagcagtttgcaattcggaacccccataaaccctcgactattgtacctagagataaagtgaacggatatcaagatagaaatgcattaatgtttttgtgatgtgtagtataactgatatttaccccttttctttttttgagagaggacgcatgatgtcgtttgagcaataaagtttaatttgggagaaaaaaaaaaaaaaaaaaaaaaaaaaaaaaaaaaaaaaataaaaaaaaaaagaaaagacaaaagtta

SEQ ID NO: 20155 - DNA, 287 bp, Zea mays
  Clone ID: cC-zmle18900025a04d1
aacgagaacgccatcaacgccatcaagtccttgttcggactctgaaacaagtgaggcgattgttagcttagcttgccctcgtacaacctgaccatttgccgtgcagatacattgtgtgtatgagtactgtccaaatgtaaagggaaatatgcaattgtgcttgtaagccacatgccaaatatgttaagcatcaagaaggtgaatatgttagcggacaaactctaaaaaaaaaaaaaaaataaaaaaaaaaaaaaaaaaaaaaaaaaaaaaaaaaaaaaaaaaatagg

SEQ ID NO: 20156 - DNA, 507 bp, Zea mays
  Clone ID: cC-zmle18900025a05d1
cggacgcgtgggggctgtcggtaaggttcttcctgaattgaatggcaagctcactggcatgtccttccgggttcccaccgtggatgtgtcagttgttgacctcactgtcagaatcgagaagggggcctcctatgaggaaattaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgagggtcgtcccaatggcctttggtcgcagaccaactttgctgcttgtctatgctgagaataaatgtgaacggtgcccctggacgctggatccatgct

SEQ ID NO: 20157 - DNA, 191 bp, Zea mays
  Clone ID: cC-zmle18900025a06d1
cccacgcgtgggcgaacgcgcaggcgactacatgatttttattttcagctactaggtctcgcacggctggcaggggcagctgtcacattacatgggcaataacgagtgtaaaatgtgagaaaggttccctgagcacatcctcagagattgcgcaccgctcgattttgatttctacatggaggagatgttat

SEQ ID NO: 20158 - DNA, 110 bp, Zea mays
  Clone ID: cC-zmle18900025a07d1
cccacgcgttcgctaacgcgctggcttcaacgtgatttatatttacaacttcaattcctagcatggctggtagagcaaacttactcattacatgtccaataaccacttta

SEQ ID NO: 20159 - DNA, 232 bp, Zea mays
  Clone ID: cC-zmle18900025a08d1
cccacgcgtgcgcggacgcgttggcgtctgctcgatctttatatacagcttctcacatttctcacggctggctggggctggttatacactacaagggcgactaccactgcatactaagaaaaaggctcccttagcacatttatcagtgatgtacgcaccgttcatattttaaattcacatggaggtgtatttatgtccccctacaggctatgacttttgtttaccctttcct

SEQ ID NO: 20160 - DNA, 140 bp, Zea mays
  Clone ID: cC-zmle18900025a09d1
cggaagttcgggtcagacccacccgtccgcccacgcgtgcgcgaacgcgtacgcgttaacgtgcccctttttttcatatccgacgtctcccaacgctggcggggacagcttacacacaacaagcgcgataacctctgtga

SEQ ID NO: 20161 - DNA, 153 bp, Zea mays
  Clone ID: cC-zmle18900025a10a1
gcacaattacatgtattttgcggaaaaatacggtgatacatttatcaaacacactttggcagttcttgtggaagctccggttgatatgcctgtcagccttttgctctgatcaatgggtactcgaaagtgcttgtaccatgagttcagttccac

SEQ ID NO: 20162 - DNA, 167 bp, Zea mays
  Clone ID: cC-zmle18900025a10d1
gcggaactgaactcatggtacaagcactttcgagtacccattgatcagagcaaaaggctgacaggcatatcagccggagctttcacatgaactgccaaagcgtgattgataaatgtatcattgtattttttcgcaagatacatgtaattgtgcaaaaaaaaaaagat

SEQ ID NO: 20163 - DNA, 344 bp, Zea mays
  Clone ID: cC-zmle18900025a11a1
ggttgggagcaaaatacacataatgtaaacccatgttcacccgtttttgggcaaaatttcaagagcgtaaaggaaaaaaaatacccgttacctttcataaatttccacaaaccacaattggaaggggattgggcgtgttttgtgaccttcaaacaaattttttcccttggaaccctaaaaccccagccttcgctgatcaaacagggagttccgggtgttttcggggatcaaaccatgttggagacgaacttcccgtacccaaagaggccccacaaagcatttggggggcccttttgtcccctttagcctaaaaaggccttgaaaagattgggggttgttactgt

SEQ ID NO: 20164 - DNA, 348 bp, Zea mays
  Clone ID: cC-zmle18900025a11d1
cccacgcgttcgcggaagtttcagcagaaaagcaacggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccaacatcggctgccccggtgctttctggaactccggctaccagcacttccaaagcaccaggcc

SEQ ID NO: 20165 - DNA, 541 bp, Zea mays
  Clone ID: cC-zmle18900025a12a1
ttttcaactttaaaggttctcttttttttcttttttttattgcatgcacacagatcattcattaatatataatgaatacaaatatatgtaaacccaagaggagcatgcacgcatggttcgacgtttttagttactaataacttgtcaactaattaagacttccctatgccccttagttactatcaacttgaataaacctataacacatccatccgtccgtccgtatctgtgtagcattaaaccaaggtctaataataataataagagcccccaataattatttacatcgtccaccagtagtacgcggcagtgtatactagctacacccatttgttccccagtgttccgtcagaatccatcgtagaatccaccgaaggatatgttggccctcgaggacgcgccttcttccgcccccatcacggacgacatggcctggttcagcctcgacgtctgctgcaccacctgatggatcctctgcatgcacaccacatcagcacacacactacacaacacaaagaggccggcacgggaggcaagcaag

SEQ ID NO: 20166 - DNA, 407 bp, Zea mays
  Clone ID: cC-zmle18900025a12d1
cccacgcgtccggtttccggtttccctgcagtgaaggaagaggaagcccaaccccatggacagcagtgtacaatcaggctgatgcttgttggaactcacctgttgatgcttgtaagcctcgctgcctggctgcgtcctgcgctgtagatacgagatcccgcagcgttcgtttgttgcacttgcaccggcttgctgctagcttgcgacaggactaggaggagctagccgaggaggaggtgtgtgactccatggacgcgggccatcaggatgcgtgggactgggactgggaggtcctgctgccagaccacaggagctcctcctccgtgcgccaccacggtagcaagaataaccttgacgatcaagaagaagcagaggagcccgacctgctgcctccgccaggaggggac

SEQ ID NO: 20167 - DNA, 312 bp, Zea mays
  Clone ID: cC-zmle18900025b01d1
tggttcagcaaaagggccagcaaggaaatcgactccatcggcgacgacatcagctcgatctcaagcagcattggagggtcagccaaatggatggtgaacaaaattaaagggaagatgcagaaagcacttccagatcttctcaaggaatatgacatgccagcagggctctttccacgggacacgactaactatgagttcaatgaagagacaaagaagctgacagtgtacatcccgtcagcctgtgatgttggttacaaggactcgtcagtgctgcggttctttacctgtgtgaccggctaccttgaaagggga

SEQ ID NO: 20168 - DNA, 301 bp, Zea mays
  Clone ID: cC-zmle18900025b02d1
atttcaacggttgctgtgaaatacatactgaaccagacgtctgttgcaggttccatggtcggtgtgagattgggactctctgaacacatcaaagacaccaacgccatattctcacttgaattggatgaagaggacatgaacatcatcactgaagtgtcgaagaggggcagaaatttgatcgatattattggggattgtggtgacgagtaccgagcttagttggccatgctgctgctgggctactacagacctatatactcgtgcccaattttgcacagctctaaatttttgcctatttggg

SEQ ID NO: 20169 - DNA, 479 bp, Zea mays
  unsure at all n locations
  Clone ID: cC-zmle18900025b03d1
gcagcttcctgctgtccacggtcacgcgcgtcacgcgggaccgcggccacgcctgggtcaccaacaacctcaacgcctccaacctcgactactactacgccttcctcaccgcgctcggcgccgtcaacttcgtcgccttcctcgcgctcagcgccaggtacaggtacaaggcccagtccaccgacacgatcgacgctgccgtcggcctggagaccgagaaagccaagcttcaggcggagccactgggctgacgtcgacgacgacggggtgcgtctgcctctgctgttaaaagcggagaagatcagccatgaatgcgtatcgtccaaggcgacgtgtgtagcatcaactcacttgtaaaaaaaagcacaggatttccacccgaaaccaaaagcagtgtctgcagtatcaactcccttgtaaaaaaaagacagtccatgatctttcatttcattcacacgcanataaaaaagtattgatcg

SEQ ID NO: 20170 - DNA, 477 bp, Zea mays
  unsure at all n locations
  Clone ID: cC-zmle18900025b04d1
ggccaagcaagggtacaggaaaagacatgtgtcagaggagaaaatttctgatgagaaggcaagtgcttcaataaccactagaaatattaagaaaaatgttgatgttctcatcgacacagtgacggctgttgttgcaccacatgatgatccacctactcagaacaagaagggaacccggcatttgagaagtaagaaaaagttagatgatgctccagttacttctaaacatccacctgtggtgttgaatgagccgaatacagtgaaagtctctaccgagccaaagacacatactggtggtgttatcatcagcagctctattgttcctactgaaggtactattgtaactgttggaagtataactgttggtggaatttcacttaaacctatgaatcaggagcgggttaaatcaccagatggaacanataatactgaaagtagccaaccaagacctcagcaaacgagaaaatctggaaagca

SEQ ID NO: 20171 - DNA, 68 bp, Zea mays
  Clone ID: cC-zmle18900025b05d1
cggacgcgtgcgcgctggcgttggcgttgtccctgaatagattggcaacttccatggcatgtacgtct

SEQ ID NO: 20172 - DNA, 67 bp, Zea mays
  Clone ID: cC-zmle18900025b07d1
ccgacacgtgggcaaacgcgcaggcatcacctttctttttttttacagtgtatactgtaagtacggc

SEQ ID NO: 20173 - DNA, 391 bp, Zea mays
  Clone ID: cC-zmle18900025b09d1
ccgacgcgtgggcgaaggcgttggtgacagcatgactttcatagacagcttgaagttctcgcacggctggttgggccagctccctcactacaagggcaaggacctgtttataacaagagagagctacgctggccacttctttccacagtaagcccagtgcatggttgagttcaacatgaaggagaagctattcaacccgaaaggcattgatcttggcaaccctgtgctggagttctacaccgacttcaactctcggtccgagttcttctggttgcacggcctgatattggactccacctacaacatcttcactacagtgcgctgctactcgttgtacgtgagcgagtactaccgcggctccatgagcacagcctgcgacaagttgactagc

SEQ ID NO: 20174 - DNA, 260 bp, Zea mays
  Clone ID: cC-zmle18900025b10a1
ggtgatgtgatttttctttattaaatgggtgaggatggacacaaacacagtgttgcaaagatcgagggagcccccgattactcccttggtagagatgggcactgagcatcgggaactaaaaacatgatcgacgctgactcaaatacctacgggcgcgactaacaacaatggatgttcccgcctatatacagcaaacaacaaggataaccctattcttggaccaaggcagccgtggccctgaatggaggaggcctgacaac

SEQ ID NO: 20175 - DNA, 165 bp, Zea mays
  Clone ID: cC-zmle18900025b10d1
ccgacgcgtgcgctgaggcgtaggtgtaatctcctaacctctttgtcttcccgaaatcatgcctgcctggtcggcctgggttttcctctacctcatcaaatacgttcattataccagagtgcgcatcttttactaggtacactatttcacacgctcctctcactc

SEQ ID NO: 20176 - DNA, 207 bp, Zea mays
  Clone ID: cC-zmle18900025b11a1
attaggattgcgctggagccaagggtcccaactgaaacgcacacagtgttgcagacattgtgggagcccaagatgaaacggttagtaggcttgtgcattgaccaaggggatatacaagattgtttgcccattaacacattgtcatcaatggtgtaacaccatccaggatgttcactccctgttacagccagcgagcccaaactccct

SEQ ID NO: 20177 - DNA, 130 bp, Zea mays
  Clone ID: cC-zmle18900025b11d1
ccgacgcgtgcgtgagggtgtaggcaaaagcatgaccgcctttttcagacttaaatgcttgcaaggctgttaaggctggttgcctcattaaaggggcaagggcctgtgtttaatatgatacagcaactct

SEQ ID NO: 20178 - DNA, 392 bp, Zea mays
  Clone ID: cC-zmle18900025b12a1
aaacacaaaacgaatccaatggtttttaacatcacaaaatacaatatcgaatgctaggtcaaaatgcatttgaaccttacaccattatacaagacagtccgaccaaacaattacactctagcgctatacaataccaaaacgacgaatgctagtttctagttattcactatacaagttatttattttatttgactactcgcaacattattcatcgcgtgatgtctttgtatgaatatggatgggttcaggaaacaccggcctgagggtcttttctggagcaacaaatatgatggcactcttcacagtagaaggcattatttacataaacttcgttccccgaccatgccctaccaggctggttctgcgtttccatcacctgcagtgttcctttt

SEQ ID NO: 20179 - DNA, 409 bp, Zea mays
  Clone ID: cC-zmle18900025b12d1
aaaaggaacactgcaggtgatggaaacgcagaaccagcctggtagggcatggtcggggaacgaagtttatgtaaataatgccttctactgtgaagagtgccatcatatttgttgctccagaaaagaccctcaggccggtgtttcctgaacccatccatattcatacaaagacatcacgcgatgaataatgttgcgagtagtcaaataaaataaataacttgtatagtgaataactagaaactagcattcgtcgttttggtattgtatagcgctagagtgtaattgtttggtcggactgtcttgtataatggtgtaaggttcaaatgcattttgacctagcattcgatattgtattttgtgatgttaaaaaccattggattcgttttgtgtttaaaaaaaaaaaaaatta

SEQ ID NO: 20180 - DNA, 344 bp, Zea mays
  Clone ID: cC-zmle18900025c01d1
aggtattgagacactcggtggtttcttcaccagattgatcaactgaaacactacaatccctacaaagaaaagtcaggtgttctcaactgctgctgacaatcagacccaagtgggtatccgcgtggtgcaaggtgagcgtgaaatggcagcagacaacaagcttcttggtgaatttgaccttgtgggcattccacctgccccaagaggcttgcctcagattgaggttgcattctacattgatgccaatggaatcgtgactgttgctgccaaagacaaggcttccgggaaggagcagaacatcaccatcccatccttgggtggggctgctgaggctgtcatccata

SEQ ID NO: 20181 - DNA, 380 bp, Zea mays
  Clone ID: cC-zmle18900025c02d1
aaccatctaccagcgactcagcgagcgagagcagcacacacgcagctagctaggagcagcagcaccggcggcggcgatggcggcctccatgatctcctcgtcagctctggcggtggcgcctcagggcctggcgcccctcggccgccgagccttctcctttgccgtggtctgctccaagaagaagatcaagaccgacaagccctacgggattgggggtggtctgaccgccgacgtcgacgccaacgggagaaagggcacgggcaagggcgtgtaccagatcgtcgacaaggacggcgcgaacgtggactgatacagtccaatgtacaacgaggatgactgggctcccaccggcgacgtgtatcgtctgggaaccactgggc

SEQ ID NO: 20182 - DNA, 622 bp, Zea mays
  Clone ID: cC-zmle18900025c03d1
cccacgcgtccgggaggcccggcggcggcatcacgaccctgcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgcggactggtaagctgaaccctgcgagcgagtacccgcccggctgaaagcacgctcttctcacatgaaggcatcgccgcgcatgcaaacact

SEQ ID NO: 20183 - DNA, 239 bp, Zea mays
  Clone ID: cC-zmle18900025c04d1
ctcacgcctgcccatacacaccgggaagggcccgctcgataattcttttgaccacattgccgaccccgacaacagcaacgcttgggcctacctcaccaacttcgtccccggccagcgagggaggcgccgtcggggaccttgaggtgtccagatgcatgtgagcgcacgctggttttcggatcgtgccatgatgtatactattgttcaatcgacaaggaatgattgtggtcattgtcatt

SEQ ID NO: 20184 - DNA, 154 bp, Zea mays
  Clone ID: cC-zmle18900025c05d1
cggacgcgtgcgcgaaggcgtaggcgacagcgtgacccccattttcatttaccaaggctcgcacggctggctggtgaaggtgtcacattacaagggcaaggacctctgcctcacgagagaaaggatccctgtgcacttagtctcagtttgtgca

SEQ ID NO: 20185 - DNA, 98 bp, Zea mays
  Clone ID: cC-zmle18900025c06d1
gccactcgttcgtaaacgcgcaggcatcgacactattttttttaccaactacttacaactgcttgccgggctggcgaactcttcacctatccaggccg

SEQ ID NO: 20186 - DNA, 406 bp, Zea mays
  Clone ID: cC-zmle18900025c08d1
gcgtcgcgtctgtcaacattgttcttcctgcattgatttttatgctcactggcatgtccttccgggttggaccgtggatgtgtcagttgttgacctcactgtcagaatcgagaagggggcctcccttgaggaaattaagaaagctatttaggctgtttctgagggcccactcaagggtattatgggctacgtggaggaggatctggtttccaccgacttcaccggtgacagcatgtcgagcatcttcgacgccaaagccgggattgccctgatacgaccactttataaagctcgtcttgtggtacttcaacgagtggggctacagcatccgcgttctcgaactgatccgccacatgttcaagacccagttagctagtagagagatagatttctgcctccctatcga

SEQ ID NO: 20187 - DNA, 126 bp, Zea mays
  Clone ID: cC-zmle18900025c09d1
cccacgcgtgcgcaatcgcgtacgcctctacttgatttttttttacaacttccaaaacttgcaaggctggttggggcaacttcctcactacaagggcgacgacgcttgcgtaccatgatatagcct

SEQ ID NO: 20188 - DNA, 243 bp, Zea mays
  Clone ID: cC-zmle18900025c10a1
accaaaggggtgaggatgggaacaaacacactgtggcaaaccttgaggaagcgccagaccacccccctttttgccatagacaatgatccctgggaactacaagatggtgggccgcttcctcaattccctctggccgctacaaccaactggggaggttcattccctttcaatgcaggcgacacgccgttcccttttcgggtaccatggcagccgtagcccaaacatgaacagacccgcccaccg

SEQ ID NO: 20189 - DNA, 128 bp, Zea mays
  Clone ID: cC-zmle18900025c10d1
cccacgcgtgcgctaaggcataggtaattacgtgtcccctattttcagcatccaattctcgcatggcttgttgggcaaggttacacattacaaggcctactatcacctgcataatgagatatagctac

SEQ ID NO: 20190 - DNA, 291 bp, Zea mays
  Clone ID: cC-zmle18900025c11a1
aaccttgaagatattttttctgcagcccagggacataagtggaaggtacacagtgttgcagacttcgtggggacgcataacgaaaccatgactaggtataaactgtggccactcccattaacaagactgtttccacacaaaaacattggcaatatggctgaaacaaaacaaaggatgtttactccatgttaaatccagccagcccacactacctatttcttgttcatgggggagccagtcccacaaggacaaatgaggtcggccatagttatcacaaggcccctcctaatg

SEQ ID NO: 20191 - DNA, 437 bp, Zea mays
  Clone ID: cC-zmle18900025c11d1
cccacgcgtgcgagaatgcataggcatatgcttgtccccactttcctgtcttcaatgtttctatcctttttgcggctggttgtaccattaacggcgccagcgcctttgtttaatttgatatagcgagtcatgatgaatgttgtaaaacttagcaagagggcaggtgttgtgcgcactgaagggaagggtaacttgcgcatgaggacatacgcttgccacatgaggtacatgcactgatgacaagctgcttcaaagcacctcgaaaagagtaggtgtgaacaacttttatgggtttcaagatgcgataatttttttagatgatgttgctattcattttgctataggctagtgctctcgcgatgataggagctaatacatgggtcggtagaggaactctgcagacaaagaatatggaagaggtgcttccgtcgtattgt

SEQ ID NO: 20192 - DNA, 493 bp, Zea mays
  Clone ID: cC-zmle18900025c12a1
ttttaacatattgagtagtaaagatatattttctgcagcccagacaaataaatggaaggtgaattgatatgtggtattcatcttcatgcatcacggtaccttgatttggtctaaagtgtggcctttaccattaacaagacttttaccacacaaaagcaagggagatatggatgaaaaaaaaaaaaagaggcatacttcatgtaaaatcccaccagcacgccctaccaaattctcgatcatgacataaccagtcccacaggcacaaataaggtaggtcagagttctcaacaggtcccttctaatggcatggtttaacaacagcaggcatgtagcaaaatcatgaggactcctttttctcttccgcggcctcctcaaatgtctctccagggacaagctcaggaacgtcatcatcatcgtcctgaacagccccagcgctggcaccagcctctgcaccagaagcaccagaggcctgcttctggaattgctctgcgag

SEQ ID NO: 20193 - DNA, 591 bp, Zea mays
  Clone ID: cC-zmle18900025c12d1
cccacgcgtccgagcctcccgagccctatccttttccccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgcccgcgctggtgctgttcaagacgatgatgatgacgtttctgagcttgtccctggagagaca

SEQ ID NO: 20194 - DNA, 404 bp, Zea mays
  Clone ID: cC-zmle18900025d01d1
cggtttgcaagcaattcgacgaggatgagctctgccatgacacgggcacgcttgaggggcttgcagggctactcgaccgaaccaatgctttgtctagcggcaaggtcgtgatacctgacaatgctggagagggtggcgtgacgaggatctggatcgcgcatggagaacaagacggcatcaccagctaccctgcctctaaacgtctgttcagtgccctacaagtcaaggacaaggagttccagtcgtacgcgggatgctaccatcgcttacatgacgagcctagtcctgataaagacgccttccgggacgacgttgtcaactggatacttgctcgcgcgacagacccttggggcgaagatagtgcatagccaaggctataaatatttgtagaagctttcttaaac

SEQ ID NO: 20195 - DNA, 616 bp, Zea mays
  Clone ID: cC-zmle18900025d02d1
ggcgcttttaatctcgagatggcttgtgctttagtttggttggtgtgcgaagcaggtactgattttctatgcatttttgaaaggtggctcatgacatgcacattccccttgcctacgctgatgctgtgattggggcagctggtgctagtatcagttatatccgtagacacagcggcgcaacagtaactattcaagagagcagaggtgcacccggagagatgaccgtggagataactgggactgcagcccaagttcaaactgcgcagcagctgatccagaatttcatggcagaagctggcccaccaccaccaggcccggcgccagctttcaacccttccgtaccaccagttgatccaaacttaggctcttacccaccaccatattgagcagctcctttttatggtcttccgaaattgctgggcctcgccatacaatggggggacttctgggtgccgacctaccctctcagctttggtttttatagacaagtgttgcttaccatgatttggcccccccccccccctctttttttctataacaacgtggtgggttggaaccccccccccggggggggggggttttaaccccttttttaaaccgaccgtaatgttctaat

SEQ ID NO: 20196 - DNA, 327 bp, Zea mays
  Clone ID: cC-zmle18900025d03d1
cttagtccaggccatcgtcaccgggaagggcccgctcgagaacctcgctgaccacattgccgaccccgtcaacaacaacgcttgggcctacgccaccaacttcgtccccggcaagtgagggaggcgccgccggtgacctttaggtgtccggatgcatgtgagcgcacgctggttttcggtttgtaccatgatgtaaactattgttcaatcgacaaggaataattgtgttcattgtcattaaagaagaacaaccatacgatagaaaataaaaacaaagaaaagaaatataacttgctatatataataaaaaaataaccaaaataaggg

SEQ ID NO: 20197 - DNA, 609 bp, Zea mays
  unsure at all n locations
  Clone ID: cC-zmle18900025d04d1
cgcttgctgcagcatacagattgctgacaccatctgtgaaggttcagctactgatctacttcatgctcaagttcgccatggaaatcctactctcggagtcgagtgttgtgaccacgttctatttcaagtggacaactagtaccgtggcaatctttctggcagttcttggcctgacggttctcccagttaatgtcatcgttgggagctacgtcaccaacctgttccaggacaggcaaatcctggtggcctccgagatcatggtgttgatcggcatcgtcatgagcttctgcttcacccctcactactccgtcccccagtatgtcacgtcagctctcatcacgttcgtgttcgccgaggtgctcgaaggggtgaacttgtccctcctctcccgcgtgatgtcgtcgaggctctcccgcgggacctacaacggcgggctgctcttgacggaggccgggacgctggcccgcgttgccgccgacatgaccatcacggccgctggctatctggggcagggccgcctcctgaacgccaccctactgncgtccttggtgatctgtctagcatctatcgncgcgacgttctgcacttacaactcactctactgatgac

SEQ ID NO: 20198 - DNA, 514 bp, Zea mays
  Clone ID: cC-zmle18900025d07d1
ccagccaattttttggtagatcacccgaacggtgtaggatcgtttcaccacattgctaatcgaggctgccttttctgacctcgtctttcttgatgttggagacgcgttcgggtcaactatacatactgaactggttgatagtacctataaaatgggagcagatctgaaggtgatccactatgcaatctgtcatgaatgcaattgcagtctagtggtctacaactataccgccatggtgaaactattccaataccattctttacagacgaatggagaccatattgactctatgagaagattcagaacaatctccagcttgggctgcacacactttgcctgcttgatatccgtgttaatggaccaacattggaaatctttatccacaggaaagaaagtctttgaaccacccagattcatgactgtaaactccgcaacaagtcagcttctagaggtggaggaagcacgtggaggatatgccttatcgtagggaaacattgtgcatatgagtggcaca

SEQ ID NO: 20199 - DNA, 253 bp, Zea mays
  Clone ID: cC-zmle18900025d08d1
tttgggttgaaccacccctccggattagaacgccaataacgctatctagcccttgttctgacttttaaacatgagaggcgatagttagcttaactgggccttgtcaacctgaccatatgccgtgcaaattcattgtgtgtatgagtactgtacaaatgtaaagggaaatatgcaattgttctatgcaagacacatgccaataatgttatagcatcaaaaaggtgaatatgttagcggtcaaacttcaaaataa

SEQ ID NO: 20200 - DNA, 178 bp, Zea mays
  Clone ID: cC-zmle18900025d10a1
acgtgaaatttctttaaaaaaagggagggggtgggaacaaacacagtttagcaaagatagagggagcgccagattactccgttggatgaaataggattaggtgaccgggaaatacaacagtgttgccccttgtgtcaagttacactaagcacgagaaaacaccagtggaggttccggc

SEQ ID NO: 20201 - DNA, 110 bp, Zea mays
  Clone ID: cC-zmle18900025d10d1
cctacgcgttggctatggcgtaggcataagcgagacccctcttatacattttgaacagcttgaagggttgttaggggcagggtacatattacatgggcaaaaacgttttt

SEQ ID NO: 20202 - DNA, 436 bp, Zea mays
  Clone ID: cC-zmle18900025d11a1
ttttaacttttttagtcttaaagatatattttctgcagcccagggaaatgaatggaaggtgaattgatttgtggacttcatctggacgcatcacggaaccttgatttggtctaaagtgtggcctttaccattaacaagacttttaccacacaaaagcatgggagatatggatgaaaaaaaaaagaagaggcctacttcatgtaaaatcccaccagcacgccctaccaaattcttgatcatgacataaccagtcccacaggcacaaataaagtcggtcagagttcttaacaggtcccttctaatgggatggtttaacaacagctggcatgtagcaaaaccatgagggctcctttttcttttccggggccttcttatatgtctctgcagggacaagctcatgaatgttatcatcataaccctgaacagccccagcgct

SEQ ID NO: 20203 - DNA, 475 bp, Zea mays
  Clone ID: cC-zmle18900025d11d1
cccacgcgtccgagcctgctgagccctatcctttaccccactttcgtgtctccaacattcctatcctcttcgcggccgggcgtgccaccgccgccgccaccgccgcggcttaccttcctatcgcgagccaagatgaatgttgtaaagctcaagaagatggcaggtgctgagcgcaccggtgggaagggtagcgtgcgcacgaagaagaaggcatcccacaagactacaaccacagatgacaaacggcttcaaagcacctcgaaaagaataggagtgaacagcattcctggtgttgaagaggtcaacatctttcaggatgatgtggttattcaaaatgaaaatgctaatgtgcaagcgacagttggtgctaatacatgggtgggtagtggaactccgcggacaaagaatctgcacgagctgcttacgtggattgtcaaccagcttggtcctgacaacctggacaatctgcggaggc

SEQ ID NO: 20204 - DNA, 474 bp, Zea mays
  Clone ID: cC-zmle18900025d12a1
ttttaacatatttagtattaaagatatattttctgcagcccagacaaatgaatggaaggtgaattgatatgtggtattcatcttcatgcatcacggtaccttgatttggtctaaagtgtggcctttaccattaacaagacttttaccacacaaaagcatgggagatatggatgaaaaaaaaaaaaagaggcatccttcatgtaaaatcccaccagcacgccctaccaaattcttgatcatgacataaccagtcccacaggcacaaataaggtgggtcagagttctcaacaggtcccttctaatggcatggtttaacaacagccggcatgtagcaaaatcatgaggactcctttttcttttccgcggcctccttaaatgtctctccagggacaagctcatgaacgtcattattatcgttctgaacagccccagcgctggcaccagcctttgcaccagaagcaccaaaggcctgct

SEQ ID NO: 20205 - DNA, 574 bp, Zea mays
  unsure at all n locations
  Clone ID: cC-zmle18900025d12d1
cccacgcgtccgagcctcccgagccctatccttttccccactctcgggtctccagcattcctatcctctccccggccgcgcgtgccgccgccgccgccgccgccgcggcttcccttcctctcccgagccaagatgaatgttgaaaagctcaagaagatggcaggtgctgtgcgcaccggggggaagggtagcgtgcgcatgaagaataaggcaagccacaagactacaaccactgatgacaaacggctacaaagcacctcgaaaagaataggagtgaacagcgttcctggtattgaagaggtcaacatctttaaggatgatgtggttattcagtatgtaaatcctaaagtgcaagcgtcaataggtgctaatacatgggtggtcagtggaactccgcagacacaaaagctgcaagatctgcttgcgtcggttatcaaccagcttgccactgaccacctgcacaatctgcggaggctcgcagagcaattgcagaagcaagcctatggtgctattggtgcagaagactttgtcaaccgctgngctgttcacgacgatgatgatgacgttcctgagc

SEQ ID NO: 20206 - DNA, 428 bp, Zea mays
  Clone ID: cC-zmle18900025e01d1
ggtcctcgtgattgatgaattgactggatatgagatcaacgttttcctactgccagagcctatcggattcatgctcacctggactgctgttttgcccctaatacagttcttaccgcatccttagactcccgctgtcttgcccgatttcccaatcctcaacgtgccatgtactaattgacgtgctgaaaaccgttacttatttgggactatactgtctgtccccagtggcgggacaacaaacaaagtcatacgtgcaaactgcagaacgcgcgcttgtatatgactgaaaatacttgctcgatcacacttgcagaaggatcaaatgctttaacctaggaacagggagctccatagcttgtgaattctatagaataaatggggttgtccgcacagtatagcaaactgcgaagcctgcaactactatagtt

SEQ ID NO: 20207 - DNA, 396 bp, Zea mays
  Clone ID: cC-zmle18900025e02d1
cccacgcgtccgcccacgcgtccgcccacgcgtccgccaattcccgtctgcccggccgcggagcggagctgctcctgccccccgtcgccacgccacgatggcggagtgccgcagcctcatcgagttcctccgcgcgttcgagcaccaccgcagggcggtcgacagctccgcctccgcgtgctcccgatccaggcgggcgtccgccgccggtggctccttctgcgacaacaccccgatggccgtgatcgacgcggtcatgctcctcgccgtcgacatcgcgatcggcttcctcctgatcccgtacctcaagctgctccttctcgagatgggcgcgatgctccaccccggcgtgttctgtcttccggacgacgtcttcttttgggccgcggtcgccgt

SEQ ID NO: 20208 - DNA, 314 bp, Zea mays
  Clone ID: cC-zmle18900025e03d1
cccacgcgttcgctgactcacgcgccacggcgaccaccacttcatttatatacagatggcggaccaccacgacgtgagcggtgtgtcctacatacacaacgtgctggacatcaacggagggcagacccacatcataaacagaggtcgcgtgatgtttgtgaacgagcgctcgtagtctggtccgggcaagggggaaaccatcacctgctaggtctgggatcgctgccttctttgctgtttacgattctgctcccttcggtgcaaaatattgggcacggcgcgtggtttacctgtccaagaagaatcactgttgc

SEQ ID NO: 20209 - DNA, 258 bp, Zea mays
  Clone ID: cC-zmle18900025e04d1
attttaggtcgaccacgcgtccgcccacgcgtccgcatactcacacggaataggcccgctcgagaatctttttaaccacaataacgatcccttccacggcagggtttgtccctacaccaccaacttcgtccccggctagtgagggaagcttcctctgtgatctttaggtgttcggccgcttgtgagcgctcgctggtatttaggatcgaaccatgatgtaaactattgttcaatagacaaggtatcattgcgttcatt

SEQ ID NO: 20210 - DNA, 70 bp, Zea mays
  Clone ID: cC-zmle18900025e08d1
aaaataaaaaaataagaagagaaagagacaagaaagaaaaaaaaaaaaaaaacaaaagacaaaaggggga

SEQ ID NO: 20211 - DNA, 148 bp, Zea mays
  Clone ID: cC-zmle18900025e10a1
attaaatgggttaggatgggcacaaaaacagtgttgcaaagatcgagcaagctccagactacaccccatgtagctataggaactgagcatcggcaaacacaagatggttggccgcttactcaattccccccgggcgcgacaaataaca

SEQ ID NO: 20212 - DNA, 454 bp, Zea mays
  Clone ID: cC-zmle18900025e11a1
ttttaacatttttagtattaaagatatattttctgcagcccaggcaaataaatggaaggtgaattgatatgtggtattcatctcgatgcctcacggaaccttgatttggcctaaagtgtggcctttaccattaacaagacttttaccacacaaaagcatgggatatatttattaaaaaaaacaaaagaggcttacttcatgtaaaatcccaccagcacgccctaccaaattctcgatcatgacataaccagtgccacaggcacaaattaggtgggtcagagtcctcaacaggacccttctaatgggatggtttaacaacagcaagcatgtagcaaaatcgtgagggctcttttttcttttccgcggcctctctaaatgttttttcagggacaagctcccgaacgtcatcatcatagacctgacagccccagcgctggcaccagcctctgtacca

SEQ ID NO: 20213 - DNA, 325 bp, Zea mays
  Clone ID: cC-zmle18900025e11d1
gggtcgacccaccgtcgccacgcgtgcggcctcccagccctatccttttccccactttcgttctccagcattcctatcctctgcggcccgcgcgtgccgtcgccgtcgcacgcgccatggcttctcttcctttgcgactacgatgaaggtttaaagctcaagaagaggcccgtgctgtacgcactcgggggaagggtacagtcgccggaagaagaaagcagtctccaaaactccaaccacagttgacaaagctgcttcaagcacctcgaaaggaataggagtgaacatggttcctggggttgaagaggtcaacttctttaacgat

SEQ ID NO: 20214 - DNA, 393 bp, Zea mays
  Clone ID: cC-zmle18900025e12a1
ttttaacgtttttagtattaaatattttttttgtgcaacccagggacataattggaaggtgaattgatatgtggtattgatctgaatgcatcacggtcccttgaaccgggctaaagggtggcctcctccattaacatgacttttaccacacacaaacaagggagatcttgcttaaaaaaaaaaaaagaggcattcttcatgtgaaaaaccaccagcacgccctaccaatttctctatcatgacataaccagtcccacaggcacaaagttggtaggtcaaaattttcacccggtcccttctaatggcatggttctaacaacagcttgcataaaacaaagagatgaggacttctttttctattccgggacctcctcaaaaggttgtccagggaca

SEQ ID NO: 20215 - DNA, 74 bp, Zea mays
  Clone ID: cC-zmle18900025f01d1
atgcatttctcggatcgttcatccggaacatttaaaaaaaattttataatataatcatattaaaaaaaacaaaa

SEQ ID NO: 20216 - DNA, 375 bp, Zea mays
  Clone ID: cC-zmle18900025f02d1
gcggcccctgagtttgctgcagtcactgattaccaaggagctgatcattggggcggcgaccaatggacctctgatgtggctgcaccacctgtagctcctactggtgctgattggggtgctgcaccatctccggttcctaccggtgatggctgggatcaaactgtggcccctgttcctgtggatggcactgttcctccagtggtcgctcctactggttgggaatcagcagcccagcccactgcccaaggctgggaataggcgctgaggcatcactttgagacgtgttgtgcgggattattccaaagtatgaatgcccgaagtcagacgacatattttgtagctaatctgctatgcttagtgcacttatgtttttag

SEQ ID NO: 20217 - DNA, 440 bp, Zea mays
  Clone ID: cC-zmle18900025f03d1
acccaattttgggttgacccacgcgtccggctggggctcggcatcaggttgcgctacaagtacaagatcacctaccatttctaccgcgtcttccccaacggcgaggtgcagtacctccaccccaaggacggcgtctacccggagaaggtcaaccccggcagggagggcgtcggccagaacttgcgcagcatcggcaagaacgttaaccccatcgacattatgttcaccggcatggccaccttcgactaatcacacttcacgtacgccgcacgccccagccgggatccaaattaaagaacttcttcttctattaattacagtatattgtaatttggctgctggtactgtggtggcatgattcgagatgtgcatgatgatccttgtgtaattgtattaccaagtctcttcttatatttacatgtacatttgctcgcttcttg

SEQ ID NO: 20218 - DNA, 583 bp, Zea mays
  Clone ID: cC-zmle18900025f04d1
ccaatgcaatcaacctggtagactcgcttcccttctcccccattcgtttgacggagctcctcgcagtcgcagcagccggcgatcagcctgcgctcgggctcagcgctggaaggtgttggaagagaatagcctgaaggttcacagtgaccttcatctgtcggaagatgtatcgggctaagagggctgcattgtcaccgaaggtgaagcgccgcgtcggcaagtacgagctcgggcgcaccattggggaagggaccttcgccaaggtccggtttgcgaagaacacctaaaacggggaacctgctgctatcaaaatccttgacaaggagaaggttcagaggcacagattggttgagcagattaagcgtgaaatttgtatcatgaaattagtaaggcaccctaatgttgttcgactgtttgaggtgatgggaagtaaagcaagaattttcatcgttctggaatatgttaccggcggagagctttttaaatcattgctactaatggaaggttgaaggaagacgaagcacgttaatactaccagcaactggataatgctgttgattctgcccagtaggggagtgtttac

SEQ ID NO: 20219 - DNA, 117 bp, Zea mays
  Clone ID: cC-zmle18900025f05d1
ctgacgctttcgctatcgcgtaggcttatacttgctcttttttttaatttactatgatctgaaatgctgggtggggaagcttctacataacaagagcacacaccttcgcatactcaa

SEQ ID NO: 20220 - DNA, 116 bp, Zea mays
  Clone ID: cC-zmle18900025f09d1
cccacgcgttcgcgaaggcgtaggctcttgcctgttttttcttttcatcttctaactctccctggcctgggtggggatgtttccacattaccagggttattcccagcttataaagt

SEQ ID NO: 20221 - DNA, 411 bp, Zea mays
  Clone ID: cC-zmle18900025f10a1
atcacaaaagcgaatggatattacgataccaatcacgtacaacatatatagggagccaggccaaaaaataatatttcgccaaccttgttactaacttcaactactaccgacttcgactccccaggggaattcggtctttgattgagggttcactacttgcagtatacaccacacaaataaaataataacgggcctccgtccatgcggtaaatggcctcccagttttttgaaaacatgctccccacctttactagccattaaaatcctacctcctgaggccctcaacgatgtatgtagcatacaggtccatagagtgctgtatggctttataagcggcgctcgctggtagaaagttattcacaggaacctccttgttctcattctttttgtaggccccgaagaagcgcctga

SEQ ID NO: 20222 - DNA, 417 bp, Zea mays
  Clone ID: cC-zmle18900025f10d1
cccacgcgttcgccggtacgttgacgaataccagcctaggctttctttccccgtgtgggcctacaaagatgtggcccgacgtcgccgttgaccgagggttattcgaaggctcccggaggttaagccgttgcggagacacgaatcttacagactggctctgcgatgaggctaatgattctgtggtccacgtgcaggacgactactgctgtggactttgagcttcacttgtagaaaggtcccgctgccacaatcatattggagtgagtgactaatagtcctgaggtgggcgcggatcgatatgatctgtgcaagtctactggactgattattgtggaccttgtgctagcatcattatggggatacccttacaactcttgatgtaggctattcacgctatgcgctgacagcgctgctttg

SEQ ID NO: 20223 - DNA, 434 bp, Zea mays
  Clone ID: cC-zmle18900025f11a1
ttttaacttttttagtatttaagatatatttcctgcagcccagggaaataaatggaaggtgaattgctatgtggaattaatcttcatgcatcacggtaccttgatctggccttaagtgtggccttccccattaacaagacttttaccccacaaaagcaagggatatatgggtgaaaaaaaaaaaaagaggcttccttcatgtaaaaacccaccaactcgccctaccatattgtggatcatgacataacgagtcccacaaggacaaatctcgtgtggcacagtcctcaacaggtgccttctaatgggatggtttaacaactccttgcatgtagccacatcgtgaggacttttgttttttttccgcggcctccttaaatgtctcttcagggacaagctcaagagcggcattattatggccctgaacagacccagcg

SEQ ID NO: 20224 - DNA, 127 bp, Zea mays
  Clone ID: cC-zmle18900025f11d1
cccacacgttcgaggatgcatagccctaagcaataacaaactttctggtttccatattgcccatgtctcttctgggccgggcgtgccgtagtcctcgccaaccccgtggctccccttattctaccga

SEQ ID NO: 20225 - DNA, 344 bp, Zea mays
  Clone ID: cC-zmle18900025f12a1
gcgcccccgccaaactttaagatcccaagggggggccccaaaataaacaacacatttttggccaaaaaaattagcccctgcccccccaacaaaggaaaaaggggttttctccctgccccatggcgccacctcgggcaaaccccttgttccaccccgaaaacccggcccccacccacaaaggagcccagccttacccttaaagaggtgcattaaaaggggggggaacaacagcaacaagcttgtcccgaaaaaaaaaggaatccctttacaattccccaaaaatataaaaagcggaggcaaaaacatgaaccccgggggccccaagagaggccccaaccccccca

SEQ ID NO: 20226 - DNA, 376 bp, Zea mays
  Clone ID: cC-zmle18900025f12d1
cccacgcgtccgcccacgcgtccggtgatgatgccatttgccatgcttgtggtcgcagtggtcaatgttagtgcaaaatattgtatatatatttgagatccaccataggaatcatgatgcttgtgccgtacgaaaaaaataaaaaaattcataaaaataagcatgagataaaagccaagatcgaaatacgaaaaattcactggaaaaaaaatagaagaaaacaaaaaacaaggggcggccgatttaaaggatcaaagttatccttccgggtgcttgcgagatcaagatttttttatagggaacagtaaatcaattttactggcgatggttttacaagccttgtattggaaaaaccctgggggttcccaaataaata

SEQ ID NO: 20227 - DNA, 563 bp, Zea mays
  Clone ID: cC-zmle18900025g01d1
cccacgcgtccgcccacgcgtccggaggactacccctatcgtgaagcagatgggacatgtaacaagaacaagctgaaaaagcgagttgtgactattgatggttacactgatgtaccttccaacaaagaagatttgttacttcaggctgttgcccagcaacctgttagtgtaggaatatgtggtagcgctagagcatttcagttatactaccagggtatctttgatggtccatgtccgacatctcttgatcatgctgtgttaatcgttggctatggttctgaaggtggcaaggattactggattgtgaaaaactcttggggtgaaagttggggaatgaagggctatatgcatatgcatcgaaacactggtgattccaagggtgtctgcggtataaacatgatggcatcatttcctaccaaaacaagctcgaatcctccttcttcaccaggcccaggttctaccaatgcagtctgctcacatactgtcctgagggatccacctgttgttgctcatggcgtgtcttgggcttttgcctttcctggagctgttgccaactggacaat

SEQ ID NO: 20228 - DNA, 615 bp, Zea mays
  unsure at all n locations
  Clone ID: cC-zmle18900025g02d1
aattttcgggtcgagcccaccgcgtccgcaaacagccatcaggtagctagcacctagcacgtagcatacccgcatctcactggctcccatcatgccacatgtagcagctgggttcctagcaagagtcttagctctgcttcccaactgttacancttcggcatgagcttgcatattcgtttcgtatcgcacatcgcttaaatctgcgatggcaccatgtgtcggagggcggctagctaccctggtgctcatccaaggcggcagcattgccgcctcttcgcgtgcagtttacccttgggatggctgcagcgcgcggggaaggatgacagagaccgacagcgacgacgacgacgacgactacgactgcgctcctgctgcctgatcgagaccctgccgcgttctggtgaaattgatctgcgtgtgctctctgagatgatgaagatatgctgccccgtacgtaggcggtaggcaaaccggcgaatagcatgtcgtatgtagtagtactaccgattgttaaatcccagaatagagtacgtacctgccgctgcttaaaactataatttggcgttaatttccactctaggcaaggggatcatgttatgttttcgggttttcgg

SEQ ID NO: 20229 - DNA, 179 bp, Zea mays
  Clone ID: cC-zmle18900025g03d1
cttacgcttacgctgtcgcgcccgccacgacgacatcgatttttcggggtaccagctgatgatgggccatagcgggaggccttccgtcttcaccagtgactaggtcttcattctgccagaccggctccacgctcattcttggagtgtcagcccactgcgcgttggttgatggactgaga

SEQ ID NO: 20230 - DNA, 67 bp, Zea mays
  Clone ID: cC-zmle18900025g04d1
ctcacgcgtgcgctgaggcgtgggctacgccgcgacctccatttccagctcccatggcacgcactgc

SEQ ID NO: 20231 - DNA, 284 bp, Zea mays
  Clone ID: cC-zmle18900025g05d1
gccacgcgtccggacatgcgcagtacatgtggctgtctagattttctgctactccgagtgtgagtgagaagagcgcactcactgaggtcgccaccattggcaatgatccaccattaaaatgttgcgcgcctcattgtgttcatgcttcgaggaaaagatctgggcactattctgctagcccatgccccatggctgtagtcctcagtacatcgcctcatccgagaagagcctctcatggtacaaactcactgggatcggcctgggcatttctagaggtcttaact

SEQ ID NO: 20232 - DNA, 64 bp, Zea mays
  Clone ID: cC-zmle18900025g06d1
ctcacgcgttcgcacacgcgttcgctctggcgctctctagtttttaccaaattgccagtatcat

SEQ ID NO: 20233 - DNA, 572 bp, Zea mays
  Clone ID: cC-zmle18900025g07d1
cccacgcgtccgcaagcaacatagaaagtggaatccattagctacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttctttcattcaaccaactgtctacattgaaccgtgctgcttatttgcagcaacaactattaccattcagccagctagctactgcctactctcagcaacaacaacttctttcatttaaccaattggccgcactgaaccccgctgcttatttgcagcagca

SEQ ID NO: 20234 - DNA, 395 bp, Zea mays
  Clone ID: cC-zmle18900025g08d1
cccacgcgtccgctaagattgaagaggagaaaaggaaaaagatctcatgactgctgtgaataatattatggggaccttactcggacacaacatcggcgacaatcacgacctacttctataccttgttttgttttcatcttgagtcagtcgatccattgtttgttcccagtctggtgattaaaagtctgcaaattctgtttgtggaattggcagcgatacaaatttggcttctttaagtaaatccggttgccggtacacagcggtattaattcacctgtaactgaatggaataccgtgatgcaaagggcacaacactctgcctgactaaaataaaatggtgaaggttcagtctcgctctaaagagagataacgtgccttgctttccgacctaacgg

SEQ ID NO: 20235 - DNA, 519 bp, Zea mays
  Clone ID: cC-zmle18900025g09a1
ctcactgtttttccgtcttggctctatatgcacatacaaacgaacaccatgttaccggtcggccttccccctacatccatggtgcgaagaaggtgtagccatgcaagacactctgtccacggagagggagagagaggaccaatcacccgggcctagacctaccctcctaataccacttgatttactccttcatttatatgaacgcgccctcatataaacgatacatcagttcgtccgtcctgtctgatccgatccagcggttgctatgagtctatgtgattttaccacagatcttcctctttttttttgtatgtaaataaagtttgaggtccaggctcgtcatgtacattcgggagcgagtgaaatcgggtacctaggaattaggagcagagggacaagagggcctggctgcttggctacagcaacaacagaaaaaatgggggaaaaaagagagaagggccttcttggatcagaatcaagatctcgtctcctgtgtgtctccctcttcggggagggaag

SEQ ID NO: 20236 - DNA, 532 bp, Zea mays
  Clone ID: cC-zmle18900025g09d1
cggacgcgtgggcggacgcgtgggtttttaccagtattatacatcttgatttcatttcaattacagcaggataggacaacatacaataatcaggagagaaaaggggaaacgccacaaataaatgtcttcctctcacacacacacagcttattcactgcttgactgaacaacctagctgctgctgctgcttggtcctgctcagactcaaagctcctcttgcacgtagccactcttttgtacagattctccatgggccttggaaatttcttttctttcttgggtgcatggacggacggacaaaaacaattccatcgaaaacccaaaaaagagaaaaagaaaacgtcgttgattgatgaactaggacagattacctaactactcccacgacctcccactccccaacctaatccaacgactaaccaatccttcctccctcccttcccgagagagggagacacacaggagacgagatcttgatcttgatccaagaaggcccttctctctttattcccccatttttttgtgttgctgt

SEQ ID NO: 20237 - DNA, 351 bp, Zea mays
  Clone ID: cC-zmle18900025g10a1
atcacaaaagcgaatgggttttacgataccaatcacctacaacatatataggcagtcaggccaaaaaataatatttcgccaaccttgttactagcttcacctactaccgactcccactccccaggggaattcggcctttgattgagggttcactacttgcaggctaccccacacaaataaaataataacggtcctctttccatgcgggaaatggccccccagattttcgaaaacattctccccacctttcctagccattaaaatactacctcctcaggccctcaacgatgtatgtagcataccagtccatagagtgctgtatggctacataagcggcgctcgctggtagaa

SEQ ID NO: 20238 - DNA, 452 bp, Zea mays
  Clone ID: cC-zmle18900025g10d1
cccacgcgtccgcagatgcgtggtctgacggcattctagggtttatttccccgtgcgcaactctttcaatttgggcgacgtcggagctaacccagggtgaattgatggctcccggtgtgcaaaccgtgaaggagacaggtacctttcagaaggtaactgcgttgaacgaaaggatgctgacgttcatgtacaagaggattgttgctgcacacccttggcatgatctggagataggttctggtgctccaaccatattcaactgcgtcattgagataccaaggggcagcacggttaaatatgaacttgacaagaaaactggactgatcaaggtggaccgtgtgctgtattcatcagctgtttaccctcacaactatggattcattcctcgcacgctttgggaagacagtgatcctttggatgcactggttataatgcatgagcctgttattcca

SEQ ID NO: 20239 - DNA, 399 bp, Zea mays
  Clone ID: cC-zmle18900025g11a1
ttttaacttttttagtatttaatatttatttcctgcagcccagacaaataaatggaaggtgaattgctatgtggaattaatctccaggcctcacggaaccttgagctggcctaaagtgtggccttcactattaacaagacttttaccacacaaaagtgtgggatttttttattaaaaaaaaccaaacaggcttccttcatgtaaaaacccaccaacacgccctaccaaattctggaacatgacatagccagttccacaggcacaaatcaggtcggtcaaagtccttaacaggtcccttctaatgggatggcttaacaacaggaagcatgtagccaaatcgtggggactcttttttctcttcggggccccctgaaatgtcttttcagggacaagctcacg

SEQ ID NO: 20240 - DNA, 300 bp, Zea mays
  Clone ID: cC-zmle18900025g11d1
cccacgcgtgcgaggctacctagccatatccttttccccagtttctggtcttcagcagttcctattctcagttggtccgcgcgtgccgtcgacgacgccgccatcatggcttctattactttaccgagccaagatgaatgtattaaatctcatgaagatggccggagctgtgcgctccggagggtagggttcagtgtgcttgatgatgaaggcagttcacaagacttcaacctcagatgacaaaccgcttcaaagctcctctaaaagagttggagagaacagggtttctggggatgaatg

SEQ ID NO: 20241 - DNA, 53 bp, Zea mays
  Clone ID: cC-zmle18900025g12d1
aaaaaaaataaaaaaaacgcatacagagaagaagccaaatgatatgcatgtgg

SEQ ID NO: 20242 - DNA, 469 bp, Zea mays
  Clone ID: cC-zmle18900025h01d1
caatcattgtgtcgacaaatgattggttacttattcctagggccttgcacttctgtttccagcgggtatgccattcaaagaatctttagataaaacaaaccccctcaaatgtcttgttccaaaacaactttacaggaaagaccgtaagctaagcagtataatcattgtgtcgacaaatgttccacgtctgcaggctggtgtatacataaaacatactccacattatacattacatgggcggctcacggtgcccttcaacatagtagaggatgaatgtccaagttcctcctggacagtgttctgtgtagggtagtggttttgatagaggattgcatatctagttggtatgttggtgatcacctttgttttgttttttaggaaccaagcctactacatgcattattgtctgtacccaaatgccaagttcagtgatctcctacgggattgagtggtgcgggcattttctaat

SEQ ID NO: 20243 - DNA, 340 bp, Zea mays
  Clone ID: cC-zmle18900025h02d1
cccacgcgtccgcggacgcgtgggtcttcctggcgccggcgtcgctgacgagactgaaggaagaggaagagcaaggacgacggactgcgatgggccactccaacgcagtggaactcgcaccctaagaactacggccctggctcgcgtgtctggcggctctgcgcgaacccctacggactgatcaggaaggacgggctcatgtgctgtaagcagcgcttgcgcaggaacaccgaggacatcggtttcatcatgtacggatggagaggccactgtgctgctgtggagaactgtctacatcatagcaaggggtcccataatgcaaggcctaatgaaggcgctt

SEQ ID NO: 20244 - DNA, 388 bp, Zea mays
  Clone ID: cC-zmle18900025h03d1
cccacgcgtccgcggacgcgtgggtctacctcgcgccggcgtttctgacgagactgaaggaagaggccgagcagggagcacgacgcgatgaggctcactccaacgcgtggaactcgcactctgagagactaccgccctggctcccgtgactggcggctccgcgctaccccccacggactgatcaggaagtacaggctcatgtgctgtaggcaacgcttgcgtaggaacaccgaggacatcggtctcatcaagtaccgatggagaggccactgtgcttctgtggagaactgcctacatcatagaaatgggtccctcaatacaaggcctaattaatgcgctttagcttgctgtttgagaccttgagactcatgtgtgaaactcgacttga

SEQ ID NO: 20245 - DNA, 319 bp, Zea mays
  Clone ID: cC-zmle18900025h04d1
gacacgcttagcctctggcacctccttctacaggactgcttttctcacatgccttaccaaaaagggtccgtaggaggagactgaatccaccaccctcacatagaggctccgactaacataacagttcctcagtcccctttaagcgcattagtcacactgcgatctatagcctattccagaccagagtcgtgatactccacatacatcaagacatatgctatcctcccactccctactctaatctactaattactcacatgcatgctgattactttgtgagtaacgcatgtctaacaccttacatgctatattttaactg

SEQ ID NO: 20246 - DNA, 93 bp, Zea mays
  Clone ID: cC-zmle18900025h05d1
gaccggctcggcctctgtgagtacttgcgactggactgcttttactagatgccccgccacgacgggtccgtgggaggacaccgaaaccgcccc

SEQ ID NO: 20247 - DNA, 351 bp, Zea mays
  Clone ID: cC-zmle18900025h06d1
gaccggcaccgcgtcttagagttcttgtcgctcgcctgcttttacgacatgccccgcaacaacgggtccgtgggatctgaccaaatccacccactctacatggatgatctgactaacatgaccgggatggagtaccttttgagcgaagtgatggaaactcacctatttgttatccgcaagcagaaatgggatagctccagataaataaagacctatgctcgcttactacatcctagactgatccatttaccaggcacctcagctctgaaacgtctttgacttacacttgaggagggatatacatgctatattagaagccgttaccatatcatgttcgaagtttgagaagat

SEQ ID NO: 20248 - DNA, 332 bp, Zea mays
  Clone ID: cC-zmle18900025h07d1
gcccggctctgcgtcttcgagttctttttgctctcctgctttttcgacatgacctgcaacaacgggtgcgtgggagcttaccgcatccacccccctgacatgtatgatctgacgaacatgaccgggctggagtgcctctgcgagcgcagcgatggaaacttacctatctgtgatccggtagcagattcggaacagcccagaaacatctagacggatgctctcctactacatcctacactgatccatctaccaggcacaagaggtatgatacctcgcccactgacgcatgagtagggctgtgcattatatatttgaaccctgaaccatgtcat

SEQ ID NO: 20249 - DNA, 386 bp, Zea mays
  Clone ID: cC-zmle18900025h08d1
gcccggctccgcgtcgtagagttgttttcgctcgcctgcttatcctagatgacctgcaacaacgcgtccgtgggatctgcccgcatccacccaccggacatatatcaactgactaacatgaccggatctgagaacctctcgagcgcagtgatggaaactcacctctcagggacgcgctagcagacacgggaaagcccatagaaacaaagacggatgctcgcctacgacatcctagacagatccacctaccaggcacatacgatatgaaagctctcctgctggcgcatcggaacgactataccttatatattagacccgttaaccatatcatgatacaagttggagaagattgacaacgaggaaaccgagcccgctgcagaagcgct

SEQ ID NO: 20250 - DNA, 307 bp, Zea mays
  Clone ID: cC-zmle18900025h09a1
aactcaccaaaagaaaacaatcaggtgctgaggcgctttattgaacatccccaacttcgtcttaatacatgcacatcccgcccacgccttaattattaaaaaatctattctaacccggtggaccgccttccacagtatattgcttgttcctgcccaccctcaaatgacatttattggtgggaaccgccgcctattgtgtccagacatcttcttagccgacagtaggtatgaacgcgtgacacataacggttgagatagatccggaagcacatcggccccggcgcaaattgagattccacccttcaat

SEQ ID NO: 20251 - DNA, 319 bp, Zea mays
  Clone ID: cC-zmle18900025h10a1
cttgtaactcaccaaaagaaaacaaccaggggctgattcgcgtaatgaaacatgcctgaaatcgtcttaatacatccccatcccacccacgcctcattgattgaaacagcgaacctaaacagctggaccaccatccaccgtacatcgcgtatccctgcccatcccaaaataacatttatgggtgggagcctcggcctattatgtacatacatcttctgagccgcacgtaggtatgaacgggatacacatagcggtgcggatacacccggaagtacatgggtagcggcccagattgagattccagcttccaataacctac

SEQ ID NO: 20252 - DNA, 54 bp, Zea mays
  Clone ID: cC-zmle18900025h10d1
gccaagctctaagccaaacacctggctttgccaccatcacattgtccggttcta

SEQ ID NO: 20253 - DNA, 383 bp, Zea mays
  Clone ID: cC-zmle18900025h11a1
tttttgtgttttttatttgtatctcaccataagaaaacaaccggaggctgatttgcgtgaggaaacatgccgggaattgtcttaatacatctacataccacccacaccttaatgcttgaaaaagcgaacctaagaagctggaccaccatcatccttacatagacgatacttgcccctcctcaaataacatttattggtgtgagcatcgggttattatgtaccgacaacttctgagccaccggtagatacgaacggtctacacatggcggtggggatacatccggcagagcatgggtagcgccccatattgggatttcacctttcaatagcgtacccgtgaaaagaggtgacctgaggggtatgttacccgattacaaacaccg

SEQ ID NO: 20254 - DNA, 232 bp, Zea mays
  Clone ID: cC-zmle18900025h12a1
gatacaaattgattggctgcatcatacctggaggccaaatattttaaccttcattccctgtaggtgtccataaacaattacttaagacgacgtgtttattaatttatgattcaagacgaaaagagtggagggcacacgtcctttatgcatttatacacgactttattatatgtacagcacagcacttgttcacactatttctgaccactgctaaaccgcggacgcctgggta

SEQ ID NO: 20255 - DNA, 221 bp, Zea mays
  Clone ID: cC-zmle18900025h12d1
cggattagcagtggtcagaaattgggtgaacaagtgctgtgctgtacatataataatgtcgtgtataaatgcgtgaaggacccgtgccctgcattcttttcgtcttgtatcataaattcataaacacgtcgtcttaagtaattgtttatggacacctataggggatgaaggttaaaatattcggtcttgaggcatgatgcattcaattaatttgtctccac

SEQ ID NO: 20256 - DNA, 474 bp, Zea mays
  Clone ID: cC-zmle18900026a01a1
attacaagttgatcccgttcatagcatatcggtggttccgtacgtgaatggcaacggaactttatctttaatacacacaggaattcacaccacaccacacacacgagttactaaaagccataatccaactactacatgtttacaagcttacataatctgtatcatctttgcatcttggggcggtatatatatggtttttcttgtctccagtccgacggtatatatttgattccaacgtgtatttttgcccagaagaagaaaataaagaacagcctgcagacgctgaaaacacccaacccagcattcttctattctttggtcaataacctggccagtccaatcaccaatctgatcctgagctgcaaacagatccagacgctaccagctactatacggaggaaacagttctgctgatgcacacaggccgcttagggcaatggatgagctggattacccaagagtcaacatcgaaaa

SEQ ID NO: 20257 - DNA, 384 bp, Zea mays
  Clone ID: cC-zmle18900026a01d1
gaagaaccaggaagccgttgatctggtgaagtcaaccaaggacccgtaaacagcggcgaagcgactgacgtccgaggccctgggaaggatgagcaaggacgatatctcatgcattgtcatccgttttcgatgctgactcttgggtaatccagctcatccattgccctaagctgtctgtgtgcatcagtagaactgtttcctccggatcgtatctggtaacgcctggatctgtttgcagctcaagatcagattggtgattggactggacaggttattgactcatagaatagactaatgctgggttgggtgatttcagcgtctgcaagctgtactttatggtgtacttctgagcgtatatacccgttggaatcaacaatataccgt

SEQ ID NO: 20258 - DNA, 356 bp, Zea mays
  Clone ID: cC-zmle18900026a02a1
aaaccaaaaaaacctcccaaaattggggggtcaaaaaaaaaaaaaaaaggggggggggcccttttccttaccaaagactgggcttttcccacactacctaatttgtctttttccccgtgtccctcccttggtttggtttaacgtccaaccccgtgaccgatttttctatcctgggggacggacggacggaaaaaccactttggggggacgaggggcccatttttttttccgggggccggcccttgaaacttgccggggtttcaagcggtccttccaacaaacaaactttgtcccccagcggcgctttttttttaaacgccccctttttttttttaccaaccccgcccaccggtttt

SEQ ID NO: 20259 - DNA, 379 bp, Zea mays
  Clone ID: cC-zmle18900026a02d1
ggcgcagcagccgccgtcgttctcgagccggtgcgcggggctggtgaaggagcagcgggcgcgcttctacatcatgcgccgctgcgtgaccatgctcgtctgctggaaggaccgctcgtagccgcggctagcttccagggccggccgccggcgaagaagctgggcccctcgtcctcccatcgtcgtttctccgtccgtccgtccgccaggatcggagagtcggtcacggggctggacgctgaagcaagccgagggagggacacggggaagaaggcagattaggtgatgtgtgtatagctcagtctttggttaggacgagtgctcccttcccttttttttttttttttgacctcccatttctgggacgttttcttggttt

SEQ ID NO: 20260 - DNA, 398 bp, Zea mays
  Clone ID: cC-zmle18900026a03a1
ggacacaggggcaaattatcgtattttttttattgccaacacacacaaaaaaaagggttaacatttttttattggtttacaaccccattcaaggggaaaaaagaatgggcagagcatgaatgtcattgctttgcttccatttccatgctcctgccttgggccattagataacccccaaactcattggctctatactagctacatcccaatgcaaagccgtaagtgcatccacggaatagccaacaaaaggaagccgaaaaaaatccccaaaaagatgttttgaaaagggaaaaaagaaaagataaatgagagcttcactcaaaatctcgatccgcgcccatttcaggactactagtcactcgcgccatacttttactgggagtgtgaggctgcaaaaa

SEQ ID NO: 20261 - DNA, 601 bp, Zea mays
  Clone ID: cC-zmle18900026a03d1
cgtgtacagcatcctgaagaagataggccgggacaaagtaccaagcggtggcggtaaaatgccgaggaccgtagttgccttggacggtgggctctacgaacactacaagaagttcagcagttgcgtagaagcgactctcacagacttgctcggcgaggaggcttcttcctccgtggtcgccaagctggccaacgacggctctggcattggagctgcgcttctcgcagcctcacactcccagtatcagtatggcgcgagtgactagtagtcctgaaatgggcgcggatcgagattttgagtgtagctctcatttatcttttcttttttcccttttcaaaacatctttttggggatttttttcggcttccttttgttggctattccgtggatgcacttacggctctgcattgggatgtagctagtatagagccaatgagtttggaggttatctaatggcacaaggcaggagcatggaaatggaagcagagcaatgacattcatgctctgcccattcttttttcccttgatgggggtgaaaccaataaaaaatgttaccctttttttgtgtgtgtggcaataagagatacataattgacatgtg

SEQ ID NO: 20262 - DNA, 500 bp, Zea mays
  Clone ID: cC-zmle18900026a04a1
gcccacgcgtccgggatgaaccaaaattcaaaccatttactggttttggaaagcggttggatggaaaagcctcaaaactgcaagcatcagaggttccttccactgcactttctgcaccttcagattcaaacaaaagagcaaatcagcaaatctcagcacccgcagcttcaggagctagcaattacagtcgacagaaaactgggaaacttgtttttggttcaagtgcaagcaacaataaggaaccacaaaaggctcctgctaaagaggagcaacccgcaaagaaggacgacgagctgaggttccaagcgttcagcgggaagagctactcattgaaacgttagctgcttcagttaaccttcaaattcgccgctactctttcgtttcgtgcatggtgggtgttctggcacctggtcaccaccatgtagatatgaattgaagtatgtatatgcttatcttgatggaaacatgacagtctgtttatttaagcccaaaagtttaaa

SEQ ID NO: 20263 - DNA, 273 bp, Zea mays
  Clone ID: cC-zmle18900026a04d1
ggataaaaacttttgggcttaaataaacagactgtcctggtttcctcaaaaaaagcatatacatccttcaattcataaccaccggggggggaccagggggcaaaacaccccccttgcaccaaacgaaagagttgcggccgaaattgaagggtaattgaagcaccttatcgtataaagggattgtctttcccctgaacgcttgggaccattacgcgtgtgcctttttttgggggagtggtcctttttaaccaggacccttttgtgggttctttt

SEQ ID NO: 20264 - DNA, 389 bp, Zea mays
  Clone ID: cC-zmle18900026a05a1
tttttgaacgggcaatggagtttttttattttcctaggccaaatacatatgacacaaacagtataattatacaagtacttcactctcttagctggggatgcaaaaacaaagggtctttttagatggacgaggttttaggccaaccaattccgaaggggcaaactgttgtaaaacactggaggggcaccacaaccaaacaacaggtcaaacataacaggatgaaaaaaaggggggcatcacggcatcagacacgagcagcattttcagcagattcctcccccctggctgtctaattatctagggaacctggggcgcaacaaacgatctgagcacgactgatgatacgcattgcctcgctgctggcaaatagcatacacgatttccccact

SEQ ID NO: 20265 - DNA, 506 bp, Zea mays
  Clone ID: cC-zmle18900026a06a1
aaatccgacccgggggcccccccggaaaaaccggccccgaccccggagggggccccactttccccaaagggggggaaaaaaaaggcgggggaaaaaaggggaaaaaggggcccccggggaaaaaaggaaaccccacaaaaaccccaaaaaaaaacaagcccgaaaaaaaaaagggaaaaccggggggccccaaaggggggccccacccccaattaggggggggaaacaaaagccccctttccaaggagaaaaaccgggcgcccccccaaaaaaaaaaaacgcccccccccccggagaggggggtttgttatttggccccccagggggattttttttccccaagagaccgcgccccaggggaggggccaaaacggggggcccccaaaaaaatgctaacaacggaccacacccggttcccccccaagagggaaaccctcgggggaggggcacacggggggaaaaaaaaaagcggcttgggtttgcctcccccacccaaaaatcccccc

SEQ ID NO: 20266 - DNA, 201 bp, Zea mays
  Clone ID: cC-zmle18900026a06d1
aaaaaaaaaaaaaaaaaaaaaaaaaaaaaaaaaaaataaaaaataaaaaaaaaaaaaaaaaaaataaagaaaaaagggaaaaaaaaataataaaaaaaaaaggggcggccctcttaagggacccaattttccttccccttttcttctagtgcctagctctttttttggggtccctaaaataaatctcctcgggggtgtgtt

SEQ ID NO: 20267 - DNA, 569 bp, Zea mays
  Clone ID: cC-zmle18900026a07d1
gtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagatttcacaaaagacagaaaccaatccactatttgttttacgtcaagcaatacgtacagtaacttccaa

SEQ ID NO: 20268 - DNA, 333 bp, Zea mays
  Clone ID: cC-zmle18900026a08d1
agcaactagaacagcatgcaaagcactgtcgtccattgatgcatggacattcagcagtcggcgcctccgcaatcaggcgttcgcaccaactaatccagccttttgagctgttgactgtccaatatggccccctgtacatgattacccaatcaacactctggggatgcggacaaggtgctaaaatcagctgatcatggtttttttctttatttctattgtgtacacgtacaatcccaaccaacgttttccccttgttcccatctgattataggcttgtgtatactgtggggttaaatgattaataaattctggtgttagctaatcaccagcggg

SEQ ID NO: 20269 - DNA, 431 bp, Zea mays
  Clone ID: cC-zmle18900026a09d1
acccgtccgccaaaacgcacaggttgcctaatccaaaccggccgacaatttttccgctctctgatcctcaccccatgtcctgtgacggtataggtgtactttcgattatacgctgttcccctacgcgtctggctttgatgcactgaaatcctgtgctgagatcaattagtcttgcgcagtagcgcggtacaccgtgctacaggccatggttagccaacagtaagcaaaaggcacaatcctgtgagccaatcaacactcactatgactcttggagacatgggcattgatttatataactctgataacatttttgttgcctattttgacaggattacatgatgagcgctcttgaatttactctgattgatatatgtgatccagtgaacaccatgtataatttataaacatttcaaattttgtaacgtttgaat

SEQ ID NO: 20270 - DNA, 309 bp, Zea mays
  Clone ID: cC-zmle18900026a10d1
cgggtcgtctcacgcgtccgcatggacatggacccagatgttagcctgcctcaactgaaacaacatggtttccagacattagccgctcttgtgttatcacaatggctgtgactgtgagtatctttacagttatgctcgttatatccctgtggtgtacctgtttcgatcgtcttcgaccaaatgtcacgtcgactgcagtctccagttgttaatacagtctgttcagcacgctgatttaagtatttgggtcaagatgttcatatataaaaaaataaaaaaaaattacattaatctcgttgtaaaaatata

SEQ ID NO: 20271 - DNA, 297 bp, Zea mays
  Clone ID: cC-zmle18900026a11d1
ggccgtcccatctacgtctaaactacttttgggtttgttcctagccatttttttctaggcaacatcggttgttgtttgggtacaatactctgaatacatgaaacgtgacgcaagcagtttgatctatttccagcgtactcatagtagtaccgttgtcagcatattgctcttgttgtaatatggcatatgttccatgtgtttgcaattattttaagaattgaagtagagaacgtctggtgcatggacaaggtcgtgtactttttctactattgtatgagggcgtttctacctggctac

SEQ ID NO: 20272 - DNA, 266 bp, Zea mays
  Clone ID: cC-zmle18900026a12d1
ggaatttccgggccgacccacgcgttcgagaatctgagggccttaacatattgcaggagtttgtcaagtcgcactagatgtgtgacatgtttcagggatactcttgatttggacctgggcttaaaattatgctttagcatctggggcttgcctaggagattagaacattttactagaagagccgaataggatatgtatgaacaatttggacatctgaatatcttttgtcttaaactatacactcttgatcactattttctataagg

SEQ ID NO: 20273 - DNA, 504 bp, Zea mays
  Clone ID: cC-zmle18900026b01a1
cacgcataaacatgcacacgagtagtctcgcgattcagagtgggttgtacagtggaggcgccagttcaaaatcagacgacaggcaaacaaaataaggaaaaacgatccatcaaaaaaacgaggaaaaacaaaccatgaaaaaaaaattagaaccttcgcatgttacagtgatgaccataacacggtaattaggtggtcacgaccgctggccaacaagcacacctcacccggccaacgaaagcagcacatgactcagcatagaacacggtaatgacaatgggaagtctcctgcctgtaccaagctaagtaaaggtggagatatgctttagcccacaatgctgttgcttgtgtgacactgatcacttcataggcacacgatagtgatctagaacagcgcacgcaccgaagagaaaatggttctcttaacattcatgattcatagctccttgagaaagtcaggcatctgacggtgctgtagcgtcaatagtggctgcccgtggttgc

SEQ ID NO: 20274 - DNA, 353 bp, Zea mays
  Clone ID: cC-zmle18900026b01d1
tgggttgacccacgcgttcggaaaacatgttgctgttaaaaagcttgtcgctttaacagaccctgaacttgataatgagttcttgacacaggtgtccattgccttaaaactaatacatgataattctgtggagatgcttggatattgtgtggaacgaaatctgcgtttaggggactatgaatttgcgacaatgggttctctgcatgatatcttgcatggaagaaagggtgatccatgtgcacagtctggcccagcacttgattggatgcagcgggttaagattgctattgatgctgctaaagggctagagtatcttcatgaaaaggtgcagccttcaatagtccaccgggaca

SEQ ID NO: 20275 - DNA, 148 bp, Zea mays
  Clone ID: cC-zmle18900026b02a1
acccttcgccctttatttttttgttttttttttacatacaaacgaataccaagaaacgggggctgttttagccaccaaacacgcggcgaacccgctttatggttgcaaaacatcaaacccagaaagagaaagagaggatctttgcccc

SEQ ID NO: 20276 - DNA, 82 bp, Zea mays
  Clone ID: cC-zmle18900026b03a1
gtttatgcacattaccaagcctggatcctctatagcggccacccttcttccttttttttacttttctattttttcctccaca

SEQ ID NO: 20277 - DNA, 147 bp, Zea mays
  Clone ID: cC-zmle18900026b04d1
aaaaaaaaaaaaaaaaaaaaaaaaaaaaaaaaaggtttgccgttccagaaggatcctatcttacatttcgggtgcaggcaacattaacctctacttcattggatggcctttgttgaatacactggccgtgagacaccacctctcgaa

SEQ ID NO: 20278 - DNA, 402 bp, Zea mays
  Clone ID: cC-zmle18900026b06a1
aaccgctaaagacgggcccgaattggcattacccatctgaaattattttctgaacaacgaagaatttgcagccaagaaacgaaagaatgccgtcacttgtcacagatcaagtggcgatgaacatcagtactacaatggaacttcaatcatgcctgctgctacttctgcactacaccactagaacaagatattagcagaactttttttgttggtgttggtggttccatgaaaaaaatctgaactatacacagtttgcgttgcgctgcatccggtcgtccccggagtcgccgaaggatctcagaagaaggggaagccgccgtccggctccatcttggcggccatcggcgagacgagcatggagccgtaaaaatcggcggcgtcccccggcatctgcaggtcgtc

SEQ ID NO: 20279 - DNA, 327 bp, Zea mays
  Clone ID: cC-zmle18900026b06d1
gattttgattctcctgcagctggatgactgggtgctgtgccgcctgtacaacaagaagaactagtgggagaagatgcatctccataaggagaaggagaaggagaagaaggcgatggagtctgaggcgtcgctcttgcacttccactccgacacgcggacgccggagtcggagatcgacgacgacacgttcccggagctgggctccctgtcggcgttcgacgacatgggcccagccccagcagcagcagccactgtcggggtctgttctgcccaaggaggaggtggaggaccttcgtgaccttcgtggcgactactggctttcgggca

SEQ ID NO: 20280 - DNA, 512 bp, Zea mays
  Clone ID: cC-zmle18900026b09d1
ccgggtcgtctcacgcgttcgacccatctaccagcgactcagcgagcgagagcagcacacacgcagctagttaggagcagcagcagcggcggcggcgatggcggcctccatgatctcctcgtcagctctggcggtggcgcctcagggcctgccgtccctcggccgtcgcgccttctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcga

SEQ ID NO: 20281 - DNA, 535 bp, Zea mays
  Clone ID: cC-zmle18900026b10d1
cccacgcgtccgggctcgggttcaggaggtacgactacgccttcagcggcagcggcaggctgaggtgctttgggcactccgggatgggcggctcgaccgggttctgtgactgtggagaacggcttctccatcgcggtgacggtgaacaagctgtctttgggcagcgtcacgcgcggcgtcgaccggctcgtcctcgaggagctgggcctgcccgtgccggacgagtactcggccaccggggagaaggggcctgacatgatgctcaacctgacgacaacgacgacgactacgccgccgcatctgagatgacgacggcgaaactgagattaccaggttgggttcgtaataatctgtggaacaagatatatagcgagcagatggaaggtggggtacagggatttggtggacagtatatatacgcgtgccattttgattttgacgtggcatgtaaaactcggcaaattctggtatatacgaagctgggtgctggaataatggccagcagtacaagaaatggacatgctagtttgttgaa

SEQ ID NO: 20282 - DNA, 562 bp, Zea mays
  unsure at all n locations
  Clone ID: cC-zmle18900026b11d1
caaagaagagcgagaagcccaaggacgccggtaaggcggcggagccagccgccgtgacgacggagaggtcgctgtctgcgccgccggcgccggcgccaatgcccgcgtacgagcaggagttccgccacccatactacgccccgcagccggtggtgagctaccacgcgtcgcagccgagctcgagcgtgtcgtacacgtacttcgcgccgcagacgcagccggcgtactccatgcaacaggcacagccgcacccacaggccgcggcctcctactccgtgcagccgacaccgccggtgtactactccgcgcaggagctgcagccgcagcagccggcgaagcagtggtcgccgtcgtacctgtacatgccgtacccgcacgcgcaggcggcgccggagccttactaccagcagcaggactactacagcccggccgggacgcacgcgtcggcgatgcacgacccgtaccgtatcttcgacgacgagaaccccaactnctgcagcgtcatgtgagaggcgagctggtctgcgcgggccggacgctcgcggccgccgggacagcgagt

SEQ ID NO: 20283 - DNA, 584 bp, Zea mays
  Clone ID: cC-zmle18900026b12d1
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatatattaattggtccacgatgatatgatttgatactatatatat

SEQ ID NO: 20284 - DNA, 416 bp, Zea mays
  Clone ID: cC-zmle18900026c01a1
ggagtaactttggcttctataggaacacaacttgaagaaccaaccagctatagcgggtccagggtacaaccgtacaagcatatttcctcaagccgagcacaagcgcccgaggattttttacatctacagacgtcctccaatatgaaaacacgaaacatggaatactagcagcgccgtccaacttttaagaatcctgcaaaaaacaaactgtaatgaagaatggtcaaccagttcctcttccttccccggatccaatccaatggagcacctcagacgaattaagcgaccgcgggcatgtccttaagccaggcgtcgagcggcttgccgatggagtagacgatgaagccgatctccctcagcttctccgggtcgacgatgttgcggccgtcgaagacgaaggcgggcttctgcatgtt

SEQ ID NO: 20285 - DNA, 536 bp, Zea mays
  Clone ID: cC-zmle18900026c01d1
ggttcgtgaaccgcgtcgtggcctccatgttcaacaccgtcgccggcaagaagatcgccgtcctcggcttcgccttcaagaaagacaccggtgacaccagggagaccccggccattgacgtctgcaagggcctgctgggcgacaaggcccagatcagcatctacgacccccaggtgacggaggaccagatccagcgggacctggccatgaacaagttcgactgggaccacccgatgcacctgcaaccgacgagccccacggccattaagcaggtgagctgcgtgtgggacgcgtacgaggccaccaagggcgcccacggggtgtgcatcctgaccgagtgggacgagttcaagaccctggactaccagaagatcttcgacaacatgcagaagcccgccttcgtcttcgacggccgcaacatcgtcgacccggagaagctgagggagatcggctttatcgtctactccatcggcaagccgttcgacgcctggcttaaggacatgcccgccgtcgcttaattcgtctgaggtgctcca

SEQ ID NO: 20286 - DNA, 537 bp, Zea mays
  Clone ID: cC-zmle18900026c02a1
tttttgcagaaattgaggtgttcatcaatatattccgaatgaggcgacagttggaccaaaataactcctaagtgctgctaattcattttcttgtcgatgctggaaacatagaagaacaaaggctcgacactcaaacaagtcagaaacaacacattcctcttaactgcagcaactccattcgctaactaaatgaagagggccgactgctgcacagcgagatacaagcgcaggcagagtccttcggtgaaatgcaagggggataatctaccgagcaaagcccagattcttcatagggccatgcgtcctgccagccgactttctgatattcttcgatcaattgctgcgtcaacagagttcatctgctcatacaaattgtgaaataaaaaacttggtgttagatatggttgctgcctccaaaacaatgagtcgagcagcatctcaggcttactggccaaatgaaagctgacctggagcaagactcttgtcacattctcgaccaaacttaagctacaataaatgctaccgtattggcagaac

SEQ ID NO: 20287 - DNA, 446 bp, Zea mays
  Clone ID: cC-zmle18900026c02d1
agcaaaactaggtggctgaggttctgccaatacggtatgcatttattgtagcttaagtttggtcgagaatgtgacaagagtcttgctccaggtcagctttcatttggccagtgagcctgagatgctgctcgactcattgttttggaggcagcaaccatatctaacaccaagttttttatttcacaatttgtatgagcagatgaactctgttgacgcagcaattgatcgaagaatatcacaaagtcggctggcaggacgcatggccctatgaagaatctgggctttgctcggtagattatcccccttgcatttcaccgaaggactctgcctgcgcttgtatctcgctgtgcagcagtcggccctcttcatttagttagcgaatggagttgcttgccgttaacaggaatgtgttgtttctgacttgtttgagtgtccagcctttgttc

SEQ ID NO: 20288 - DNA, 220 bp, Zea mays
  Clone ID: cC-zmle18900026c03a1
aaataattggggttttgtttttttttatttatcttttctttactctatttaatacatccccatacatcctaccccttaatgaattacacatctaatctaaccaaccaaaacgacctccaaaaaacaacacctaatactcccccccccaaaaaaacattaatttgggtgaaacaaaaaccaattatttaacaacaaatacacaaccacacctccctatgaa

SEQ ID NO: 20289 - DNA, 554 bp, Zea mays
  Clone ID: cC-zmle18900026c03d1
cccacgcgtccgcccacgcgtccgcggacgcgtggtcttcaaccctacaggctccaacaagcaatcggaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctctgcttatttccagcagcaaatactactaccatttggccagctagctacaacaagccccgcttacttcttgacacaacaacaattgcttccgttctaccaacagtttgtggctaaccccgcaacccttttacaactgcaacagatgctgccctttgtccaacttgctttgac

SEQ ID NO: 20290 - DNA, 503 bp, Zea mays
  Clone ID: cC-zmle18900026c04a1
tttttagattccacttttttttcttaacaaacagagtaacactcatatatgagcagtggcgtatcaagtaactcatagagacacatactgatcgcatactcgaaactacccgagaacacgcacacactactcacagctttgggcacctatactgaccacatattaaacactacccacacaaactccgctctggaaactatactgaccgctcggctccctccggggaaaatccccggtgcaacatcaggttccatcaacacgggaaaatccacacgcgacaggaggcgccgccaccacgctacgcgctgtttatatttcatactttcttcaataacaaggattcatgttcggaatgacttacaggaagaaacaccagaggctgggaagcaatagcagacaagaacacgttacatcaatgtaaacgtcggctttacatgtgcaattattaaccagccagatttcaagtacaacaaatacaggtcttttaacagctgatccttaat

SEQ ID NO: 20291 - DNA, 447 bp, Zea mays
  Clone ID: cC-zmle18900026c04d1
cggacgcgtgggcggacgcgtgggcggacgcgtgggcggacgcgtgggcggacgcgtggggagtcaattctctcaccgaggtcctggtgcccgaggggattcgcgaccccatcccaattcacaacgcatcgtcgtctcccacaacacgctccactaaccctagcgacagcctcgggtcgtcgtttgatccccgcggggagctctagttccgccaagcgtgcgtaccggcgttcggatccgggaccgaagatgacggagtccctggtgcggaacaagccggggatggccagcatcaaggagatgccggtggtgcatgactggccgccgccgggcggtttcgcgcccgtgcgctttgcccgccggatccccaccttggggcccagcgccaccgccatctttctcaccaccttcggtgcttttccatatggtatgtaccaggtcggccag

SEQ ID NO: 20292 - DNA, 456 bp, Zea mays
  Clone ID: cC-zmle18900026c05a1
ttttgtaaggaagaaaaacagtaaataatcggaggcaaacactgcgtagtctacatggtgatgattagctgagctgaaagagagagggacacgtggggataccaaaccctaccatcaacctcacaccgtcacatgtgatggaagatgctgtctgagatcctcatgactttgactgatgccgtctgagggtatcctcattattgatgctgtcttgtctgggggggccgagagacgcagcacgcgagtacgcgacgcaacgcaaccgaactaaaagctaagcatagaggtcgatgccccagaacttggcaggctggttagtccggtacttccggtcgatggccttcatcctctccatgttctcgccggagatgtcgaaaccgaagacgtcaaagttctcctgcagcctctccaccttggaggtcttggggaacaccaccgtgttccgttgcaaacccc

SEQ ID NO: 20293 - DNA, 209 bp, Zea mays
  Clone ID: cC-zmle18900026c05d1
gaatttccgggtcgacccacgcgttcgtccactcgttcgtccacgcgttcggccaacgaggtgtagtaatcagccaatctagcatcagcgcgcggggtctgagagcatagcggctggtctccatggcggtatctgtggcgctgagcagcgggcaccggatgccggcggcggcgctagtcgtttggcggatggataaagcggacatcctt

SEQ ID NO: 20294 - DNA, 439 bp, Zea mays
  Clone ID: cC-zmle18900026c06a1
acctttatttatttatttttatttttttttttttatttttaaaaaggaagggggtgggatgggaaataaaaatgagtcacacgcgatgggatgtaaactaaaaattgggtacaaaaaaaatatttttagttaaaaggcaacaccaacaaaggtgtgggggaaaaaaaaaggggggaattagaagggccatggggttgaacatgaaggggaacggggggggaaaaaaaaaaggaaaaagggggttccaaggacatggggggaacataatttgcgaaattaggctcggaaggacaattggggaaaacatgctggggataaaaaagggggacataaaagttaggggtaatattgggggggaaaaaaactgggatgggtggaaggggataggtaaaaatttgggtgggaatagggagggataccctattatcagggaagaccc

SEQ ID NO: 20295 - DNA, 78 bp, Zea mays
  Clone ID: cC-zmle18900026c07d1
aaaaaaaaaaaaaaaaaaaaatttaattaaaaataaataaaaaattaaaaattataaaaaaaaaaaataaaataaaga

SEQ ID NO: 20296 - DNA, 473 bp, Zea mays
  Clone ID: cC-zmle18900026c08d1
cccaaaccctacccatacccccgccgccgccgtcgccatgccttccaagctcgacccgtcgcatgtggtggaggtcttcgtgcgggtgactggcggcgaggtcgtcgcggcgtcttccctggcgcccaagatcggcccgctcggtctctccccgtagaagatcggcgaggacattgccaaggtgacggccatggtctggtagggcctgcgcgtgaccgtcaagctcactgttcagaaccgtctggccaaggtctccgtcggtccctccgtcgtcgtgctcgtcatcaaggcgctcaaggagcccgagagggacaggaagaaggttatgaacatcaagcacatgcggtaacatcggccttgacgacgtcgtcgagatcgccatgaccatgaggaacaggtccatggccaatgagttggccggtacccgtcaagagatccttcgcacctgcgttagcgttgggtgcaccgtcgac

SEQ ID NO: 20297 - DNA, 164 bp, Zea mays
  Clone ID: cC-zmle18900026c09d1
cacgcgtccggctcttcactattcattgtggaagcacatgtattattagtacatgaacttttctttgataaaaaataatacaaaaaatagggaaaatttatataattcaacataatattcttctcccattaaatatatctactttcaaatttacggcccgccct

SEQ ID NO: 20298 - DNA, 333 bp, Zea mays
  Clone ID: cC-zmle18900026c10d1
gttcgtcacaataggtatcagtgttccacacataccgtgggttgtttcccatatagttatcatgaaaccgcttcggggttgaaaattctagtctcgcgaacacctctgcgctgtgtaaagtcttctatatctggttgctcgccccacaggagtagtttgtattaggttgctgtactgtagcctctattctcgtggataggcatcccatttgtccctttggtacgaaaagtaagcaacggcctcttgtgccggtaaacaatcaatgaatggttacttgagtaaaacacccatggtgtattggacaagcagttaggaatcttaatttcttggcgt

SEQ ID NO: 20299 - DNA, 580 bp, Zea mays
  Clone ID: cC-zmle18900026c11d1
tggaattaccgggttgacccacgcgttcgtgttcttgggcgatcgctgtcacagccctgatccgaatcgttgtccttgcgagcctcgccgatccggcactctcctaccctcggttcaagatgcacatctttgtgaagacccttaccggctaagactattaccctcgaagtggagttttctgacaccattgacaatgttaaggctatgatccaaggacaaggagggcattcctcctgaccagagcgggtttcttcacgggagcagattgtggactggcgcacacttgctgactacaacatccacaaggagtcaaccctccacttggtgctgcgccttaggggaggcatgcagatctttgtcaagaccttgactgggaagacaattacccttgaggtggagtcctcagaacaccattgacaatgttaaggcaaagatccaggacaaggagtggattccacctgaccagtaacgtctaatctttgtcggaaagctgctggaggatgtgaggaccctcgctggctcctcatcctgatcgagagcaccctctccttgggctgcttttaagggtggttacaaattt

SEQ ID NO: 20300 - DNA, 493 bp, Zea mays
  Clone ID: cC-zmle18900026d01a1
ggcatggaagaaagtagacagcaactgtaacattgataccagggttcagacatgcaagtcaccctactaggagtataatgtcgagacattctattagcaatggcatgaatattacgatcaacaagcaaccaataaacgtcaactgcttttatccgccatccatttccagcttctccaaggctgatctggccctaacccttgaagaataaccagccttcacagtccttattcatcgtcatcttcatcctcattttcatcaattcctacccagcgagtgaaggcaaacaggaactccttgaatgtcaccattccgttcttgtcccagtccatttcctcaaatcttttcatggctataggcccagaagagcgctctcctgtcgaggtctcgtttattgcttggatcatctcatccttgctcacatacccatctttattcttatccaagaagacaaacgcatcaaccaaggtctcgaaggttgcctcaagatttcct

SEQ ID NO: 20301 - DNA, 335 bp, Zea mays
  Clone ID: cC-zmle18900026d01d1
cccacgcgtccgctctcttctcctgctggttggctcatcaggcctgcccgaataatcctcctgcggattcccctcacggcaggccaaaacccgcacctttcccccgtcgacagattctcaaacccggcgaactccgggcagggctcacgtcgccgatcccgctcccggattctctttgccgccgcgaggagacggcgtccagtccaggccttcagcagcttcgtctccgtgggtatctgatcgggggatttcttgcttgagaaactgctagcatgggcgccggggtttggaccgcatgacacgcacaaacgggaagtcccatgggttcgaagctt

SEQ ID NO: 20302 - DNA, 351 bp, Zea mays
  Clone ID: cC-zmle18900026d02a1
cggggggggaatatatcgattacttatttgtggcgagttgaacagcgcaacacatgtccatagtccatacataattggcagataacaaggaattacatgatagatccaaaccttcattgtcttctggaagccatgaggatctttttacacagcaacaaacccacaaattaccaaagcagtctttcccagcaccaagtctattatggcctacaaatccacagtatcaggcgagtccatgatgcgagatcatgaaacccgcgaagggggagcgcctaacgtgcccgatccttgatctcatcgaggctgatttcactcccatttggggcctgaagtataacctgaatgccattg

SEQ ID NO: 20303 - DNA, 517 bp, Zea mays
  Clone ID: cC-zmle18900026d02d1
cgcagtccgcaggaccggacactcggcacgcaggctagcagcacagtagcagccagagccatccccgctcctggctacgcttcgcttcctcggcgccgattcctcctcctcctcctccaccctcgtccgtccccttccggcgcacgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagataggtgtggaccaggtcggggatcgcgctaccagctacgatgacttcacaaacagcctccctgagaatgactgccgatacgcgatctatgatttcgactttgttactgcagaggatgttcagaagagcaggatcttctatatcctatggtccccatccttcgccaaggtgaagagcaagatgtcttaccccagctcaaaccagaaattcaagagtggccctaatggcattcaggttga

SEQ ID NO: 20304 - DNA, 416 bp, Zea mays
  Clone ID: cC-zmle18900026d03a1
ctccccccctttaactataaaacgggaagccaaaaaacaaaaaaaagaaaggggcggacaaaaaacaaaaaaaaagggaggccccccccccccaaaaaaccccccgacaacccccccccccgagcccccccctggccctcccccccggggggggccaaaaaggcccttgccacacgcccctcccaaacgggccaccccaaggagcccccccccaggcccacccccaaaggggaatccctcccgcccccccccccggccccaaaaaaccccaaaaaggcggggggccccccctatccccctcagggccccgccccccccaaaataacccccaaaatgacgctcccccccccggaggacactggccccccaccccacccccggggggggcccctcccccccccccccatcataccccc

SEQ ID NO: 20305 - DNA, 475 bp, Zea mays
  unsure at all n locations
  Clone ID: cC-zmle18900026d03d1
cccacgcgtccgccctgatcgcttgggtggggatcccgacgccaccggcgtggctaccaacctacatgctcatcaagtcggacaagctcgactacgagaggatatgagggccggccggcggcctcacagggcaccgtagtgccgtcgccgaattcatgcttcatgtcgcatcaagagttggtcaagcaggacacaccttttgttgttgacttgatgaacgtatatacgtacatgccactattgccagaacagtctacagaggcgatctgagacctgagctgctggaataatcacgaaggctatcgggagcgacgttcgacgaccagattcaataatcgctgctgcacatcacttttttatgtgatttaaactcacatttcataattaatgctcatcgntcccactctaggtgatggttaatcgatgcgcttccgcaaaggaccagcttgtgtggcttcaatgaagggccctagcc

SEQ ID NO: 20306 - DNA, 462 bp, Zea mays
  Clone ID: cC-zmle18900026d04a1
ttttgttaagagaggcgagtcggccactcatatcttcagaaatgtttcagttgcaactctcaactcaaaacggttgcaacggctttccattcagtacattcattcataaggaatggcacatgaagaaggttgatagatgcatgcaggcgatatgcatttctttctactctgaggaaccagattcctcctgtaaatcgtcatcagagccaggtttctcctctggatcatcagagtcaggtgtctcgagctgaaggacaacattgaacccaaatgctgatcccggcgcgaacgcggactccatctcgccttcggactgggttgtctggatctcaggtttcaccttcaggttttccttcttgacaaattcttcaatggtgatgctcagtatttcctgaagaacgaatttggtgacccggctcttgccaagcatctgcagcaggatgctgctgggtatatttgatg

SEQ ID NO: 20307 - DNA, 534 bp, Zea mays
  Clone ID: cC-zmle18900026d04d1
cctgagcctttgcggccggctggagctggacggtccccgggcagcgcaggcagccggactgcgggagtcacctccatggcctcggctgctactgcaaccctccccaaggttcagttgaggccaagatgcaacagctactttcaggtgaccggtcaagtccatgcccacaccaaaacatgcgttgcctgcaagtgtccgacccatatccacgggttgcttgtttcagctggaggaaggaggacattcctgccggtgtctgcagttggatcaggtcagggctcatcggtcactgaggccgacaggaagagcgatttgtcgctggagaacgtcaagacgtccgttgtatcccgcgacgatgaaaagattaatgtacgagtgcagttgcctggaaaggcgacgcaaaaagtgtttgatgaggctctgacgttcttggcccgtgatgcgccaccggttcctggttttaggaagtccacaggagggaaaacatcaaatatccccagcagcatcctgctgcagatgcttgccaagagcccg

SEQ ID NO: 20308 - DNA, 376 bp, Zea mays
  Clone ID: cC-zmle18900026d05a1
aacgaacgacccaggaaacagttttgttttacccttttggggcaggaaagctttacccaatgggggggggcttccccttggttttttccccaccagaaaggcataaaccatgagccccagcccggcaaaaggcataggggccttacattttattttttttaaagaaacaagtttttcccccccaaaagggggaattttttttccacaccccgaatggccccttttggtgttgctcgcacgggcggggtttgggcattgggcgccccattattgccattgccacagagtttggaaagaactgtcctttaagctccttggaccaccggccagaagggtttggtgcctgccttccctggcccgggcctttacggaaaac

SEQ ID NO: 20309 - DNA, 400 bp, Zea mays
  Clone ID: cC-zmle18900026d05d1
gatgtttcgtccaaagcagctatcggtagcaagcaaccatgcatgcctggagcaggaatcacgaaccgggatctcatactctcccagatgagcaggatgagaaaccagattcccactggcggtgtaactcatccaccaataggcgccgagccaagtgatatatggctcaagcgcctgccgctaggcgaaccagaccctgacgttcttgggtccgagaccaacagggcataagtctgagacagattcttcgccacccaggcaaataaaccggtcctttgacgaggcactcccttgccacccaggaaaacaagaggagcacagcttgaatggaggggggaaagtgcatggaagagcacccccttattccagacaagagcttcaatcgctggatagggagatg

SEQ ID NO: 20310 - DNA, 492 bp, Zea mays
  Clone ID: cC-zmle18900026d06a1
ggactaaaacaaacatttggggtggtagtagaacagaacttcccaagtttctcatagttcttacaaaatcgtagccacgtaaggctatctgaacccgaaaatataaacaaaattttacacgaacgtcaacatatactcaactgggcagggttttttagatgataaagaaacagtagaacaaagtccggctcctttcgcatcctctaaatagcacataaattcctagctaaaaggaaaatggcctgcaacatcatgtcaattgccttttcacatgaacatctatcagtcctagatgcttgtagtcgcattccaaagccgcaggagtcccgttgggaccaccactacatattcttttcctattcaggtcagatgctattcatctcaccactgcagccttttttggggagttatgtaaagctgccattcctgcacctttgatccctgattgagaaccaccgattttttctgtcgcttgggtggacgcgttggtct

SEQ ID NO: 20311 - DNA, 325 bp, Zea mays
  Clone ID: cC-zmle18900026d06d1
cccactcgtacggaaagattcagcggcttctcaaatgcaggatcaaaagatgcaggatggcaattgtacaaaactccccaaaaaactgctgcatcggcgagatgtatacctatctgacccggataggaaaagaatatgtatcggcggtcgcaaccgtctcctgctgctttgggatgcaaccacaagcatctaggactgataaatgcttatgtgataaggcaattgacaagacgtagcatgccacttttcttttcctaggaatttatgtgccattcagaggatgcgaatggagccggacttagttcataccgtctctttatcatct

SEQ ID NO: 20312 - DNA, 396 bp, Zea mays
  Clone ID: cC-zmle18900026d07d1
cccacgcgtgcgcaagtgaacctgaaacttgcggtgttactggctggtattctgagtgagagtgagtgatcgagctatctgagctccgatcctagctagctaggataccgccataccacaggtcttcattcacaagtttaggagcgacagcaacaagagatcgatggcctgtgccaccgagcttaagttcttcttccttcccaagaagtccgaatggggcgccaccaggcaggccggcgcgcccaggccgaccaccgggttcatggtcgagcgcgccttcgtctacgccgatgagctcgggaagaccgtgaaaacgatcgcgttttcggggcggagcatcctggcgacggactagtagaacgcgacgtgcgggaagcggatggcgatcatcgtgct

SEQ ID NO: 20313 - DNA, 344 bp, Zea mays
  Clone ID: cC-zmle18900026d08d1
acccacgcgtccggccattggttacaccatattcattgatctctgttgtcggcttttaggactttaggcgtgatatggccttttagggttaagagggagaccatgttacttatattcagccccagcgagttgatgtctttgacatgctgctctgggactgcccgaggcacctgggatcttccagccacagggattgtaactaggcttgctgtcagaatgatttgtaaatgttccaccaggggcggccactgggagcacaggttgtgaccttgggacataaaccagagggcgttcgacccatgtatctttcaagaggtgttgcacaacgtctttggttttggagg

SEQ ID NO: 20314 - DNA, 392 bp, Zea mays
  Clone ID: cC-zmle18900026d09d1
ggtcgttccacgcgttcggatggagaaggccggcgggtacagtagcgacggctagcagtcgttgctggacagggtgatcaacgagctcgacgagcggacccaggtggcctacgggtccaagaacgagatcatccggttcgaggagaccctttactgttcgttcaggctcgccgcctgcgccaccgtcaccgtccgcgcccttatctgaattactagaatccgggctcgtagatgctggagtacacagtacagggaaattgcccacttttttcatcaacttaagtttttagattaaacttttttgaaacaatcagacaggagatctgtcttatatattgatgaggagaaagatgcccaaaggctaaaaaaaaaaagtcgatacaataacaagt

SEQ ID NO: 20315 - DNA, 379 bp, Zea mays
  Clone ID: cC-zmle18900026d10d1
gacccacctcatcctgtcatgaatacactcatggtccttcaaccactctcagtcattataaatgatgaagtgagctataactccgggggacatttttgttgatcaatgtgtctgtcggaagccctgtctacgtaaatctacgtcatatgcttaaagattgttcaaaacaagatatgctggatggatttccatccttggtgaaggatattgtaactaaattaacagaattagggttagtttgggaacttcattttcccttgggattcctattttcccatgggaaaaagaactaactttccttgggaaaatgaaaactcccttggcaaaaatgtggttcccaaactaaccctactcttagagtcattttgtcaactctatt

SEQ ID NO: 20316 - DNA, 506 bp, Zea mays
  Clone ID: cC-zmle18900026d11d1
cggacaaggcagagcgccatcgttcggattccttgctgaattcccgatcgctcgctcgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggtccggcgccggccaaggaggagaagggcctcggcgagaccatcttcggcttcatcttcaagaaggaccaactggtggagacggacccgctcctcaacaaggtcggcgccgagccggccgccgtctcccgcgccaagacgaccgccggcaagaaggctgccggcggcgacgacagcggcagcggcggggggttcaacctcggcggcctcggcgggctcttcgccaagaaaagcagctgaacgtgccaagtgtggcgtggctatggattgtcgaactcaaagctggaattggcttttgagggggaa

SEQ ID NO: 20317 - DNA, 451 bp, Zea mays
  Clone ID: cC-zmle18900026e01a1
acaaaccaaacacccccttatagtcttcccgacaataaatacaagggcttcagtttccaagcaatttgtttcaacagaaaaaaacccactggatcctggtgcataccgtacatttcatttgcaagtaaacacaagggttcctatgaagcaacagctttagacataaatcaccagactaggaaaaaaaaagttcaaagcaaatgacagctgccgcacaactgaagggggggcttaatcctttctcagggcgatatactcgcgcttagtaccggccttgttaatgactacaatttccaacttggctccaggggagatgtctttctcaggtggagatgcgaacacgtccttaactagaacgatgggctttgactccgacaatggggtgacagcttccctgacagggagttataaaggacttggtgattttagttgattggccaggactggcatg

SEQ ID NO: 20318 - DNA, 491 bp, Zea mays
  Clone ID: cC-zmle18900026e01d1
tccggggttgacccacgcgtccgcacaccacctcggtcggtcggcccacgggccacgacccaaaaaaggatcaaggtgggagaaacaaaacacaaggcggcgggcgcagcttccccactccacgttccgtgtttccgactctggtgactccaccaccagcaacccgtgcagcgagcgcactccgaccatcgccatgtcgaggcgcggcgactgggtctacgagaacaacggcgggacctgcgtggccatcgccggcgctgattactgtgtcgtcgctgcggacacccgcctttctgtgggatacagtattctcacgcgtgatcactccaagatctgcgacctggctgacaaatgtgtactggcatcttctggctttcaaggtgatattaaagctctgcagaaaaacctagctgtcagagaattgctgttccaacaccagccttaaataaaggatgagctgccccggcatggcacaacttctcttcaatacc

SEQ ID NO: 20319 - DNA, 523 bp, Zea mays
  Clone ID: cC-zmle18900026e02a1
gagataaatctcaaccaatatattgattatttctaggaaacacatgccggtatgagggcaccattatcgagtacatctcatatgtaatctaaaagatggcacctccaacgatgggttgctgcctcgacaagacaggattcatcaaagagaaccggttgtatggcagcaattgttgctgctgtaggaaggcagcgaccaatgggttagccactgccaatggattaagtaactgttgtcgctgttgtaggtacgcaacagagttcgacatagttagttggttgaatggaagcagctgttgcaagtaggcaacagggtttgccacagctagctgagttagagctggtacaatctgttgcaacaattcttgttgcaggtatgtaggtgcattggccacagcgagcgggctagatgaaagcagttgttgctgttgtaggtaggcggcagggttcaccatggctagttgactaagcgctggcagaaactgttgcagttgtagttgttgctgggttgcaactacctttgc

SEQ ID NO: 20320 - DNA, 436 bp, Zea mays
  Clone ID: cC-zmle18900026e02d1
accaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcagctgcttgcatccaacccacttgctctagcaaacgtagttgctaaccagtaacaacaacaact

SEQ ID NO: 20321 - DNA, 84 bp, Zea mays
  Clone ID: cC-zmle18900026e03a1
ggaatcacgttatatgaagtggtgtaggcatgacatgcacatcacatcatccatcttgtattttgaagttatgtcgtgatctta

SEQ ID NO: 20322 - DNA, 83 bp, Zea mays
  Clone ID: cC-zmle18900026e03d1
taagatcacgacataacttcaaaatacaagatggatgatgtgatgtgcatgtcatgcctacaacactgcatataacgcgattc

SEQ ID NO: 20323 - DNA, 313 bp, Zea mays
  Clone ID: cC-zmle18900026e04a1
ttttttttttttttttttttttttttttttttttttggtttttggtttttttttttttttttggggaaaccaaaatataccccctggaaccatatttcttcaaaaggcccaaaggaggtccagatcaacccaagggggggaacaaaacaaatattgaaagggcccacaaggaaaaaaaagtctaaaaaatggccaaacatgggaggacaaaaagtatctagaaaccattctgggacacaatttggtaaccatttaagggcgcccaaacccaaagggggcataaacaggccccaactcctacccttttgttttc

SEQ ID NO: 20324 - DNA, 482 bp, Zea mays
  Clone ID: cC-zmle18900026e04d1
ccacgcgtgcggcgattcttgatgttacattatgtgatgcattgtacaaaggggctatcaaaaagggctcggcatacccaactggaattcacatgaaagacttaggttcagcattcttaaaccgcatgcaagttcaccacaaggtatctagaggaacttacgaggtcatacgcaagggtgccataagaactattcagatcatgacagaaagaagacagggcaacatgaagatgactcggctttatgggctcgagtgttgcctgatggatcctgattcattgagcttctgagctccagaaaaaatgtgcttgcaacagcaccacagcagagcttccaggtgagaaagggcacgacgaggtcttggtacaaggtggagcgattgatgaccttgctgagcaccttgtcgaccattacgatgttcctaaaagatacatcgtggtttatgacacaacaaacaggttcgtagtgggggctgaacatgt

SEQ ID NO: 20325 - DNA, 292 bp, Zea mays
  Clone ID: cC-zmle18900026e06a1
gtagttactttggctactataggaacacaggtggaagggccaaccatctatagcggggccagggtacaaccgcacaatcatatttcctcaagcccagctcaagcgcccggggattgtttacatctactgacgtccgccaaattaaaacacgacacatgtaattctaacatctccgtccaattttttagaattctgcaaaaaacaaacctggatgaagaatggggatcctggtactttttcttccccggaacctatccaatggagcacctcttaccaattaagcgaccggggg

SEQ ID NO: 20326 - DNA, 499 bp, Zea mays
  Clone ID: cC-zmle18900026e06d1
cggacgcgtgggcggacgcgtgggttccgaggcggggatgactagcccaatggtggccaccccggtccagttccacacaaccggccgcctcagcttctgctccttttcctttcccagcgcatcatggaggcggcgatttgcggcggtgagggcgtccgtcgagacgatggcgacggagaagctgggcatcaaggtggagcgcaacccgcccgagtcccgtctcttcgagctcggcgtgcgccaatggcccaagtgggggtgcgagaagagcaagtttccgtggacctactctgccaaggagacgtgctacctgctgcaggggaaggtgaaggtgttccccgtaggccacagggaggagttcgtggagatctgcccgggagatcttgttgttttcccctaaggcttgagctgcacctgggacgttgccgaggccgactacaatcactacaacctttagtagccgccgtcgtcgactagccctgcggcgcttgatgtatac

SEQ ID NO: 20327 - DNA, 485 bp, Zea mays
  Clone ID: cC-zmle18900026e07d1
accacgccttccaatacgccgggggctacccatcgcggagccaccggcgattccgtacccccttccccggagagcgatggtgacggaactgacagcggctctactgcgcgcgtacgacggtaccgtcccgtacaagtccttttacgtttccgttcggggcaaggtctacgacgtcacctccggccgcggattctacggtccctgcggcgcctacgccgttttctggggccgtgaggccagtcgcgctcttggcaagatgtccaaggacgaggccgacgtcttctgggaccttttcgggctctccgacaaggagctcggcgtactcgccgactgggagatcaagtttcaggccatgtaccccgtttgtgtccgactcgtcgccgacgcctgatctcgctactattggtctatatttactctgtcctgccttttgcggatgttaatgctgggctcgcttgcttgtagctagtagctttgctacccaa

SEQ ID NO: 20328 - DNA, 299 bp, Zea mays
  Clone ID: cC-zmle18900026e08d1
gcgtccgccactcgtatttatgatgaatactatcatcgaggccgaaaaggtgttctagcaatcaggacctagtaaagtcgagggatcttttagaactaggtccaggaccagaattgactggatatactcagattacactgtaatgacgggatgtggacacggatccatagtgacgcgggcattacgagatgaaattggaataaggactcatacgaggatacctgtgtcaagcgtgggaacgttctaaacacctgccgagacatatggtaaatcccgaagtaccagaccatcttgtacct

SEQ ID NO: 20329 - DNA, 452 bp, Zea mays
  Clone ID: cC-zmle18900026e09d1
gggtcgattcacgcgtccgtttttttttcacctctcaagttcaatatataaaattcaaatgcatggtacgtacgacccaaacacctgccacgaagaaactcaaacaatctacgtttacatatgcataccagactacactagtatactttcgtgtattcttttgtacttcacattcactacatctacatgtctacatgcagtactgtagtagcactgtagcagtagtcgagtacaggagagagtgtatgaagaggcgtgcgatgcgagcgagacagatgggcaccggccgcgccgcgtggtagaaaaaaaaaaagccctccaacgaatcaagaaatttgcattcctagctaagctaaaaaaaacacctaggatccagtgtatacagcgtgtcgtgtgtgcgtgtgtgtgttatattgtgcatctgagagtgcgaaggcgagcatgtacgctac

SEQ ID NO: 20330 - DNA, 330 bp, Zea mays
  Clone ID: cC-zmle18900026e10d1
acgcgtccggcaacgtgtgtacagttgacgtcttatggtattgagttgctgaaacttgtaaggttcatcacttgtgtgtcggactctacttgtatatatatgcgaagaactcttgagatacacattgactacaatgtcttttgatgaataagaccagacagtgccataccgaacttgtccttcacacggttgatttgccatcttgggggatttggggaggtggtggtggtcgtgctctctattggtgtgaggctgatggcgtggctgtcattaatacaatccttaattcgtgttttgatgagcttttacaaaataatttaataaataaag

SEQ ID NO: 20331 - DNA, 471 bp, Zea mays
  Clone ID: cC-zmle18900026f01a1
tttttggaggacaaatattaacaagctcatattggtggggtttggttttcgagtcgattcaaatttcacagagaggactgtataatatactagtatactaggactaggatagtagcagcagagcagtagtactgactgcacacgcacacacgactttatttggcgacataacagcagtagcagctagtacaagcaaggaatcgggttcgattcatacgggcggcagcggcggctgctcttgcttctggtcgtcctggtcctcggcggcggagtctggatcgggcttggcggcggagtcgtggcgtggggcggcggcgaggatgaggggccggtccttggcctcgtcgtggtcctcgtcgtcgtcgtcgtcgtcggtggagaggttgatgcaagagcagcgctcgagggaggcgaagaaggcggaggtgacgcttgtccccacccaggtcgcccagctcttcatggccgatc

SEQ ID NO: 20332 - DNA, 496 bp, Zea mays
  unsure at all n locations
  Clone ID: cC-zmle18900026f01d1
caactcccccgcaccgtaaccctagcagcagatcggccatggagagctgggcgacctgggtggggacaagcgtcacctccgccttcttcgcctccctcgagcgctgctcctgcatcaacctctccaccgacgacgacgacgacgacgaggaccacgacgaggccaaggaccggcccctcatcctcgccgccgccccacgccacgactccgccgccaagcccgatccagactccgccgccgaggaccaggacgaccagaagcaagagcagccgccgctgccgcccgtatgaatcgaacccgattccttgcttgtactagctgctactgctgttatgtcgccaaataaagtcgtgtgtgcgtgtgcagncagaactactgctctgctgctactatcctagtcctagtatactagtatattatacagtcctctctgtgaaatttgaattgactcggaaacaaaaccccaccaatatgagcttggtaatatttgttctac

SEQ ID NO: 20333 - DNA, 437 bp, Zea mays
  Clone ID: cC-zmle18900026f02a1
ccagctgaagttcattctaattgagctgcgcgttttcattacaaagagatcagaccacagacgcattgggaaacaaaaagaaaaccgaacagcttcaggcagaggggtggatgcggcggtccgtactagctgtgcctgcgagtgtgtgcgtcgatgttgagctcaggcaggccgatccgcggctcaactgacgatcagaaccttgggggccacgccctcggccctcgccaccgccggggggatccttggcgcgccggccgcgagaaccgacaacgtgccgctcctcgggggtgccttcctagtcctagcggtgggcttggtgcaataatgcctgcgcggcgagaggaggcgtccgcggtgcgcgttgagggcgccgccgcagctccgcgacggcttgaggcgcttccgggccggcttgggcaggtcctttagcgacc

SEQ ID NO: 20334 - DNA, 443 bp, Zea mays
  Clone ID: cC-zmle18900026f02d1
ggtcgctagaggacctgcccaagccggcccggaagcgcctcaagccgtcgcggagctgcggcggcgccctcgacgcgcaccgcggacgcctcctctcgccgcgcaggcattattgcaccaagcccaccgctaggactaggaaggcagccgcgaggagcggcacgttgtcggttctcgcggccggcgcgccgaggatgccgccggcggtggcgagggccgagggcgtggccgccaaggttctgatcgtcagttgagccgcggatcggcctgcctgagctcaacatcgacgcacacactcgcaggcacagctagtacggaccgccgcatccacccctctgcctgaagctgttcggttttctttttgtttcccaatgcgtctggggtctgatctctttgtaatgaaaacgcgcagcttcaattagaatgaacttcagttggaaact

SEQ ID NO: 20335 - DNA, 545 bp, Zea mays
  Clone ID: cC-zmle18900026f03a1
ttttagaacaactaaaatttattatccaccagctccatgaacatgcagcaaacctcttggggtgaaccaaccaatgacgaatgttatattagtagtagcatacacattctggttggggcacatgttgaacattggcgtgcagcccgatcacattgtgtgggccttgcccgcagcacaacaccatagacgtcaccctgcaggcagcagcaacatgtctacttcttcaagttcttgttgtgccatgtcaccaccacatgttactgtaatttaattagcagtaagaagctcatccatatagcaataatatagattcagacttgtagaccaaagcaacactcttttctatatgattttaggcagtggcggacctaggttttttatatagggtatgccgtaacaaattttttatataagatactaacagaaggtcatctctatatatatgatgcccagggctattttatcctcgccgagtcatatttttttaaaaaaccaataaataataaccttactaaatctgcaaattttaacaaaattctaactta

SEQ ID NO: 20336 - DNA, 576 bp, Zea mays
  Clone ID: cC-zmle18900026f03d1
cggacgcgtgggctcaaaagatggtcttcgcattgtgctagtaagttagaattttgttaaaatttgcggatttagtaaagttattatttattggttttttaaaaaaatttgactcggcgaggataaaatagccctgggcatcatatatatagagatgaccttcttgtagtatcttatataaaaaatttgttacggcataccctatataaaaaacctaggtccgccactgcctaaaatcatatagaaaagagtgttgctttggtctacaagtctgaatctatattattgctatatggatgagcttcttactgctaattaaattacagtaacatgtggtggtgacatggcacaacaagaacttgaagaagtagacatgttgctgttgtctgcagggtgacgactatggtgttgtgctgcgggcaaggcccacacaatgtgatcgggctgcacgccaatgttcaacatgtgccccaaccagaatgtgtatgctactactaatataacattcgtcattggttggttcaccccaagaagtttgctgcatgttcatggagctggtggatataaattttagtt

SEQ ID NO: 20337 - DNA, 335 bp, Zea mays
  Clone ID: cC-zmle18900026f04a1
cttcttgggtttgggtttttttttatttcaaacgcacggccaaaaccccccccagaacccgagtaaggaccggaggctactgggggggggccttagtccccccaacccacccaacatctgcaaagcaggtcaaacaaagggatataacacaaacccaaaagccaacacaaaggaaaagaacccccaacaaaacccaaccccacgctccatttaattttaaatgcacaaagggaggcgaaaagaaaaatacccaggccccccccactgccctgcccagccccgacaagcaaggtaaaaaaaaaagacgagatctccctagcccaatgccaccgccc

SEQ ID NO: 20338 - DNA, 468 bp, Zea mays
  Clone ID: cC-zmle18900026f04d1
tgaagaggttgctggaatgtggaagcactccatcaaagtttcttatgaagcaacaaaggcagcatttcctggtggtgaagttatcgcgcatcttgatcacaagagcttcaagggctggcagaagaatgctgttacatgcttcttgcaggagcagaacatcaggataggaaagcctagcgatttcctgtgacgtgctacgacagtgctggacaggacaggtggagaggctgtgaatgcttgagctgatttccctatgcgcacgctgaataaatatgagacataggggctgtttggttcgtggctaaatgtgtcatactttgcctaaggttagtcgttcgaattgaataactaaccttagttagaaaagttagtcaaaatgtggtaaattaggctcaaaccaaacagccctatagtaagactcgatccttaatgcggttcaagagcttgaatttgccgtttttataaata

SEQ ID NO: 20339 - DNA, 449 bp, Zea mays
  Clone ID: cC-zmle18900026f05a1
gacgaccggagcagacataatcaggaaattatccggggcaaaccaccacccgcagtcaacaagagcgctggaccatataaactagatatcacactccagttgtagtttgacccatatgccatcacaggcaaaccgctcaagagttcagatgcttcaaccacactacgactgagagatacttactacacacgcggcaaccacagggggcaccatgttttcgcaacatctacagactgtccaggcattatttcatggataagcaagcaggagcatgtacgagactgctccaagcttagctggggcctaaggaaagcgcttagccgctgaagcccccttacgagctggaggcctcgaaggtatctggcttatgcttctccatcaggccccgtagggctgcgtcaaacttcttttccagctccagctccagatccatgtattctttcttgagc

SEQ ID NO: 20340 - DNA, 455 bp, Zea mays
  Clone ID: cC-zmle18900026f05d1
gaggcatttaacaagcattgccatggtaaaagccgtttgaagtatgagatgaggtcttacaatgagagggtggtgattctaatgaaacaaatgactgaatacatccaacatctgaattacctgatgaacaagatggttaagacagagcatctatctatagcagtacaagaatcattgggtgttgttacccagaagctacttgagactattgaagaaaatatatttgtttggagtaaagcaaaagagaagcacatggagtatgaggaagagatgaaatcccaggaggaaatttttcatggtctaattgaggatattcacaaggtcacagacgataaagaaaagtagtttgagaagttgttgcaagaagagcgcttaaaggccagactctttgatgttgattctggaactatgaaagatcgtccgctcttgaaggaatatgtgcataagctcattga

SEQ ID NO: 20341 - DNA, 561 bp, Zea mays
  Clone ID: cC-zmle18900026f06d1
ccggaatttctgggtcgacccacgcgttcgctacagatgctgttgttctcatgctcaagaagaagatccacagattaccagttgtaaaccatgacgaaaaagtgataggtacggtgagtgagtgtcagaatgctcacaagccagcagagattaaaaaaaaaaactgcatgccatacacttaataagtattatccctaattatcattgacaacacagagattatatgttgcaagggctaatggggttctaaacactgttaacaggtatagttacccgcgctgatgttcttcgcgtgttggaaggcatgttgaagatttatgagcgcagattcccatgctcggaagccacagtctcttgttaatatgtagatgtgcccgggcatggtgtttttgagtagcagcaaagagatctaccatgtataggagtttttccttgtaaataaaagtagcacgccaggagactccatcccaggttccgcactgtttgtgcgaccagatgctgtatactagccagattctttgaagaccaatttaaatggatatgtctaaagtagtgtcttgg

SEQ ID NO: 20342 - DNA, 135 bp, Zea mays
  Clone ID: cC-zmle18900026f07d1
cacgcgtccggccactcctgacactcattacattaacataatggttgtaagatctgaattgataagcgtccggggccccccctagccattgtgtaaccaatttattctgaacccctcttacttgaaaacaagtta

SEQ ID NO: 20343 - DNA, 514 bp, Zea mays
  unsure at all n locations
  Clone ID: cC-zmle18900026f09d1
ggtngttccacgcgtccgcataatattctggcctaatggcaagattatgagaatgagcactggtagctcagctgctgacgctgctagaagaatgggcgtggaagggaagctgctctgggttaatggccaactagtgctgccccaaacagagctaaaggatggggatatagttgaagtgagggtatagatgcaagtaccatattccagtacaccttcctcagggttattgatcatattggttcctcagttcttgccctatcttggcaatgcatcgaacctcaattgtacagtccatttgtcgaaatgaatcgaagaaagaaggattaggtccagttagtgttgtgtcatacaagagttcactgtgtacaattagacactgcaagtataaaagctgtctgtccagctgtgcttctccttgcccatagttacagtggtaatgtaaattttcgtcagtaaagatgtagtaatgtttagttagtggtccaaacaataaaaaaantaaaaaaaagggcgg

SEQ ID NO: 20344 - DNA, 463 bp, Zea mays
  Clone ID: cC-zmle18900026f10d1
ggtcgatccacgcgtccgctccggttggaatcacctaccactatctacagtgaactcaagtctacattttggcccatgcttaccgctggatggaagttgtggccttttgcacacttaattacatatggtgtggtttctgttgagcaaagacttttatgggtcgactgtgtggagcttgcctgggacacaatatagtccacgtactcaaacgaaaagtcataggcaaggaattctgatagcacctccacaccagatgcttcaaaggacatctccagatagcagccctagagaccttggagagctgattcgtccttccatcgcttcagtttatgtaaattgtacaattagctgcagcaactctgcatgtgttaccctttttttggtagatatgtttatatattcatgaaacatcaattgtgtagtatgtgccatataatattacgaagaaagttgcgaactttct

SEQ ID NO: 20345 - DNA, 508 bp, Zea mays
  Clone ID: cC-zmle18900026f11d1
cccacgcgtccggttggcgttgtcttccggattttgggccactacactggtcagcctcttcttggagctaaagttgtagcctccatgctgatgtttgcgacggtcgctgggattctcatggcactcttcttgaacactgctggcggcgcctgggataatgcaaagaagtacattgagactggcgctcttggtggcaagggcagcgagtcccacaaggctgcggttactggcgacacggttggagacccattcaaagacactgctggaccgtcgctgcatgttcttatcaagatgctcgccacaatcacgctggtcatggctccgatattcttgtgattaaccaaccactcatcaagcttgctattaaccctgcggagatgtacctatgcgaccaggtaaatgaggtgtgtgtgtgtgtgtgtcacctgcatgtgatgatgtaacggtccaatcggtttgtgtcacgacatgctgtacccagagaaagaagcggcgatctatacccatg

SEQ ID NO: 20346 - DNA, 459 bp, Zea mays
  Clone ID: cC-zmle18900026f12d1
tcggaattttcgggtcgacccacgcgttcgcccacgcattcgtggacgcgtggggagtagtctagctctattatctgtgtattgtttgctctccacaagaaacaagggatatcaccaacaatggccgtcgccttcttgtcctcggtccatctgctgctcctggccgtcgccttggttggcatgagcgccaacgccgccacctttaccattaccaacaactgcgggttcaccgtgtggcccgcggccaccccggtgggcgggggcacgcagttgaactcgggctggacgtggaccgttaacgtgccggctggttccagcttcggtcgcgtgtggggtcgtaccggctgcttcttcaacggcaacagtgggagctgtcatacaggcgactgcggttgtgcgctggtctgcaccctgttggggcagtcgtccctgacgcttgccgagatcaccatcggtggt

SEQ ID NO: 20347 - DNA, 340 bp, Zea mays
  Clone ID: cC-zmle18900026g01a1
aaaaaaaaaaccccccccccttgttaattaagggcccttcccttctttttttccgggggagaaaaaccccccccgggggcttcccccccctggccccattttttaacaccccgccccctgggggggaggccggccccattaaaaccccccaccttttttaaattcccctaaccccggttttttgttcctttccccaaataaggggccccccgcaaaggcgagggggggggctcgaaacccggaaaaatagggtttggggcccgggggccgggccgacccctgggttcccccgggaattcccggccgggccccgggggggtcccccttttccctttagggg

SEQ ID NO: 20348 - DNA, 338 bp, Zea mays
  Clone ID: cC-zmle18900026g01d1
cccagacctcagtcaccataccctaattatccagatttcaagccaccatcctcgccttcgccgtcagcaccttaatttggcaagagtacaagaaaccgggtctagaggatattaaagaagttgagttgttcatatggagccggcatctcaccagaggtgcatgttgtactatgatcgtgacagtgtggctaagtcactgtggcgagttttctgcagcagtaaatatatgatgtaatgttcattaattatcaatgtgctatgattttcttttaaaaaaaaaaataataaaaaaaaaaaaaaaataattaaaaaaaaaaaaaaaaaaaataatataaaaa

SEQ ID NO: 20349 - DNA, 281 bp, Zea mays
  Clone ID: cC-zmle18900026g02a1
gcggacgcggagatgcagagggtgttctcgcgcatcgacgcggacggcgacgggcggatctcgccgtcggagctggcggcggtgtcgcgcgccatctccccgccggcgagctcctcgcacgggcggcgcgaggtggcggccatgatggacgagctggacacggaccgcgacggcttcgtggacctgggcgagttcagggcgttccacgcgcgcggcgttggcggcggcggggacgacggcgacgacgcggagctccgcgccgccgtcgccgtcggcgtcga

SEQ ID NO: 20350 - DNA, 281 bp, Zea mays
  Clone ID: cC-zmle18900026g02d1
tcgacgccgacggcgacggcggcgcggagctccgcgtcgtttccgtcgtccccgccgccgccaacgccgcgcgcgtggaacgccctgaactcgcccaggtccacgaagccgtcgcggtccgtgtccagctcgtccatcatggccgccacctcgcgccgtccgtgcgaggagctcgccggcggggagatggcgcgcgacaccgtcgccagctccgacggcgagatccgcccgtcgccgtccgcgttgatgcgcgagaacaccctctgcatctccgcgtccgc

SEQ ID NO: 20351 - DNA, 271 bp, Zea mays
  Clone ID: cC-zmle18900026g03a1
ttttgatcaatatgcaaagagctttatttgacaaccatgtatgtacatacagacacgacgacgatcgaacatataagaccatgataggtcatatgacatatataagacttttatcttgcatatatatatgtacgtagtacccgtcctgctgctgaaagcagactaaagttggcgcaggtagacaccgatcgcagcgacgagcctggtcgtcgcgcgtccatagaatcccacgatgctgctgccgatgggtgcggtgatgcaaaaacgtgtc

SEQ ID NO: 20352 - DNA, 271 bp, Zea mays
  Clone ID: cC-zmle18900026g03d1
gacacgtttctgcatcaccgcacccatcggcagcattatcgtgggattctatggacgcgcgacgaccaggctggtcgctgcgatcggtgtctacctgcgccaactttagtctgctttcagcagcaggacgggtactacgtacatatatatatgcaagataaaagtcttatatatgtcatatgacctatcatggtcttatatgttcgatcgtcgtcgtgtctgtatgtacatacatggctgtcaaataaagctctttgcattttgatcaaaa

SEQ ID NO: 20353 - DNA, 479 bp, Zea mays
  Clone ID: cC-zmle18900026g04a1
ttttgtgaaataaagcatctgttgatacaatgataaggcaatgtagcattacaaactacaaggttcctttaacggtacagtattcagggttataactccgtgttgctacacctgaaatcacgccaaccgcctgtctgacgaggaacatgtcgatagcatcatgaagatcacactgatccttttcatgctcagtacctgcacccttggtccccaacaagatcgacctcccagtgttcgtacaatggtacatgtagctccaaccgtcacgataaatgactaccgaagtgtggtagccatgaaggaccggatacgttgcaggagttctgccttcaccgaagcaggcactgatgctcttcctttcggaacaataacatgaatgaggtcatctaccctcacattatttcttcctttcttccttacatagtccctgcagaatgccttcatctcatccatccagccgcactcgacgagccgctcgc

SEQ ID NO: 20354 - DNA, 439 bp, Zea mays
  Clone ID: cC-zmle18900026g04d1
gacgctcagccgctcaggaatcgaaggagcgacgaagctaattgagggcgcatctaagccgaattgaagcatgagggaatcgattaatcgtccgcctacgccgagcgcggtggaggatcgggacaaggagccttctctcgtagaaatcattaacatcaagtttgtagagagtggagagaaggagaagctgacggagctcctccgcgagcggctcgtcgagtgcggctggatggatgagatgaaggcattctgcagggactatgtaaggaagaaaggaagaaataatgtgagggtagatgacctcattcatgttattgttccgaaaggaagagcatcagtgcctgcttcggtgaaggcagaactcctgcaacgtttcccgtcctttatggctaccacacttcggagtcatttatcgtgacggttggagctacatgtacca

SEQ ID NO: 20355 - DNA, 87 bp, Zea mays
  Clone ID: cC-zmle18900026g05a1
aaaaaaaaaggaaaaaaaaaaaaaataaaaaacaaaataaaaaaaaaaaaaaacaaaaaaaacaaaaaaaaatcctaacagagaaaa

SEQ ID NO: 20356 - DNA, 549 bp, Zea mays
  Clone ID: cC-zmle18900026g08d1
cggacgcgtgggcggacacccagaagggccacgtctccacgcaagtgaaaggaacgctgggttacttggatccggagtactacatgacgcagcagctgtcggagaagagcgacgtgtacagcttcggggtggtgatgctggagctggtgagcgggcggcagccgatcgagagcggcaagtacatcgtgcgcgaggtcaagctggccatcgaccccaacgaccgcgaccactacgggctgcggggcctcctggacccggcgatccgggacaacgcgcgcaccgtcgggttcaggcggttcgtgcagctggcgatgctgtgcgtggacgagtcggcggcggcgcggccggccatgggcgaggtggtgaaggacatcgaggccatgctgcagaacgaggtctccgggcccgacggggccaccagctccgccggctccttcgtcaacgacttcgacggcgccggcggcggagcgaggtcgcacccgtacagcgacgttgagatcacgagaggctcgtacggtgacaacgcgtcggactacatgccgtactttg

SEQ ID NO: 20357 - DNA, 108 bp, Zea mays
  Clone ID: cC-zmle18900026g09d1
gaccccccctgtatcggggcattaagcgctgcgggtggggtggtaacacccagagtgaccgcttcacttgtcagcgccctaacgccccgtcctttcactttcttccct

SEQ ID NO: 20358 - DNA, 426 bp, Zea mays
  Clone ID: cC-zmle18900026g10d1
gggtcgactcacgcgtccggtggcggtggtggctatggagaaggtggaggctttggaggtgggcatggtggtggtcgctatcctggtggtggagggcaccatggtggtggagggcaccatggtggatggaattaagaagcattgctacataaagtttctctatgtccgataacaataaatggcgacgataaatttgaatgctacatgtagttccgtgatggaaatcttatgtattttgtataaaacatggtacatggactgttacgtatgttgcatgaaatactgtactagaataagatctttgtatgccatgtatggtattagtgtgcatgtgtctggcttttgaaaggtgtacctcgtcatttatggacttatatgtttgtatagataaaaataatatttttttctcaataaataaattttttt

SEQ ID NO: 20359 - DNA, 545 bp, Zea mays
  Clone ID: cC-zmle18900026g11d1
cggaatttctgggtcgacccacgcgttcgcctttttgagatggatactagtatgctaggtcgagtagctgttttaataattagggatctcggtagaagtcgagtgatttttctagcactcgcgcgaggacaggaattgattgtatccactttgataacagaataatgatggtctgtggacactgatccatggggatgcgtggtctacgagatgaaattggaataaggatttacgtgcggatacctgtgtcaagcgtttgaacgtactaaacatatgccgagaaatatggtaaatcggttagcctagtacctgattgaacctggcagcagattgccctcctcacgcgacctgagacgaggtctcccattccggttatggtgggtacaagtgcggtcactgcacgacggccagtcggtgtcagtgaggcattgtacgccaaggcggtgagcccctctctgctgacggtgaatctatggggacagttgatttttgtggagacggagtgcccctgcatgtcgtggtgttaggtttacctcgcaaggata

SEQ ID NO: 20360 - DNA, 229 bp, Zea mays
  Clone ID: cC-zmle18900026h01a1
gaacacaagaagcaactttgttttctcgtaccacgaaatgtcccagagacagaagtacaacgtccagagaatcactaattcagagcggcacatcacaagaaacaattccaaaccactagctggaaatctcgtcatcttcatcgtcgtaatcatcatattcatcttcatcagctgattcgtcaaaatcgtcttgatcctcatcatagctaacagaggtgactgcgttgtc

SEQ ID NO: 20361 - DNA, 229 bp, Zea mays
  Clone ID: cC-zmle18900026h01d1
gacaacgcagtcacctctgttagctatgatgaggatcaagactattttgacgaatcagctgatgaagatgaatatgatgattacgacgatgaagatgacgagattgacagctagtggtttggaattgtttcttgtgatgtgccgctctgaattagtgattctctggacgttgtacttttgtctctgggacatttcgtggtacgagaaaacaaagttgcttcttgtgttc

SEQ ID NO: 20362 - DNA, 504 bp, Zea mays
  Clone ID: cC-zmle18900026h02a1
ttttttttttttttttttttttttttttttttttttggtttttgtttttttttttttttttttttttatcttatcctttttcttctttttttttttttttttttttttttaacccccccccccaaaaaaaaattttttggcctttaaaaccccccccccgtggagaaaaaaaaacaaaacacctctctcccccccccccaaaaaaaaaaaaaaactcccgaacaagagggccccccccccaaaaaaacggacaccaaaagggggcggccccccaaaaaaaaaaagaaaccccccccaaattacactctcttaaaaaagcccaaaaaggtcaaaaaaaaaaggggccccccaaaaaaaaaaaaaaaaaaatgcgggcaaaaaaccttaatagggggggccctcataatggagggccccaaaaaactcgggcatataattgtgcccccccccaaaaaaaaaaacccccaagtttccccccgcccttgaaaaaccctcccccggtgt

SEQ ID NO: 20363 - DNA, 476 bp, Zea mays
  Clone ID: cC-zmle18900026h02d1
cccacgcgtccgcacgacaaaaggaagaaaaacccaagaaatatctctgcggccctgctcgtcccgagccgagccggcgagatggcggggatgtctcgcgcgatccgcaacttcgccgccgcgtcccggcgaaccctgaccgctgcttcggggccggcgctgccgaaggaggcggcggcggcgggggcgcgggtgagggcggcggcgcccgggcgcatggggcgggatcaggaggacgggaggcgcgtgcagtgggtgttcctcgggtgccccggggtggggaagggcacctacgccagccgcctctcgcagctgctcggcgtcccgcacatcgccaccggcgacctcgtccgcgacgccctgggcacccctggccccttcttcaacaagcttgctgagattgtcaatcatggaaaactggtgtctgatgagatcatcataaatctgctgtcaagacgtctggaagagggagagga

SEQ ID NO: 20364 - DNA, 492 bp, Zea mays
  Clone ID: cC-zmle18900026h03a1
aaaggtaaacattaccttgattcagaggtaataattgggccatcaacaacgtgcacggttcttatcatgtagtcaatgcataaaatacatgcaagccattacagccaggcaccgcctataagaatcagaagagaaggtttgttggcagtacataaatccatgaacaacaatgtctaagtgccccttctttactacatcaaccatcaacacacaactcagattaagatcaacgtagttttctttcttacacattagaaaggtgagccccatgaatgaatgtcaaaaaacattatcaccggcatgtagatggttatcaagacataaatgatgtcatccatatttaagcatcgttatccatccattcttaggattcctagaccttttcttgagactccagtgccttaactcaatattccatgattgcttgttctgttggagcagtacttgatgaatactggcaaaaacatgtgcaattacaaactcaattggatc

SEQ ID NO: 20365 - DNA, 285 bp, Zea mays
  Clone ID: cC-zmle18900026h03d1
cggacgcgtggggccatttcttgtggagatttatgcatatgacataaatccaactacaactataaaagggaagcactacatcggctctggtgtgcttaactatatctttgatttcgcgaatattggtttgttatttaaattagcgaaaaatcaagcttatatccttttgggccctctgacattatgacattggtttagaaggttctttagtgaaaaaattcaccatattccaggtcattggttttaacaaatcatagtattccgttccaatacaatcaaggtatt

SEQ ID NO: 20366 - DNA, 531 bp, Zea mays
  Clone ID: cC-zmle18900026h04a1
tttttaaatccaacttaaagagtttaaaatagatgagttgataatactgcagcaggagtccgactctgtcctgtttacaaagaagatatatagataggtccatgtccaatgagtatagtcgatctaaactgctgagctgagagagagggagagagagagagttacaggcgtatatgaaggtcactcgacgatcatctgttctgcaatgtgctgctgttcaacaccagataatagattggtaataaacaaagcgactcaagacgaatactacaaaacaaggcataatcttgattgtcgacgatgttgttgttgtgtcccagacgcagaaggtaaaatattcacagcagtcagctcatcatgcgctctttttccttttctcctcttcaatcttagccttaatgtaagagtacatagcaacaccagctatggcaatggacgtgccaattccagtttgtgtgctaattttgttgccaaaaacaacgattgagaagccaatgacaaacacacgcttcacccacgcgttcgcggacg

SEQ ID NO: 20367 - DNA, 444 bp, Zea mays
  Clone ID: cC-zmle18900026h04d1
cggacgcgtgggtgaagcgtgtgtttgtcattggcttctcaatcgttgtttttggcaacaaaattagcacacaaactggaattggcacgtccattgccatagctggtgttgctatgtactcttacattaaggctaagattgaagaggagaaaaggaaaaagagcgcatgatgagctgactgctgtgaatattttaccttttgcgtctgggacacaacaacaacatcgtcgacaatcaagattatgccttgtttggtagtattcgtcttgagtcgctttgttaattaccaatctattatctggtgtggaacaccagcacattgcagaacagatgatcgtcgagtgaccttcatatacgcctgtaactctttttctttccctctctctcagctcaacagttaagatcgactttactcattggacatggacctatctatatatcttt

SEQ ID NO: 20368 - DNA, 543 bp, Zea mays
  Clone ID: cC-zmle18900026h06d1
gccacctgtgcgatatgaatttctcgccgatggggatcctctgccgctgggccactacgctccgtggttgtgctccaccacctacgtccagctctcgttgatcgacctgggaggatgcgcggcgcacacggatgttcgtcgcagcttcgcctgggtggattcattctcggcgcggctggaatttctcaccgatgtgagctctccgccgccaaagcgtcaccggacctcgcagagcatgggcacaaccttagatggcgatttggcgcaccagggcgtttcgtcgtgcacgcgcggaatcggggggaataccggttcgtgcttgggtggaatcgctcgccgaaggcctcacctgggcgccgtcgttcggccggatgaatgtagccaggagattggagggagccgctgccaaggtgctccgactcgccatcgatccgctgggcgccatcagacgccgtgtgcatgaatagcttaccactccatctttggctcagcagtgaggacacgtgtcatctgaagagcaagattggtacctggaatctcaag

SEQ ID NO: 20369 - DNA, 414 bp, Zea mays
  Clone ID: cC-zmle18900026h07d1
gttgatctacgcgtccgcaagcccagaaggggccatcaaaggaggcgacggcccaagctggtattccataaagatatcttgtctggtcataggtcactgtccgggcctgaagatatagaggaagtgcacttgttcgacgggttagtccacgcttctggtggatcctgggagtggagtttatctacgccacgacgctttggagggcggactcgaggtaagaaacctcggacaactgtagtaactcgagttgtacaagacgaaggctaagttagtccaccggggaaacctgttggtactggcgacctcgaagccgacgataggcgattgggtggatggggcataacaacatggcggtgttaaagagcgagattgtccgtacgtaacaacttggctgctgcactttgagaaagggta

SEQ ID NO: 20370 - DNA, 350 bp, Zea mays
  Clone ID: cC-zmle18900026h09d1
gcgtccgacgcggggcattctgctgtcaaagaggaaccccttgatgagcatgaacctgcagaggaatggcatgaacacctgcatgacgtccccccgggactggctgcggagggacctgagcgtcatctgcttagggctgatccgctggatggggccgtccagcattccggtcatcaacggcaacagactcacggcgctcttcttctacaacatcgtccaggagctggcccacttacccacgcacgcgcccgtaacctgacacatatggctgtggctagtgacgtggcacctgtgcctgctcatcgtgctcaccttgggccagatcggattcaagggcaagaccgaggact

SEQ ID NO: 20371 - DNA, 400 bp, Zea mays
  Clone ID: cC-zmle18900027a01d1
cccacgcgtccgatttggtcgacggcttgtatgatccaaaatgaaaaccgtacggtgccccccctccccttctgttaggaatttagttagcaccgtttttagttgaaaacatgtaatcgctaaaattatatataccaatagtattggacgggattgtggaaactagaatccattactattctattttaatttttatatactttactgccgcaaaaaaaaaaaataaaaaaaaaaataataaaaaaaaaaaaaataaaaaaaaaaaaaaaaaaaaaaaaaaataataaaaaatataaataataaaataataatcataaaaaaaggggggggcccttttaagggttcaaatttttcttccccgggtttgcaaagtaaaattttttttattgggcccccaaaa

SEQ ID NO: 20372 - DNA, 361 bp, Zea mays
  unsure at all n locations
  Clone ID: cC-zmle18900027a02d1
ggcatattggagctagtcgggctcagctactctggatggtttgtgtaccgatacctgctttttcaggaaaaccggaaagaattggcgggtgttatcgatgatataaagagaaggattgttggcgatgatgaatagctgtttcctggtttgtaattctatttatctcgccctgtttggttctgaggaattgaaaaataatccaatggtgaagtgagaaagcactttctagctattggttttaattcatggggtccaaacaggctcttgatagaatctngtaggtttctgttcttaattaatgccaatcagagctacgaggtattggcctttnaaaaaaaatgccctattttctttcttgatt

SEQ ID NO: 20373 - DNA, 353 bp, Zea mays
  Clone ID: cC-zmle18900027a03d1
cgcataccagctggtcttacactagttctatatcgaactcttgaacccacacatgcttattaacatgtataggggcgacaccagcggggtggtcaccatggagcacaccatgcactacatcatgcaggacattagctggctcttgatcaggcattgggtctacctgggcgcgttcagtggtctcggtagtggtcacggatgagacgcccgcgcagaagaacgccctggtcattatccaggttatgaatgacggggcgtacggcgatgcgcatgagcaggccagtgacatcatcgtgaatctcaaggtgagcgtccggctgagcgagcgcttcaacaagatcatgcacaagcac

SEQ ID NO: 20374 - DNA, 316 bp, Zea mays
  Clone ID: cC-zmle18900027a04a1
catggttgtgttttttgacttttttataatctagcatttgtatttgtcattggtttttggttgggggaaaacaaaaaaaaccgcactccttcccaacaaacgggccagaggggtaaaaagtattagcctggtgtacccacccccaaaaccagggggcctccctgggggtctccctcactgccccataaaaaacctggaaaaaaaaaaaggcacctgtatcaataaagggttccacccccggggaaacgtttgcaggggaagggggggcctccccacaccaaaattttccagttgaaaaaacccacacctgaggggc

SEQ ID NO: 20375 - DNA, 593 bp, Zea mays
  Clone ID: cC-zmle18900027a04d1
tgggtttacccacgcgtccgctcatcgaagtccaaagatctttacatgagaatgcattgcgtgttgaggatctcccaaccaacccgtcttctcaatctgcatcacaccctccagagtcctctcaagacattagttcacaatctttgtcttctgaaatggcaattggaggaccaggtggactatggcattttatatataaaagcatttaccttgaccagtttgtgtcatcagaatttccctcacccataagtaacaaaaagcagaagaagggattgtacaaagcttaccaaaaattgtatgcatccatgcatgataaagcaactggtccacacaaaactcaattcagaagagatgaggattatgttctattttgctggataacccaggatttcgaactatatgcagcctttaatccactggctgataagactcaagcaatcaagatgtgcaatagagtatgccaatgggtgagggatttagaaaatgagatattcgtgtatggagaaagcaccctttcctggtgatatgctgtcctgtgtgtaataacttgttatgcctatgttacattttttttgtgaaaagttttttgatgt

SEQ ID NO: 20376 - DNA, 265 bp, Zea mays
  Clone ID: cC-zmle18900027a05a1
cggggtggggttttattcctttaattttttttccgtttcctttttgtttttcctctttccctggggggagacaaaaaaaagggccccccccccctagaaaaaggccaaacgcgtaaaaaattaaatcccgttaaaccaaccccaaaaaaaaacgggccctaccctttttcccgcaaactacgcgaatcaaaaactcgtcaacaaaaaaaattaactgcggtaaaaaaaagtgcccccccccgggacacaaaacctggggaagggg

SEQ ID NO: 20377 - DNA, 458 bp, Zea mays
  Clone ID: cC-zmle18900027a05d1
attttgggttgccacccgtccgctatcgagtcctagatcttacatgggaagcattgcgtgttgtggatctcccaaccaacccgccttctggatctgggtcacaccctccagagatctctcgggacattggttcacaatctttgacttatggaatggcatttggaggaccaggtggtctatggacttttatatattaaaacattaaccttgaccagtttgtgccctcataattggcctcacccataagtaacaaaacgcataagaagggattgtacaaagctttcccaacattgtatgcatccatgcacgatcaagcaactggtccacacaaaactcaattcacaatagatgaggactatgttccctcctgctgggtaacccacaatttccaactatatgcagccttttatccactggttgttaagactcaagcaatctttacgtgccatagactatgc

SEQ ID NO: 20378 - DNA, 480 bp, Zea mays
  Clone ID: cC-zmle18900027a06a1
attaccagacaaagctttatgattcaaaacgggaacagtaataaatgtgcacaatgattacggtcattatcatcatcctaaaacagcagcaacaaatgccactaataccataccaggttacaagcagagtcttcaccgacaaacgcaccacccactcatttcattccgagcaaaccaaccaccggacttagccccacatacacaaacaatccacggaggaaaatcaaaacagagcctagcagcatatataacaagagttctgacaaaccgccccaatcatggggccaacagtttcatcgtcgccacatttattagtcgctgatagcaggcgactccgaccttgaccgtgacccaagaggtgacatggacgctggccggggtgacctatgatgaccgcgccgaggcttcttattcttcttgcctgctggggacctctttctctcataacgaccattggcttgaccacggcgatcatttatt

SEQ ID NO: 20379 - DNA, 452 bp, Zea mays
  Clone ID: cC-zmle18900027a06d1
ttttgggtttacgcacgcgtccgcggacgcgtgtgttccgcatccccgggtgaagcagcatcggtgttgtctgtagcggtaccggctcaccagtgatgccaggaagaatggggaggtacagtgctgcgttcaggcccttcgtggttaggacatggcggcaggggaaggagcccaccttccatgagaggatatggcggtggccgaggtgaccatggctgtgtgaacctcctggttcgtaacattccattttgatgcacgcctgaggaactacgtgtccctttctaacggttccgtcctgttcgggatgtttacctgccaatagattatcacactggggagccaatatgatttgggttatgggagattggctatgcttatgacaattctgaggttcagtaccacatgaatcgtctgactgttgctgtgcgtgaaataactgatgtgcttgctgc

SEQ ID NO: 20380 - DNA, 418 bp, Zea mays
  Clone ID: cC-zmle18900027a07a1
ttttggattttaagtaccaaacatacttttttgatggaaggcgggaccagatatatatgtgctcactgtttacggagacaatggtcctcctacaacaagttgactgggtgacaataatcccataccatgataaactcggagcattctcctacaaacgcatcatcctgtgattccataccgagcacccgcgcctcgggatcttaggccccatgctgatactatgaagggtggaaacctagcactgagcctagcaatacatataactagagtctggacaaccgtcccatatctggggacataagaatccatctgcgtcacattaatctgtccgtggctacaagatactgcgttcttgaacgagtcccatgaggggtcctagtcacgggtcgcggtgacctgtgaagatcggtgggtggat

SEQ ID NO: 20381 - DNA, 331 bp, Zea mays
  Clone ID: cC-zmle18900027a07d1
ggttgacccacgcgtccgagggcccgttggtgatcgatccgatgatactgatggataccttttgcttggcgtggaaccggataacaaacggtacaaggttgaatggtaaggctcagttccgcggtcatatttgaactgagcgggcatgatggtatgagatggaccccaccctccatgataaggagttggccatggcataggtgaccatggttatgtctatcaactgagccgattgattttattgcaatgcatgcctgaagttgtacatgtcatttttgatccattttgacctgctagggatgtcattccggctacagattatcacactggg

SEQ ID NO: 20382 - DNA, 428 bp, Zea mays
  Clone ID: cC-zmle18900027a08a1
ttttgtattttttgttacaacgggcctatcaaacccgagcattactctaaaacaagcactaagtgcctaacaaggaaacatgggcccccccttttaagacagaccgtatgacaataattattacaccctccttacacatgaaacaggattatatactgcacagcgcgtccaatctaaccctgaccagggggtcccaatttttgtgaccaggatgagattgctagggcgccgtaacactgcacggtttcctagcaacagaagtgaaaaacgtttattcggacgtaacattggaccatccataagcacaaacactttctgacttagcacaccaatgtttcaggattgacagatgacgaacgcggaacatgggggtggctacccgagagtctggaattgcgagatatgcttgtgccggactcttggatcta

SEQ ID NO: 20383 - DNA, 405 bp, Zea mays
  Clone ID: cC-zmle18900027a09a1
gtatggggccttttagaccggggggtttctctcaaacaagcactaattgcctaacaaacaaaattggacgccaacttttaagacagattttatgtgaataattattccaccctcctttcacatgaaacaggattatctactggacattgcaaccaatctatcgctagcaagggggttccaatttatgttatcaccattatattggtagggtgccaaccactggttggttttcggcgatggaagcgaaaaactttgatttggacgtatctttggaaaatccatagccaagagaactttctgacgtagctcacaactctgtaagctctgacagatgacgatcccagaacttgatgatgggtttctgaatctcagacattgggagatttgtttgtgcccgactcctgg

SEQ ID NO: 20384 - DNA, 382 bp, Zea mays
  Clone ID: cC-zmle18900027a09d1
gcacaagcaaaactcccaatgtcagagattcaggataccatcttcgagttccggaatcgtcatctgtcagagcttacacagttgtgtgctacctcaggaagactctgttggctttggatttggcacagctacgtccatatgaaagactctcacctgcgacgacaaaaaccaaacagtggatggcacactatcaatctgatgctgatgacagaaaatgggacccccttgctagcgctcgagtggtagccctgttcaataaataatcctgtttcatgtggaaagagggtggaataactatacatataagagctgtcataaaagtaggcgtccaattctgtgtgatagacactcatcgcttgtttgagagtaatggaggggactg

SEQ ID NO: 20385 - DNA, 389 bp, Zea mays
  Clone ID: cC-zmle18900027a10a1
cgctcggttccaggaaaagaagcgctacaagcttcacaaaacaaatgggaggttcacactttaggccggccggtattttatacaaacaaaaagcccctgcccgtgaaaaccagctagtggacaaaacgggcgcaccagacagtcggacccaaaggcctccgcacaaatgatagaaggcctagaccgggaaggggcgatccaccgttaggtcagcggcagggaaggaaaaagacctcgcttagtcggtccgaacggcatgttccgggggaataggaggagcccggccagaaccccaagaccgtctcatgagccaaaggacgctgccaaacgtggtggacgggttccaggggctatcaccaacgggcatccggtcggccccgttttcttgg

SEQ ID NO: 20386 - DNA, 435 bp, Zea mays
  Clone ID: cC-zmle18900027a10d1
acctccaccaatcctctgctgagatcgaaccaacaaaacggactcacctcggccatctgctatagggcgaatggttccccaccgagtctgcccaaccgaaggcactcgcgctatggtccctccattgctagggcccaatgacggctccgcagccgctactagagccacgcgactacctatgggccagtaccaccacgttgtgccgtacagaaagctgctcctccgggctagagggcgaggggccgcacctcgcactgaagatcggtcttccagggaccgacaaggccgccggactatgcgcggacacggagcacgccctggcgcacactgactatgtgcgtacgactctgaccggccattggcccgtgcctgacaggggcagcgccccccgcgggttgacctactccctataacgattcgcgaatctggacgggg

SEQ ID NO: 20387 - DNA, 184 bp, Zea mays
  Clone ID: cC-zmle18900027a11a1
ttttgacaggtttattgccaaaagccgcctcctctgatacatataaagaatttgtaatacataggtacaaagaactcttgggagaaccgaaaagaaagcaaagagctcttgtagagaacgaagcaaacgaaaataaatgtaaatctggaagcaataaaaatatcagatctagtccattggaagt

SEQ ID NO: 20388 - DNA, 400 bp, Zea mays
  Clone ID: cC-zmle18900027a11d1
gacactacaataagtgggatttctctggatcatccgatcggtttcacattcacactgtggtatgcacctgctggataccccccccttctaaattaaccgaagaacgctcccttggtcgcatcagcttcttatgctttataccctgctgagggtgattgcttgaggctctcgacctccgctgctgccgaggctgattgtgcccattgtgttgtggctggtcctacaagcctgagggaagggatgcccaactcgccctgtggataggcctcactgggagcgattactgccgctgtcgcccctcggacacgaacaacacattatcctatgtcatcttcacctcttatggtagcaaccatcattgatgtcaactgtgcactggtacgcgcaacaacacctgctg

SEQ ID NO: 20389 - DNA, 238 bp, Zea mays
  Clone ID: cC-zmle18900027a12a1
ttttgacttttttattgccaaaagcgtcctcatcttatacgggtaaagaatgcgttatacatacgtacaaagaactcttgggcgaaccgtgtggagagcaaagagcttttgaagagcacgaagcggatgtacctacacattgctctagatgcggtcaaaagatgcgatctggggcattgtacgagatattacggtagtagctgaccaccttagttcttcgaacgaaagttgatccatt

SEQ ID NO: 20390 - DNA, 328 bp, Zea mays
  Clone ID: cC-zmle18900027a12d1
gccactcgtctcagggcgcgtggtcttgttacgactttgctgttcctaataccaatgaggaatgcgatggctgggttttcagcccgtatgtacaaaccgaggatggcatgtatgattgcgtcaacttatcatgctgcacatcctgggctggctcataggatgaggaattagaactgtgctgttgtgcaggttgagtatgcactgaggattctggcttgttggaaccaccagcggggtgtgattgtgtaccaccactgtgcgtatcgcatgattggggcgatcaatggcactgtggcgcctctggctcggatgaggaatcacattatgt

SEQ ID NO: 20391 - DNA, 397 bp, Zea mays
  Clone ID: cC-zmle18900027b02d1
cagtggctgctagccgagacaggggatagattgagagaggcgcgcagatggcgacgccgtcgtcgtcgctttgctccagcttcgcctccctgcggaccgcctccatcggccacccccgtggcatcgccttctccacgcccaggaaggcattccatgtgagggcatcagctcgggtggacaagttctcaaagagggacatcatcgtgtccccttcgattctgtctgcaaactttgcgaagctgggggatcaggtaaaagctgtggaggtggcaggatgcgactggatacatgtagatgtcatggatgggcgctttgtgccaaacatcacaatgggacccttggttgttgatgctctgcgtccagagactgatcttccgttggatgtacatctgatgat

SEQ ID NO: 20392 - DNA, 282 bp, Zea mays
  Clone ID: cC-zmle18900027b04a1
caaccccatgcttataatagggttatttccccccggggccggggggaagcctaataaaaaaaaacgcgactttttttcgttgggcattataaaacaaagcattgcccggcaggaaacacacttaccgtttttttccatgcccccttgacaaaaacccaaacaaaaaccgacggtccggggttttttttgtccatggccacccccggcagtctgaaaggggcctttttctggttgagctgttgcttgaccctcccctttttgaagggggggaaaaggattttt

SEQ ID NO: 20393 - DNA, 465 bp, Zea mays
  Clone ID: cC-zmle18900027b04d1
gggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaatct

SEQ ID NO: 20394 - DNA, 338 bp, Zea mays
  Clone ID: cC-zmle18900027b05a1
ttttaatttattttttttttattatattattcatgataagagtgggggtttagtgattgaacatcacgcttttaaacggccttttaccacccggtgcctgggggtaatagcctaaaaaagacggcgcctttttattatcggcgattatatcaaactgcttctcccggtaggaaaaacatgatacactttttacctgcgcaagtttacgaaatgggaaaccgagtgggaggcccggctgttatgtgcaacatcggctcccccggattttttaatgggtggtttttgtggttgagctggccctttagcattctattcttggggggggggggaaggaactc

SEQ ID NO: 20395 - DNA, 498 bp, Zea mays
  Clone ID: cC-zmle18900027b05d1
ttttgggttgacccacgcgtccgactattttagactgcgagcggccacccggtcttaagagcggcatttacgcgacgccggtgatccagtgcagcaagggccccttcgacaagtacatgctgtgccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattccacttcccccctgtaccgggtggaaatatacctattataagcatagtggtgaaactcaaaaaacaaaaa

SEQ ID NO: 20396 - DNA, 418 bp, Zea mays
  Clone ID: cC-zmle18900027b07a1
gccctcacaacaaattaatataatctctgaaaatcatattcatgggggggcatatatttgcatatatattaacgaatctaagcctattcctacatataatatattacatccaccagaattaactacagcctttccaacaaaactgggctcaaaatcaccttccctcccttttaaatgatggtggtctccaaaccttaaaaaaaaaacatttccactctggtttttttctccttctttcttgggttgggcgtttttgcaaattaactgaacaacagccacaccaagtatgctcaactcaattacagctagtcttgacttttgaagaaaaaacatgttcttgtacatatgcaacatggttgttatccacacgaatggatcggacgggtatatatgtatttatgaataactagctagagcc

SEQ ID NO: 20397 - DNA, 427 bp, Zea mays
  Clone ID: cC-zmle18900027b07d1
gggtttacccacgcgtccgatcttttcctctccacaggcgactcccaacgcaacagcagcttgtcgtgcgagtcgtcgccggccggccggtatatacgcaagaaagccaagaaaaacacttctgcctcttcctccatatccaagaaccaaaggttgctagctagccgcgactcgttggctagacgattcaagcagcagcgcaggatggtggcgccggtggtgattgcgtcggccgggctgggcatgctggccggcgtggcgatggccaaccggtccctcgggaacgggctcccggcggcctccaagtgggacgcgcgcccgcgctgcgccacgtgcggcggctccggccgcgtggagtgcatatgcaaccgctggtccgacggcgactccggctgccggacctgtgctgggtcggggaggatgccct

SEQ ID NO: 20398 - DNA, 470 bp, Zea mays
  Clone ID: cC-zmle18900027b08a1
cccaacaagaatggggtaaagtttgacatgagcaccagtcggctacatagaaatagcagtaacgcgtccttcatttttatggaattacaaactacacatctgctaacaaactatagggaatatatacagcaacgaccaatacaattgccaaataactttccgactatatatgtacaccggaaattgggcatagctatgtaatctggaacgacgggggaacagctataatagtggtataagtctgcttcacctatgggtcaagaactaggacccccctgaggactggtaatgtaaaccagttcgttgcggtggagcggctgaaatatttcgcctcaccttatgattcttaggcgctaaaacccttgtggatagaactccaggggttggaaggaatgctggtgcaagcctgagcagcgaccttcgacactgcttcaagaaggatgccaacgttgcagatgtttgcgaaggac

SEQ ID NO: 20399 - DNA, 527 bp, Zea mays
  Clone ID: cC-zmle18900027b08d1
agtgatttccacaatctgcgaactgaatctctcaagcagcaatacaacttggtcaaggataggacagcggttcaggatacattcagctatggctcccatgtgatgcaatatggttcattggagttgaatgttaagcatctgttttcgtacattggcacaaaccctgctaacgatgacaacacgtttatagaagacaactcgttgccatcgttctcaaaggctgttaatcagcgcgacgctgaccttgtctacttctggcagaagtaccggaaattggcagacagctcacctgagaaaaatgaagctcggaaggagttgcttgaagtgatggcccacaggtctcatgttgacagcagtgttgagctcattggaagccttctctttggctctgaggacggtccaagggttctgaaagccgtccgtgcagctggtgagcctctggtcgatgattggagctgtctcaagttcacggttcgtactttgaggcgcaatgtgggtcgtcggcgcatcatgggatgaagcacatg

SEQ ID NO: 20400 - DNA, 402 bp, Zea mays
  Clone ID: cC-zmle18900027b09a1
cccaacaagaatggggtaaagtttcacatgagcaccaaacggctacatagaaatagcagtcacgcgtgcttcatttttatggaataacaaactacacatctgctaacaaactgtagggaatgtatacggcagcgaccaatacaattgccaaataactgtccgactatataggtccaccggaaatagggcataactatgtaatcgggaacgacgggggaacagctataatagcggcataagtctgcttcacctatgggacaagaactaggaccccgctgaggactggtaatgcaaaccagttcgttgccgtggagcggatgaaatatatcgcctgaccttatgattctaaggcgctaaaacccttgtggatagaactccaggggacggaaggaatgctggtgc

SEQ ID NO: 20401 - DNA, 405 bp, Zea mays
  Clone ID: cC-zmle18900027b09d1
agcgatttgcacattctgcgaactgaatctgtcaagcatcatttcaacttggtcaaggattggacaggggttgaggatacattcagctactggctcccatgtgatgcattatggttcattggagtatgaatgttaagcatctgctttcgtacattggcacaaaccctgctaacgatgacaacacgttgatcgtagacaactcgttgccatcgttctcaaaggctgtttatcagcgcgacgctgaccttgactacttgtggcacaagcaccggaaattggcagacagctcacctgagaaaaatgaagctcgcaaggagttgcttgatgcgatggcccacaggtctcatgttgacagccgtgttgagctcattggaagccttctctttggctttgaggacggtccaa

SEQ ID NO: 20402 - DNA, 400 bp, Zea mays
  Clone ID: cC-zmle18900027b10a1
ttttatcattgaaccataatatattaatcctaataaatgagatggctgacctttacctaaactttcagataaccaaacgttaggtaaaatagcacacaccgcagccatgtttgcatattaaataaaatgactctaccctacaggaccaaaatagcatatgaagtacatgacagttacttagagaaaagccctaactgcataagaaaaacaaatgcttagctgattatagaattttagtgaaaatgacgaaacattctgctctgcagaggggcataaactagcaccaccagaataaacttctaaggttacttcctctacggcttatatataccaagatttgtttattttactggacattggttcacctccaagggccacatatgttgaaggtggacaaacc

SEQ ID NO: 20403 - DNA, 412 bp, Zea mays
  Clone ID: cC-zmle18900027b10d1
aaagcctaccccaatactctgagggcgcttgccaatttgatctgcctcaccgtcactggcccgtccgtggatggggccgccccactctttaactccgctgtctccctatccacctcaccatctccgactttacccaatgctgttgctggcagtggtgcctccaacactggggatatgacacggtatgagagagggtgcgtgccaccgctcaagggtgcggtgacacatgctggctactgtgacccgccccactggtgacacaccgtcctggccatgttggtcggactcgcctgaggagggcctcgcccctcacgagcggtgtgtgtggccagcaccccacgctcagggctctaactgtgtcaggatcatgcgccaacacctagatgtgcctattgtcggtggcagggactct

SEQ ID NO: 20404 - DNA, 429 bp, Zea mays
  Clone ID: cC-zmle18900027b11a1
aaaacaataacactataataacaaatgggagctttaacaatcaaataaaccttgggacaaccttttgtaaagcaaacccttttgagttcaattcatgcaggactactatagtttaggacataaccctactacaccaaaagtacccaacatgggcatctaatttacacagacgcctagcccttgtatctcttaaaaccataagagaaattgaggaatgtcggattagaagacaccaaacctgttatctgcgaataccgcaaacgcataatccttcatggtctcaccatcaaaaaattggcggtactgcatattgctaccgagaaacttggatgtaccctgaacaccctttatgtacaaaggcaatttatgtggctcgaacacaaacctgaaaaacatcctgaatttatcgttggaagacacatatgattt

SEQ ID NO: 20405 - DNA, 453 bp, Zea mays
  Clone ID: cC-zmle18900027b11d1
cggaattttcgggtcgacccacccgtccggtgtcaatccatacgacgagggtggcgagggccaatgtgttttttacacacctgtcaaggtggttcatattggggacacattccctctacaggtgcgacctccttctgacaagaaaaccattgtggcctacatcaaaaaatgcatcaggaatcggagtgttgagcaggggccatataacgcggttgaatacaaaaagggtgccacgggtgcaaccaactttgtccttatcaagctgagggacccccaactttttgttggtgactccatcaaggatgatgcgtctgccgtatgaggctattactaggatggtgccactaatgtcgacattcctacatttctctcacggtgctatagagatcacgtgctcagcgtgcggacaaattagttacccatgttgggtgctatctatgtactaccattata

SEQ ID NO: 20406 - DNA, 324 bp, Zea mays
  Clone ID: cC-zmle18900027c02d1
atttttacttgaaaaatgagaatcctttggaaaaatggagttaccaaactagactaataaaatttatttatgtgaccaggtgaaggccatggtgttgagagataagatggaagtctcgaggcgaggaccatattgtggtggtcttggaggaatatggtttgatggtgacatgcaaattagactatctgtccgaaccatagtattttaaacaggggctggccacagcacgatgtacttatacttagacgcatataggtgtctggagtgggtcgatcatgttaacgctggtgcacgcattgttgactgcagtagcccacatgacga

SEQ ID NO: 20407 - DNA, 412 bp, Zea mays
  Clone ID: cC-zmle18900027c03d1
attttgctttccttatctatgaacagacacactctgcgttgtcaggctgtatagtacaaaaagaaaagatatggtccgcatgtgcaaactatgatgattgccattgctagacctcgcggctaaagctgtctctagcagtaagcctctctctagcaccgtgcgttatatcaatcttctagaccccgtggttaaggctgcctctagcagcgctatgtcttttacattctcttttatgcagttctctctaaaagattcatcttttgtatcccgttcatcttcaacgacgtgttgtaggtcttagttgccgacagtagccctcatgacgaacaacgtgaatgcgagaataaagctgaatgcactgactaggtccattaattcttgagaagacagggggggccggcttaaaggatcc

SEQ ID NO: 20408 - DNA, 264 bp, Zea mays
  Clone ID: cC-zmle18900027c04a1
acgccctctctcttttttttttttttttatttttcttttattattatatattatttgggttggttttaatgttttatttatgttattttttaaattgccacccaagccacccagtgacactaagccgctgagcgacactcaaaatttctcaaccgagcctgggagctaaccaattttcccaataaaggattacaacaaaacatagggtcctcaggggaaaaaaccgtcccctgctgaaatagaagggcagggacctatccgaat

SEQ ID NO: 20409 - DNA, 387 bp, Zea mays
  Clone ID: cC-zmle18900027c04d1
tttgggtttacccacgcgtccgcggacgcgtgggctgacgcgtgggaaaaaaactataaatagtttaattttataaaaaaaaaaagataaaaaatggacatggagttaataataataacaataaaaatccatatacggggcggctcttgattggatccacccttcccttcccttgtcatgtaacgccttattttttttttatggcccccttattttaacccacggtccggctttttaaaacatgggaattggaaaatccacggggttacctaactaaatggctttggttaacatccccctttggccagagggttttatagcaaaaaggcccccactgttcccctttcctaacagttgcccagcatgaatggggattgggcccccccc

SEQ ID NO: 20410 - DNA, 406 bp, Zea mays
  Clone ID: cC-zmle18900027c05a1
attattgggggggggttttttttttttttttctttttttttttttttgcaaccccaccccccaagcgagcctggaacggtggggtcaaccgggaaattccgaccggggcccgggtggaaaccatctttccctttagggggggaatataaaacctggggcacaaaagggaaaaaatatattccgggggaaaatggaggcccgtgacaattccagaaaaaaaagcaacccgaaaaattaaataaaaaagccggggggcccaaacggcacccccaaccacattaattgcggggggcccaacggcccttttaaaaaggggaaaaccgggcctccacacggataaaaaaaaacggccacccccgggaaaagggagtttgatatggggccccaggaggttttttttttttcc

SEQ ID NO: 20411 - DNA, 415 bp, Zea mays
  Clone ID: cC-zmle18900027c06a1
gaacggaaagtaatacgggcccaagatagttaaatttgggcagggctatacatgtagattaatttgaagtttaatcaaacccgtaattcataaaactatactactatgtagcaacagctgggtgtgaaatttaactttacattctgagagagtactatgtagcaacgctttgatcgttcgtttgcccactcgttgtcgctggccttgtttgcaaaatcctccccttacattggtctcagatcctaaatgggatgagcggcgtggagtttgacaggtaccccgccggggctgtcacgccgctacctaatttaactgggtaccccacattcttgagcaccatcttcacaccgtttaaacattccaaaatttgccacttgttgaggttgcccagatggcccatccttgaaaacctttc

SEQ ID NO: 20412 - DNA, 371 bp, Zea mays
  Clone ID: cC-zmle18900027c06d1
ggtttacccacgcgttcgcggacgcgtgggctgacgcgtgggccatgatctgaccgaacttcattttaagcgccgaggtcgccaggtacgcgtgggggcggtacaacctcactctcgggcttagtctgacaagaacgccgggtaggttctcatgatcggtcatctcaggaacctcaacgagctgcaacttctgggacgcctgagcggtgtggagatggtgctgaaggatgagggggacccagtgaaactaggtagcggccggtacagcctgtgtggcgtacctgtcaaatatcacgccggtcatcccatataggatctgtgaacaacggaaggcgaggatatcaaaagcaaggccagcggctaccagtggg

SEQ ID NO: 20413 - DNA, 448 bp, Zea mays
  Clone ID: cC-zmle18900027c07a1
gatcggtaagtaatacgggcccaatatagttaaatctgggcagggctatacatgtagattaatttgaagcttaatcaaacccgtaattcataaaactttactactatgtagcaacagctgggtgtgaaatttaactttacattctgagagagtactatgtagcaacgctttgttcgttcgtctgcccactcgttgtcgctggccttgtttgcgatatcctccccttacattgttctcagatcctatatgggatgagcggtgtggtttttgtcaggtaccccgccggggttgtcaccccgctacctagttttactgggtaccccatattcttgagcaccatttccacaccgtttaaacattccaaaagtttcaactctgttgaagttgcccaaatggcccatcctagaaacctttcccgtgatttttttaggccctagcccaggttgaa

SEQ ID NO: 20414 - DNA, 343 bp, Zea mays
  Clone ID: cC-zmle18900027c07d1
ttttgggttgactcacgcgtccgcggacgcgtggtcggtcgcctaggacgtcctcgtgccgaactttcatcttctgcgacaaggtgttaatggacgcgtgggagcggtacatgctcagcctcgggctcggcttcaacaagatcggcgagtaggtcttctggatatgccatctagggatatttaacgagctgactctattgagatgtctgagcggtgtggagacagtgctcaaggatgtggggaaccaaatgaaactaggtagtggggtggaagccgtagcggtgttcctgtcaaacattaagcctggtatcccatataggatttgataaaactgtatggggag

SEQ ID NO: 20415 - DNA, 399 bp, Zea mays
  Clone ID: cC-zmle18900027c08a1
gatcggtaatttatggcgggggttatatttttaaattttgggcatgggcttatttcatgtatattattttgatgtttaatcaaacccaaaaattataaaattatacgactatgaaaaaacaaccgagaagcaaaattaacggtacattctgagagagaacgagggggtaaaactttgttcgtccttttgcccagtaggggaaaatggccaaaaataaaaaaaactccccttacattgttaaaaaaccccaaaaaggaagagcggagttgtgtttgaaaaaaacacaaacggggaaaacatgccggtaaaaaaaactacttgggtgccccacaaccttgaaaaacatcaccaccccggtaaaaattccaaaagttccacctttttgacgtcccccagaag

SEQ ID NO: 20416 - DNA, 447 bp, Zea mays
  Clone ID: cC-zmle18900027c08d1
ccgacgcgtgcggacaccgagcacgtactaccaggctgatggtggcgtactccaaattcaagcccatggaggagtggtggtcgtacgggctctcgcagcagaccgggttctcctacctggacggctcgctgttcatgtccaggaatgcgttgccctactacctcctagcggctcttgtgggcggcagcgttctccgcaccgcgctgttggtcctgtccgtgccgatcatatacggtacctacgccgttttctccgaagcgctggccatcaacacgctggtgtacatgtccatggcggggctcaaggtgcgcatgatccggatagcggtgcgctccgggctcaccacgatctacgcgggcgacgagcacaccgatagctggagggtgttcatctccttgggcaggcgctacgtcgtcacggccagcgctagggtcatggtcgagccct

SEQ ID NO: 20417 - DNA, 461 bp, Zea mays
  Clone ID: cC-zmle18900027c09a1
aaaagttcaattggtttttggacaaatttcggattaatttgaatagccttaacattgacccagatctggattcggtacaaacgtaagactcaaaaaacactcgtcgttaaaagcccagtcaaacgaaagcggtaaacacgagacccaactacaatttgtacaaacaagcaacagtgatctctcattaatccgaccatggattcttgtgctccgggatgtccggactgagcctctccttgccctttcccttcccactcccacttccactggccgaaccattatcaccaataatcctattctcccaaggctgctcgtggcccgtaatatcaaacccaggcttatcgcccacagcctccaaatcatcggtatcgctgtcccccacggcgaaaggcttggtgagagtgtgcgtcgaaacagtgctggcttccttaggcttatccggattgaaaccggtgcggacc

SEQ ID NO: 20418 - DNA, 276 bp, Zea mays
  Clone ID: cC-zmle18900027c09d1
ccgacgcgtgggcggacccatcacctagccaccaggtaggacagtggcgtgtcccataatcaaccccatggacgagtgctgttcatacgggctggcataacatacggtagacgccgacctggacggtactgtgttcatgttcaggagctcgatgcaatactacctcctcttggctttcgagggcggcagtgtcctgcgagcacagctggtgctgctgatggtgccgatcccatacggtacctacgcctcactcttactaagggtggccagtaacac

SEQ ID NO: 20419 - DNA, 233 bp, Zea mays
  Clone ID: cC-zmle18900027c10a1
aagcacgagcgggatctgatcaaattaggacaaactatgaatccccatacccttcacccatatatggtttttgagcattcgaaaacatgacaacaatctccgctaagagcaaactcaaaaaaaagcggcaaacaccaaacccatcctcaattggtgctaacacgctactatgtgccatcatcaatccaccccaggaatagaataaaacgggaagtccggaccgctccttttgc

SEQ ID NO: 20420 - DNA, 54 bp, Zea mays
  Clone ID: cC-zmle18900027c10d1
attttcgggtcgacccacccgtacggagacgcgtgggctgacccgtcaccggac

SEQ ID NO: 20421 - DNA, 442 bp, Zea mays
  Clone ID: cC-zmle18900027c11a1
gtaggtgcgggatcttatttattttggacaaactatgttgccacaaaccctggactcatctaaggttattgagagggcgacaagatgacaacccttttagctatgaagaagcgcatgaacaacttgcatagaccaagctaatacttgtttgatgctaaagcgctatatattgccacaagcaaaccaccccggggagagaataaaattgagagtccaggacgctcttttgcttgcttattgactgctcaagttagttcagaagtggcaagggttttcctagccactagtaacttattgtggtcgagttttgggacactaatctaggcgcaggctacattgcttgggcaatgattcttacctgaaggatcattgccacaacaaaggtgagttggaaaatagcataacctaatcgaactccacctgatgctgaagctactggcat

SEQ ID NO: 20422 - DNA, 417 bp, Zea mays
  Clone ID: cC-zmle18900027c11d1
gccacgcgtccgatgtgaaaatccttaaacccatccattatgttgtcaaagcacgagctaaaatgggggagaggggaaactatgatccttctatgagatgggcactgagaagctcctctgagcagatactggttctcccaacggaatcaagggacatgcttccagacatcaccttattaggaacagttcgtcacacacttactttgtcagattagatgaggactagcatatctactggaagaggaaggagctgatattatccataccgagggtggcaaatgttctagcccgcctgaacctggattgcgtggattagaatgaaaaggcaaaaccaacactgcgtggagcatacttacatctctcgggctgctagtattccactgttgtgcttgtcacggttaacctcggtgactgcac

SEQ ID NO: 20423 - DNA, 534 bp, Zea mays
  unsure at all n locations
  Clone ID: cC-zmle18900027d01d1
cccacgcgtccgggctcgggttcaggaggtacgacgacgccggcagcggcagcggcaggctgaggtgctttgggcactccgggatgggcggctcgaccgggttctgcgacgtggagaacggcttcgccatcgcggtgacggtgaacaagctgtctctgggcagcgtcacgcgcggcgtcgtccggctcgtcctcgaggagctgggcctgcccgtgccggacgagtactcggccaccggggagaaggggcctgacatgatgctcaacctgacgacaacgacgacgactacgccgccgcaactgagatgacgacggcgaaactgagattaccaggttgggttcgtaataatctgtggaacaagatatatagcgagcagatggaaggtggggtacagnggattggtggacagtatatatacgcgtgccattttgattttgacgtggcatgtaaaactcggcaaattctggtatattacgaagcttggtgctgggaataatggccagcagtacaagaaatggacatgctagtttgttg

SEQ ID NO: 20424 - DNA, 465 bp, Zea mays
  Clone ID: cC-zmle18900027d02d1
cggaattttcggggcgatctacccgttcgttcttaccatgtttagctttaactggaaccggatattaattttttatagcgctccatgctcatgaccaacatagggcggggtatgaacaaaaggacctatacgacacttattaacatttggtaggttgtctctaaacggattactgggaatacccagtattggtgaatgacgaccaaaaggtatttctgggctcacatgttcaggaagctcttgatgagctacaacaaaccatgatgggtacataagctccactttttgaacttgacggcgggaaacgagacgaacctgggcttgccatgtttgaaattgacttgtcacaagatgaacctagcggggggggcgagaaaagtttctgacttgccgtggacaccaaccgcaagggccaaaactgctaaaccatatgcggaaaaagccccattttaaccgcgtgctcta

SEQ ID NO: 20425 - DNA, 463 bp, Zea mays
  unsure at all n locations
  Clone ID: cC-zmle18900027d03a1
cgcgtacgcgagcttggattcgtgtacatcagacgcgcctcgnccttttttttttataattatatttcaccacaatgtatatatgtacaaggtggcagaggattcatagtctgtccttattaacaccccacgtttgatgtgctccagtgcgtgctgcaacactggccacaaagaaagtacacctgttacaaagaacacatttgcatgcgaatcaagcctaccggtttacagccttaccgcccgttaacaataatatagctatccgtttatgtcaaaaagaaccgcttgcttaaatatactaggatttcttatctgaaggattgtccacagtctatgcttgaattgggttacccagcattggtgctggccttatatggcaccagggtgtgtttttttttcagcgagtgccttcaaacccattcgggcacattaaaaccaatttgggggaactttttcggttctt

SEQ ID NO: 20426 - DNA, 470 bp, Zea mays
  Clone ID: cC-zmle18900027d03d1
ttttgggttgacccacgcgtccggaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctgcttgagatgggttataaaaaccctgttcttttgctccatccactgggaggattcacaaaagcagatgatgtgcctctttattggagaatgaagcaacatgagaaggttcttgag

SEQ ID NO: 20427 - DNA, 422 bp, Zea mays
  Clone ID: cC-zmle18900027d04a1
gggtggggttttttttttttgaaagacaacggtagaattgacaatccaaccaccgatgggggtaatttttaaacgggtcaaggtccgcgcttgagggggggaaaaaaaaaaaaaatattttgggccccccaactcgggaaataaaacaatccgccccaaatttggggggggtggggccatcccaaaatacacccaatttttaccccggaacggtgtggtttgaaaaggaaacggtaattgccaaaaccactataaactgccttttgccggaaattttcttggggggaggtctctgtttctgtttaaaaaacaaaaccacccggcgcatttttttgcgggaaaccaagaacgcggggggaggggttcctttatgcaacgggcaaactcccaaactaaaaccactgcctttgggaatttggggg

SEQ ID NO: 20428 - DNA, 521 bp, Zea mays
  Clone ID: cC-zmle18900027d04d1
tttgggtttatcacgcgtccgagtacgtgaacgagggcggcgccatggtgcccgtccgcgtgctcaccgtgctcatctgcacccagcacgacgagaccgtgaccaacgacgagatcgccgtcgacctcaaggagcacgtcatcaagcccgtgatccctgagaagtacctcgacgagaagaccatctttcacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgtctagagcatcgtggccagcggtctcgcccgccgctgtctcgtgcaggtgtcgtacgccatcggcgtgccggagcccctgtccgtgttcgtcaactcgtacggtaccggcacgatccccgacaaggagattctcagatcgtgaggagaacttgac

SEQ ID NO: 20429 - DNA, 556 bp, Zea mays
  Clone ID: cC-zmle18900027d05d1
attttgggtcgatcccacgcgtccgggcacgtgaacgagggcggtgccatggtgcccgttcgcgtgttcaccgtgctcatctccacccagcacgacgagaccgtgaccaacgactagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggttggggagcccacggcggtggcgccttctccggcaaggaccccaccaaggtggaccgcagcggcgcctacgtggccaggcaggccgccaagagcatcgtggccagcggccttgcccgccgctggctcgtgcaggtgtcgtacgccatcggcgtgccggagcccctgtgcgtgttcgtcaactcgtacggtaccggctcgatccccgacaaggagatcctcaagatcgtgaaggagaacttttacatcaggcccgggatgatcagcattaacc

SEQ ID NO: 20430 - DNA, 383 bp, Zea mays
  Clone ID: cC-zmle18900027d06a1
ggggaaaaaatgggcaccccctggatgggtcaaaaaaaactttttttgtatactcacccggcaaccccaacttttaacaaagagttacggtggacccaggttccctataataagtgtggaaaaaaattgggcttttacgggtaaaggaaaaaacggggggggtgtccaaagaacccttttgtgggcggcttttttcggttgtggttccgggaaaattcacccaaatgccttctgaggggggggggagtcccctcacttttcgggcctgagcccaaggggactacaccaacagaaccccccttttttgtgtccttctccgggggcgtggataaaattttggcccggcaactttttttttttttggggaataaagaaaggggggg

SEQ ID NO: 20431 - DNA, 519 bp, Zea mays
  Clone ID: cC-zmle18900027d06d1
tttgggttgacccacgcgtccggtagattgaaagggaaatggagtatttggcgaagacaaggcttccactctaacggtctagccgaaacaagccggagattgatccgccacatgcccacatcggactaggaccagccgaacaaccattcccaatttctccgccgccaaggcacgaagccggagcacgatggcagccaccacgaatcggtttcccccacgccatgtcctccccctgcatctcgcaccagtgcaccaccagcagaacaaagcagtttgatgaatttacctcaaggctgctagaaattcatgataagatgatgtctataaatacgaaagaggatatacacttaggattgcaccggtctgactatatgctggattcttaaaccaattcactacttcaaattgagctcaacactatcccatcatccttttctggccttggctcctttgtcagggaactttaaagtttcaggttggacaaaatgatattccaccaaaaagcatggatgccatgcg

SEQ ID NO: 20432 - DNA, 387 bp, Zea mays
  Clone ID: cC-zmle18900027d07a1
ttttagtattaatttttttattcaggtataaagaatcttggaacatgttacaattttttgtcgataaatagcggatgatcctctatgatgaggtcaaacaaatcatgaatatacggaatcaagaaagcttgacacagtcgactctgttggcatttcacccaaaccccgggcacatgctttggaaaccacccaattcagggcacaggaaaattattggttcttgaaggacatggaaagggcctcataagagtcctctacaacccctttaatatccccaggtatcgttacagatttcaccgacaaacttctgacggaggtgagggcacttcacaaagtaattgatctgctgtcattgtactgaactttttccacatttttcttcatttt

SEQ ID NO: 20433 - DNA, 218 bp, Zea mays
  Clone ID: cC-zmle18900027d07d1
attttgggttgacacgcgtcggacaggagcgggtgaagcagagtgcgatatcatgcttagctatgcctcatgccgatcctggcggggtttggcctgtcttacccacacggtctaaggcctggcttgtacggttttattggtggctgtcaaagcacttctctgggccatataggttcctaatgatcgtgcttatatagacgaagtgatgcatatgaata

SEQ ID NO: 20434 - DNA, 78 bp, Zea mays
  Clone ID: cC-zmle18900027d08d1
cccacgcgtccggactagttctaaaaaaaaaaaaaaaacaattttaagggcggtcgcctctcaggactacagggggct

SEQ ID NO: 20435 - DNA, 397 bp, Zea mays
  Clone ID: cC-zmle18900027d10a1
gttcaggaacacaaaatcaacgctgcgagatggagtttttccaaacttacaacggtttgtttcatgcggtactgtgtagtcgaaacaattatttcaccaaatggctgtacagataaaatttaaggcatgtgctctctatattggagttatatcaaattcaaaagggccccaattccaataatttacaggggcctctgttctttcataaagggtagttgagggggtctcgctgcagcaccttttgaaccagcttcgtgtgctgctgggcgtgcaccgaatagaaccccgtggtggtatcagtcgacagggccctgccgaccaacttgatgttctcgatgccaccccggcccagaaactttatcgtcgtgcgcaaccgcgggttgatgtacctcggacg

SEQ ID NO: 20436 - DNA, 400 bp, Zea mays
  Clone ID: cC-zmle18900027d10d1
agcttcatgaacccgaggttgctgacggcgatgaaggttcttgtccggggtggcatcgatgacatcaagtacgtgggctgggccccgtcggctgctaccgcgacgggcttatactcggtgcacgtgcaggagcagaccgagctggtgcagaaggcgctgtagcgcgaccccctcaactaccctttctgaaagaaacgaggcccctgcagattcttggaattggggacctttggaatttgatataataccaatctatagagaacatgccttaaattttatctgtgcagccatttggtgaaataattggttcgactctgcaggaccgcatgaaacaaaccgttgtaagtttggaaaaactccatctcgcagcgttgattttgtgttccttagggctcaattt

SEQ ID NO: 20437 - DNA, 418 bp, Zea mays
  Clone ID: cC-zmle18900027d11a1
ttttagaataataatacgatcacaataatccaattgagagatggtgtaattacaaaaatacaatggacagcagtatgcgaatctgacaaagctactgaataattgtggctctgggtcaatcctaaaaaagttaaggcttgggcaccatatcaaggatacctgtcaacccaataaagtccccaatttcaaggaattcacaagggccaatatacttgcataactgtcagaaaaagggcattcacatactcataaattggaaaatcttggttatcacaagatgccaagtctaatctaaaccattcattagggtaagctgcggcgccagttcaacaaacttgattagcttttgccagcctggcccacagtcttgaggactccataaatccgacaagtgatggaagacggatacgaacaggga

SEQ ID NO: 20438 - DNA, 90 bp, Zea mays
  Clone ID: cC-zmle18900027d11d1
tactacatttgccatccactgctgacttaaacctattgattggtacaagggcacaaagaactcattgagtacaggaacctgtccgctata

SEQ ID NO: 20439 - DNA, 426 bp, Zea mays
  Clone ID: cC-zmle18900027e01d1
ctcgcagcaaggcatcggcgtgccacacaagccgtgggatgtttcccggagagcgagcatgaaaccgcaacgagcaggaaaatcctagtcgggcgaacacctttccgctgtgtaaagtcttgtatatctggtttcttgaccacaggagtttttgtataggtagcagtactgtagcccttttttcgtgtttgtcacccatatgttgttttgggatgaaaagtaggcaacggtccgtttggctgttaaacaatcatgtagggatacttggtagataaaaccaaaggggtattggacatgcagttaggaattttagtttctggcgttcattgcgtgatgtagtcgagttgattggtcggcccgccatgcaactttaataatgttacttatattggaggcctgtgcattgatcatatcccattttatttc

SEQ ID NO: 20440 - DNA, 508 bp, Zea mays
  Clone ID: cC-zmle18900027e02d1
caatgtgtgtctgtatgttctgaactgtacaagcttatcgagaaagagcactgtgagtctacaacaatccacacccaacacaggcggtggacacaacccatccaataatctttcatgagtacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagccttctccttctgcgcctcgaggttggcgagcgcctttacgagctcgggcttcacacgggtgcgcccctcgtccagcttggccttcagctccgcggtggtctcctttttcatcttgttaagcgccgccgcgatcttggcgcgcgccgtctttatgatggccgccgtctggtccttcaactggtttacctcctggaggcgcccttgacatcgtcg

SEQ ID NO: 20441 - DNA, 380 bp, Zea mays
  Clone ID: cC-zmle18900027e03a1
gcacagaaatcagtttaacttaggatagattgccattttttgcgttctggggcaccattacaccacatgctcataggttcgacacatcattcacatcccaaactcaaacttcataattcattcaaacacagcaatggagcccacctacatactaaagtaaacactggagcaaacgtccctgacaccgcaaaaaaaggcacagtttgcggcttgataccttaaatctcctggacagtcaaacctggcgggagcgactgattgagcttgttggccttgtcggagtcgtggacccaaagggtgtagaggtacctggagcagcgcaccttgaacttgacggggtccttggcccgtttgatccgaaccgaccgcgcgttctttcg

SEQ ID NO: 20442 - DNA, 402 bp, Zea mays
  Clone ID: cC-zmle18900027e03d1
tttgggttatcaccctccggcacggggtggacccggtcggcggatcaagcgggccttggacgccgcagttcaaggtgcgctgtgcaggtgcctctacacccttgcgtcacgactccgacaaggccaacaagctaagcagcgctcccgccaggtctgactgtccaggagatttaaggtatcaagccgcaaactgtgcctttttttgcggtgtcagggacgtttgctccaggttactttagtatgtaggtgggctccatgtgtgtttgaatgaattatgaagttggtttgggatgtgaatgatgtgtcgaacctatgagctgtgggtatggaccccaaacgcaaaagaggcaactatcataagttaactgattttgtgcaaaaaaaattgcctatactctcgtg

SEQ ID NO: 20443 - DNA, 266 bp, Zea mays
  Clone ID: cC-zmle18900027e04a1
cacagaaattataaccaccggggaacgataaccaccttttttgcacaaacatggtttatcttaatgtgcaacgccaacttataaattatacttgtctatacaatgcaatgtgaaataaaaaaaacacatgcatttttcagcatcaatctattcaggtacatacacccttttcgttcccaaagacaatgaaattgggtatcattgccggtgagctaacttgcccgggacaaaatttgtggcctgggcccatgccttgtttttgactg

SEQ ID NO: 20444 - DNA, 369 bp, Zea mays
  Clone ID: cC-zmle18900027e04d1
tttttgggtttaactacccgtacggccacgcgtacgtccacgcgttcgcccacgcgtacggcttctttgtccatgccatcgtcaccggtaagggcccggtcgagaaccttgctgatcacatcgctgacccagtcaacagcaactcatgggcctacgtcacctacttctttcccggctactaagctcaacggctatgctatgcaacttcattgtctttttgatcggaaagggtgtacgtacgtggattgattgatgctgcgagatgcatgtgtctcttttgtttgaccttgcattgcataagcttagtctagatgattagttggcgttgtacactaatatgaaccatgtgtgtgctaatagtggtggttt

SEQ ID NO: 20445 - DNA, 322 bp, Zea mays
  Clone ID: cC-zmle18900027e05a1
tttttattttttgtttggcacgggacaaaacatgcgcccgggagaggattcccagcagcaacgctcaaagcctgtgccatataaacaagaaaaagcgctgcttattacgggttgtctgagacaacttgtttggaaaaaataacccgccaccttgttgctacatgaagaaaataaaggagatacagcccccgggataagaaaaaaaaagaactgatgatcctttctcacaaataacataattcccatacaacaatatcagatcacaggtcaccgtgcgttgctaacaagacagcctttgcaaacagcaacagcttcagaaggg

SEQ ID NO: 20446 - DNA, 408 bp, Zea mays
  Clone ID: cC-zmle18900027e06a1
gatgtcgcgtacgaagcttgatcctatagagcggacgcgccctcccgctcccggctcctctcctttcccgcgccgggaagaacgcagccgtggccgccaccttcttatccctgcgaggccggctatcccacgctcacaccaggaagctctcctccccgttccttggcgcccccgcatccttactccggtcgctggctcccacgcccgtcggcgggcgatactcgcggaggacactcgccgacggggccatggcgcctctcatgccgggaggaacgcccaagaaagcggtgggcgtaacaaagctggcgctcgacgcctgtctggccaggcctaagccgtccgtctgcccggcggtcggcgcccagggagtcaaactgcctggggctctgcaaggtgttctatgccaac

SEQ ID NO: 20447 - DNA, 462 bp, Zea mays
  Clone ID: cC-zmle18900027e06d1
gggtttatccacgcgtccgctgacgcgtgggcggactcgtgggttccagagctggcccatttttactttgttctgtacaacagagccgtgatgacaggggcatctccaaagggcggtgagttccctctgtaccctgactaagtcgccgtcgtcaaggacgatgtcttcgtcaacttcttgaagaacatcttgttcgtctggaagaacacactgaagctgttccagttcgtttgatgggccattgactctgacgccatattatacgttggcggccacggacccatgtgtgtccttgtgcactaccccacatgccagcagctgatccgtgagtacttggaggccgactagatcgggtctgcctcatgtcactcgcccgtcgttttttcctacctaaactttcggacgggaacctcttggttgccggcaaggaggtgcccgccttcagctacgctgaaggagaac

SEQ ID NO: 20448 - DNA, 305 bp, Zea mays
  Clone ID: cC-zmle18900027e07a1
tttagcctttactttccaacgcagggaaaaaggagacgggggcggtgtcctttctatgacagtgaagggggcgctcccgcgtttacgagcggaaacaatacatgccgttacggggatgaacaggacctgtatacagcctagtctgtggtctcgccagctagctggagaaacttggggcggagacttgccaagggggtcatcgcgccacttttacctatacggacagtcgtagtaagcggaacacacaacacactcttcaacctacgactgtgtggcggggcctgaaatgtttctatgcccgtgct

SEQ ID NO: 20449 - DNA, 307 bp, Zea mays
  Clone ID: cC-zmle18900027e07d1
tttttgggttgacccacgcgtccgggcacgcgtgcgcgtgaggcagaggatcctgatatgctcatttttgctatgggctgcatgccgaacccgactggggtgggggcctgtcatagggcacagagtccgcagtcctgcgctgctaggggtgtgtcttggtgggctctgaaagcactttctctgggagtatataggattgcgtatgaacttacacacatagacggagtgaggtagatgaataggtcaatgactgtacatgattactttaagatgtgctctgaactcccgatgtaggctgtgtatgaaa

SEQ ID NO: 20450 - DNA, 351 bp, Zea mays
  Clone ID: cC-zmle18900027e08a1
ggaatggccgagaagggctatcaaatctgcaaaaatctaatgcttgggccaaaattatatgacgcagtcaagcttaccaaggctacgctccatctgtgttattttacccagacaacgatagatggaacgggtgtttaacaaaaaccctacccaaaaaatcctctacagtttacaccataaaacacttgcgggaacatggatacccttggctggaaaagaaagaacatttttcaaattagttctgtcaaaagggtagggaaaacagtcttcaccaccatttaccggaggaacaggagggtcatttgtcgatcttgattctgcccacaaggctccgccctttggggagcacgt

SEQ ID NO: 20451 - DNA, 464 bp, Zea mays
  Clone ID: cC-zmle18900027e08d1
cccacgcgttcgagatgatggaggaagcatatgcttctcctgtagacaagatggtggaagcaaatgccgcgtgggctgttaacatggaataagcagatgccacctctttggacaagatggaagaatcagattccacattgccggacaagatggaagaagcagatgccacattgccggacaagatggatgaagctgatgccacattgccggacaagatggaggaagccaatgccatgttgccggacaggatggaggagaaaaattctgatccgtaggacaagatggatgaagagtgacttgggggtgtaaccagatttgaaataacggttgacttgttctgtcagtcgcctatcttgatctggaacatcatggattcacctgtggtaccgcagatgaagactgatacgtgcgtccccagaggagtacccttgtgggcagaatcaagatcctcatatgatgaccat

SEQ ID NO: 20452 - DNA, 546 bp, Zea mays
  Clone ID: cC-zmle18900027e09a1
tttttccacttcttttatttaatgcgccggggcttattcgatttattctaaaactgatctcccacagccatcatgaccgatcttgcagctaaacgcaactcacgcccttctaagcacgcctggtttctccgttcatcatctgccgagggtttcgagctagaggccgacttcaggactcaacccatgttgcccatgcagatgtactcgagctccaagtactggtcaacgccgtacttagatccttgtatccctagaccagactgctttactccgccaaatggcgccacctccgttgaaataatcccctcgtgtaccccaactaagccggactcaagagattcagatacacgcgatgaacgaggtgtgctcttggtaaaaatgtatgcaggtaagcccgcgtttgaatcgatggccatatggactgcttcttcctcagttttgaacgggataaggggtgcaactggaccaaaaacttcttctctgaaaagaagcatatcgttggtcgacattccctactacagttggctcataaaatgacattcccag

SEQ ID NO: 20453 - DNA, 489 bp, Zea mays
  Clone ID: cC-zmle18900027e09d1
aatttttgggtcgacccacccgtccgcgaaaggtttggatatgcattcatgacacctgttcatatttttatggacggtgacggactaaaatagagtacgggtcatggtcctgtgattaaccaatctcacgttcaaaaggtggagaagttaattaatgaccccacttccatgggagctaatggcatgctatgtggcataagacacatcctgggaatgatattttatgagccaactgtactaggggatggaagcaacgatctgcttcttttccaagatgaaggttttggtccatttgtccccctgtataccgttcaagaactgtggaagaagcagtgtcatacggtcagcgatacacacacaggcttagctgcatacatttttaccgagagcagtacctcatgcatggcgtgtatttgaatctattgagtaccgctaatttggggtcaacatggggattattttagcggatgtggcgacttttggttgatg

SEQ ID NO: 20454 - DNA, 485 bp, Zea mays
  Clone ID: cC-zmle18900027e10a1
tttttcctttttttttatttaatgctccgcggcttattcgatttattctaaaactgctctcccacagccatcatgaccgatcttgcagctaaacgcaactcacgcccttctaagcacgcctggtttctccgttcatcatctgccgagtgtttcgagctagaggccgacttcaggactcaacccatgttgcccatgcagatgtacttgagctccaagtactcgtcaatgccgtacttcgatccttgtctccctaaaccagactgctttactccgccaaatggcgccacctccgttgaaataatcccctcgtttaccccaactaagccgtactcaagagattcagatacacgccatgaacgaggtttgctcctggtaaaaatgtttgcagctaaccctgtgtttgtatcgttggccataaggactgcttcttcctcagttttgaaccggataaggggtgcaactggacccaaaacttcttctttgaa

SEQ ID NO: 20455 - DNA, 441 bp, Zea mays
  Clone ID: cC-zmle18900027e10d1
cccaaagtttgcaaatgcattcatccatgctggtcatagtttttggacggcaacggtctataagagagtacgggtcaaggttctttgattaacgaatctgctgttcattaggtggagaagttcataaatgacgcctcttccaagggagcaattgtcatgcttggtggttaaagacacagtctgggaatgtcattttatgagccaactgtagtagggaatgtcagcaacaagttgcttcttttcagagaagaagttattggtacagtttgcaccccttataccgttcaaaactgaggaagaagcagtccatatggtccacgatacaaacacaggcttagctgcattcatttttaccaagagcatacctcgttcatggcgtgtatctgaatctcttgagtcccgcctacttgggctaactaggggatttttttaacggtggtg

SEQ ID NO: 20456 - DNA, 174 bp, Zea mays
  Clone ID: cC-zmle18900027e11a1
ttttttatttttgattattaaacgccccccgatccagcgcgggcatatataatctgttgtccaaagaaatacatgaccggtctttcagctgaaaaaaaaaaaacccgtgctcaaccaaaaaaaaagctccctttattatctgccacacgctccgccctatgggcccaacaagcg

SEQ ID NO: 20457 - DNA, 395 bp, Zea mays
  Clone ID: cC-zmle18900027e11d1
ccggaatttttgggtcgacccacccgtccgggcttatgggcggaacgcactattgctcaagatggacagttttacagccgagatggggtctgacctcaactggtctgtttgacatatgaccagataatgggagggtactaagggccaatgcatcatccacacctcgatttcagtgtgagaagcacttacgtgctttggcaaatgcaccgctgctgcgaggaactcttactagcgaatagatcgacataatggtagacacctattccgctacgaaccccaacttggcttgcaggaccagggagttcgccctaactcgaaagaaaccgttgatggatccagatgttacctactgggcacagtcaactggtgtgctggcaacggcatttacatgagcc

SEQ ID NO: 20458 - DNA, 109 bp, Zea mays
  Clone ID: cC-zmle18900027f01d1
cccacgcgtccgggccagtgatccccgaccccgagtgccgatgtcgacgccattcctgattccttcatcttgcgggccgtcgtaccgacgacggagatatagtcagagc

SEQ ID NO: 20459 - DNA, 380 bp, Zea mays
  Clone ID: cC-zmle18900027f03a1
aaaagggggaccaaaaattttttggccctgacaaaaacaagaccccttatttaaaaaaggggaactttcaaaacctgttctgggggggaaaaaaaaaaaaactggggggtttttaaaactaaaaaggccggaccgtttattcgaggaaaggctttttggatgcttgtttaaaaccgcccccctttttccgtttaaaaaccttttaagggggcttgaaggtttttttgatgtcctggggggggggccccaagtttgggaacccccccttaaattgggagggggggaaataaaccccctcttccacgatggcgggggtgaacctccccaacttttggggggatttttttttggggcccccaaaattgtggccgggccccccg

SEQ ID NO: 20460 - DNA, 539 bp, Zea mays
  Clone ID: cC-zmle18900027f03d1
ttttgggttgacccacgcgtccgcatcgggggtggcctccccgttggtgcctacggtgggagaagggacatcatggagatggttgcccccgcagggccaatgtaccaggcaggaactctcagcgggaaccctctagccatgaccgctgggatccacacgctcaagcggctgacagagcccggcacctacgagtacttggacaagatcaccggcgaactcgtccgtgggatactggacgtcggtgcgaaagcagggcatgatatgtgcggaggacatatcagaggaatgtttggcttcttcttcaccggcgggcccgtccacaacttcggggacgccaagaagagcgacaccgagaagttcgggaggttctaccgtggcatgctggaggagggcgtgtacttcgctccatcgcagctcgaggcggggttcaccagcttggcgcacaccttccaggacatcgagaagaccgtccaggccgctgagaaagttctgagcggatatatggggtccgctttaagcaagcatgcagaaagcatttc

SEQ ID NO: 20461 - DNA, 465 bp, Zea mays
  Clone ID: cC-zmle18900027f04a1
acggccttttctttttttttttccattaattttaaactaacagcacagtatatttccggctgggttccaaacttacatgatccattccttggaaacagaacacagagactgacacatacaaattcatgtttcagaaacttttattgacccagacacgtctaccattattttttcatatacttctttttttgatttttcagtattcagagaggggaaccattttagcaaccccgtcccaggtgaaccactggagtccagaaaccagttagaaggtgggagtgtatgcactgttaagttaggacgaggaagatgacttgacgaacattctgatctttctttcaagcttctccttttttgccccaatcacaagggctacctcctttccattcttgaccagcacaaacggtggcatcgtctgtaccttccatgtccttgcgacccccgggagctcggggacgtccacct

SEQ ID NO: 20462 - DNA, 371 bp, Zea mays
  Clone ID: cC-zmle18900027f04d1
tttttgggttgacccacgcgttcgggacaggcaggcagcgagtgcaaccgcgagagcgatcagcgatgggctccttcttctcgaccttagtgacgcccccttcggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtctcatggacttggaaggtagaggcgatgccaacgttcgggcttgtc

SEQ ID NO: 20463 - DNA, 366 bp, Zea mays
  Clone ID: cC-zmle18900027f05a1
cattactacaatgagtactatacagaaccagacatgtgtcatgtacacgtaaggtaggtcttccccgtgcgtcgtatgtactagggggaaaaaagaggagagcccatgccccttgatcaggatcactcaagattgagggctgtttacagcctgacttttacaactagatatatagtgtggtgggggggcacactgattttttaggaacagctagctcttaacacattctgcatgttaagatcatttccgattgtctttgccttgtggatgtacaggatgtttattgatacctgaacctgcatcaattaaccccccttgtaaccatccggcttttgtcctggtgcggaccctgggtctgacgcttgg

SEQ ID NO: 20464 - DNA, 390 bp, Zea mays
  Clone ID: cC-zmle18900027f05d1
attttgggttgacccacgcgttcggccacgcgtccgcaccaggacataaggcggttggtttcaaggtgggtttattgttgcaggtccaggtgtcgagggcatggtgtacatccacaaggacaaagaagccggagatgatcctaacatgcaggacgtgacgagagcttgctggccctagaaaataagagtgccccactaccactatatatatttcgttgtcaatgttagggggcatgcagccctcaatcttcagcgatcctgttcagggtgcatgggctctcctctttttgccccgttatacatacgacgcacggggaaaaccaaccttacgggaacataacatatgtgtggatgtgtatagaaatcaatgaagaatgtggggaaagaaaa

SEQ ID NO: 20465 - DNA, 451 bp, Zea mays
  Clone ID: cC-zmle18900027f06d1
ttttggtttcccacgcgtccgcggacgcgtggggatattccggatctggacgacgaggtctactcggatgcgttcaactataagcatttgggcaacttggggtacattggtaactcatcggcgctcgactataatgggtactcgcatgcccgtggtttcctggcaatgtacgcgtggcgatcgacctattggtctgagcatacctgtatgcgaaccaaggtgttgttaatgattgactggatcaagcggggtatctttgggcgcgacttgtcaaagttctaaatttgagcgaacaacgggtcacgcacatgggagtttttgtgcatgaacatgcaagatggatacgcttcaatacatgggaaaccaaggatgagggtccctataatggaagcctgcaggatgaacaacgatatcatactatctgcactgataatgccagaggacgagaggc

SEQ ID NO: 20466 - DNA, 473 bp, Zea mays
  Clone ID: cC-zmle18900027f07a1
ttttatttgtttcgtaaaagatatcgtccgattctccttctattgattcttttccgatcgagatgtatggatccatgtgtctacatacctagattctgttcatggattaacgaaaatgtgcaagagctctatttgcctttgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttaaatcggaactttccgcgtcgaaccttttttattacgtcttggttttactcctatattgggagttactttacttatttggttgccgtaaaccaaaagtggatgtgcttttggcttttgttgaaccttttccaccgcttcgaagagaatttgataagcccatgatttt

SEQ ID NO: 20467 - DNA, 553 bp, Zea mays
  Clone ID: cC-zmle18900027f07d1
tgggttgacccacgcgtccgcccacgcgtgcgaggatttacccggtgtgagatatcgcattattcgatgaaccctacatgctgtcgcagtaaagaatcgtcaacatgggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggttaatatggaaattctctcagaggatttcccttactttgggcgtgtcaacaaacaattggaaatacctcgactgtttcagaacaggtccgagtcaaatagcaatgattcgaagcacttctttttccattacactatttgggaaacctaaggactcgatcgtatggatatggaaaatacaggatttccggtcctagcgggaaaaggagggaaacggatactcaatttaaagtgagtaaacaagaattccatact

SEQ ID NO: 20468 - DNA, 470 bp, Zea mays
  Clone ID: cC-zmle18900027f08a1
ttttccaatcatcttttttccttatatattattcctttccatttcaatggttcattcaggtcattgctcacactgccacccatggtgatgggtgacactacgttgctcatcgccgctgaatgagtaaactagcgagctaggtagctagccagcggctccattacattattactacagtacatagttttctgagtagtagacaccgccggcagctgcgttgcaagggcagggacctggctgctgcatttgcaggccgcacatatccctcagctgctgcgctacctgggccgccatcagcgccgagagctcgccctgcggttgctgctgcaggaaggactgcaggaccacaccgtatgtcgactggtaccggtgcagcggctccacctgcctgatctggcggcagcactgctgctgcagcgcctggcactgtggcgagccctaaggcgtcgacaacgggctgcactggtgcc

SEQ ID NO: 20469 - DNA, 469 bp, Zea mays
  Clone ID: cC-zmle18900027f08d1
gtcaggctagcaatgagctcatcgactccagattggagaactcgacaccatgaaggtgctgatcgttgcccttgctctcctggcgctggctgcgagcgccgcctccaatacaagcggcggatgtggctgacagacaccaccgttgcatctaccgcctccgatctatatgccgtctccgatctatctgccgacgcagcagcaggcgaaggcatggcaataccccactcaaccaccgcagctaagcccgtgccagcagttcggatcctgcggcgtcggcagggtcagcagcccgttcctgggccagtgcgtcgagttcctgaggcaccagtgcaacccggcggcgacgccctacggctcgccacagtgccaggcgctgcagcagcagtgctgccaccagatcatgcacgtggagccgctgcaccggtaccaggcgacatacggtgtggtcctgcagtccttgctgcagcag

SEQ ID NO: 20470 - DNA, 429 bp, Zea mays
  Clone ID: cC-zmle18900027f09a1
ttttccaattatcttttttccttatatattattcctttccatttcaatggttcattcaggtcattgctcacactgccacccatggttgatgggagacactacgttactcatcgccgataaacgagtaaactagcgagctaggtagctagccatcggctccatggggggattactacaccacatagtccccctgagaaggagacacaaaccccccctgcgttggaagggcagggacctgcctgatgcagctgcaggccgcacatcgccgaaaaatgctgcgctacctgggccgccatcagggccgcgagctcaccctacggctgctgctgcaggaaggactgcaggaccacaccgtatgtcgactgctaccggtgcaatggctccacctggctgaaatggaggcagcactgttgctgcaaagcctgccac

SEQ ID NO: 20471 - DNA, 440 bp, Zea mays
  Clone ID: cC-zmle18900027f09d1
gccacgcgtgcgattaggtcatcgacttcagattggttaacttttcaccatgaatgtgctgttcgtgggccttgctctcctggcgctcgctgcgagcgccgcctccagttcaagcggcggttgtggctgtcagacaccaccgttgtatttgccgcctacgatctatatgccgcctccgttctatctgccgccgcagcagcaggcgtagccatggttataccccactcaaccaccgcttcttatcccgtgccagcagttcggatcctgtggcgtctgcagcgtcggcagcccgttcctgggccagtgcgtctagttcctgaggcaccagtgcagcccggcggagacgccctactgctcggcacagtgccaggcgctgcagcagctgtgctgccaccagatcatgcaggtggagccgctgctccggttccaggcgacatacg

SEQ ID NO: 20472 - DNA, 441 bp, Zea mays
  Clone ID: cC-zmle18900027f10a1
acaaagcccaaacgaattggggccaacatacgctaagtcgcccaaaggaattagggagccaacatcacggtagtaacagggtaaaccaggacctagagatagttttgactcctaaataacacaatatattgtacccaataaaacattccaaaatcatagtacaacgttacaaaaatgtgttgtcacaggaaaataactaacaacattttaggtggacatagtaacaacatatttagccttgttcatctaagactcctgcaaattaagttggtcgcccaagaccaaaattcatggcttctttctttgcttcttggccgaaacaataacaatcaacactcatttgatctcgcaaaattatacagctcaaaaatggatgttgctcaaattcttgacacctaaactattgagagtacacgagaccgtctttcgcaagatacagaa

SEQ ID NO: 20473 - DNA, 500 bp, Zea mays
  Clone ID: cC-zmle18900027f10d1
cactaataggcaagagtgcactcttgggaaccggtgtttcattatctcgtcctctcagctttacgccggggccgacaccatctcaaactacaccaaaaccaatacgtgcagtaccagctgttgttcctgctcctgataaacaggccaatgttcccaaggggaacactgctgagcttcagaagaaaacaattgctcttcttgaggagtattttggcatacgtattttagatgaagcccatcattgtatcgtggagctgcagagttctgatttctacccagaaattgttaaagaagctgtcattcttgccctagataaaggcaccaattttgttgatccttttgtttggctactggagcatttgttcacaaagaaaatttttaagactcaagacctggaatccggttgcttggtatatggtactctgctggatgacactggcattgaccttcctaaagcttcagcacaatttggtgagatcattgattcgcctgactttgtt

SEQ ID NO: 20474 - DNA, 425 bp, Zea mays
  Clone ID: cC-zmle18900027f11a1
gggaccgggggatttagtgcatgttgcccatacaaattcattgaacgacttttgggtgacaaaaaacaaaaacgggttgttagaaaaaaaaaacccccgctatatgaccgattttcttccctcatatgtaataaagaagttaaaagaccatggtacaccccttgccagaaacctaacatttagagcatgcaatgctggccccttttttatccccactaaaacccaaagtttggggggttttgcaacccaaaaccttgccggccaccatggagggtctttcatcccaagattttttaaatggcgggcattattttttgcaacaccaattttttcattttttgatttactggctggccctcaaagggaaatggtgtcatggggaaaaattaccgaagtgtgttgccccctatttgcaaaagggggta

SEQ ID NO: 20475 - DNA, 441 bp, Zea mays
  Clone ID: cC-zmle18900027f11d1
agcttatgggcgggtgaaacgattgcttaagaaggtttgttttacagtcgtgatgggttctgccctagaatgagcagtttcacataacaccagattcttttagtgtacttaatgccgatacattttccaaactttgttttcagcatgagaagcaattacatgctttggctaatgcgctgctggagcgtgaaacacttactgcagatgagatcaacatagtagtttacccctaccaagaagaaccccagttttgcttccaagacgaggagttcgtcctcacttaaaagattcctttggtgcatccagattttacctactgtgaattgtaaattcgtgtacaggtagtggcatctagatgagccatcgcagtttgttcacatgcccccttctgcataatagggcgcaacacaccttctggacatttttcaccttgacaccatt

SEQ ID NO: 20476 - DNA, 456 bp, Zea mays
  Clone ID: cC-zmle18900027g02d1
atcatgaatcccctcaaggcccttcaaccactttcagcttcttgttagtcatgaagtgtgctagaactccgtcaaacatttttgttgtatcaatgtgtctgttggaagccctggctacgtaatattctacgtccaaatgcatcaaagattgtacaaaacaagatatgcggttaggatatccatccttggtgatggatattggaactaaattaacagtattagggttagtttgggaactccattttcccttgggattcctattttcccaagggaaaatgaactaattttccttgggaaaatgaaattcccttgggaaaaatgtggttttcaaactaacctaacccttagagttaatttgtcaactctatttttctaaggaaattcctctcataaggcttggtgtcaaattaaataatcattattttctaattattctcttcttaatttattaatctt

SEQ ID NO: 20477 - DNA, 431 bp, Zea mays
  Clone ID: cC-zmle18900027g03a1
caagcaaataaaagctacagatttgcagtactagcacatgtgttgttgaagtcggctgatttcattttttcaccagaccaccactgacccctatgtgcagcacacagacaaccattgtatccacacccacactaccaacctaggtatccagtttctggcagtacggacaccagaaccttgctatatatgcatgaaccaacataaggcatcaagctatcattaccaaatcaacagagtttcatggaagaataccaaaaagctgccccatctctcttttcatgaagcacacacttggaacttacctattgccatgcaatgtattgccattcaatctaatgagcacaggaggcatttatcctgtcacctttaccgtcatggaaggcgatggaactttcagctagggcagtaaccacccaagcccactcgttcgg

SEQ ID NO: 20478 - DNA, 451 bp, Zea mays
  Clone ID: cC-zmle18900027g03d1
attttgggttgacccacgcgtccgcggacgcgtgggcttgggtggctactgccctagctggaagttccatcgacttccatgaccgtaaaggtgacaggataaatgcctcctgtgcacactagattgaatggcaatacattgcatggcaataggtaagttccaagtgtgtgcttcatggagagagagatggggcagctttttggtattcttccatgatactctgttgatttggtgatgatagcttgatgccttatgttggttcatgcatatataggaaggatctggtgtacgtactgccagaaactggatacctatgttggtagtgtgggtgtggatgcgatggttgtctgtgtgctgtacataggggtcagtggtggtctggtggaaagatgaaatcagccgacttcaacatcacatgtgctagtactgcaaatctgtagcttttatttgc

SEQ ID NO: 20479 - DNA, 286 bp, Zea mays
  Clone ID: cC-zmle18900027g04a1
gggcgtggttaccaattcacttcattcaaaaagtggtcacgggacattttatctgagggaatcacaatgcaacacatttgctaacaaaatgggggaattgctacggcctcgaccattacaaatcggcaataaatcgcctggtatttatgcacaccggaaactgtttaaataaccgtgacctagtaagacgggggaacagccataaccatggcataagtctgcctcgcctagggtgcaaaaactaggacacctttgtgaactggtaaggcaaaccaggtcctttgcc

SEQ ID NO: 20480 - DNA, 433 bp, Zea mays
  Clone ID: cC-zmle18900027g04d1
attttgggttgacccacgcgtccggtttccttgcatgtgctgctggcggcaatcaaagagctgaaacgttacaaggcagagcgagcaaaatattcgggatttcttgcttcccaggcgacatcctcctgatctggtgatgattatcacggatttgcaccagaaaattctgaacgtttatatgaagctgatggccactattggtactgcacatagtggagactggagagttagcaacactgcagcgtcacttgttctaatgctcacggaagtggttaggatgtccaggtgatgtcaggccgagagctatagtcgaaatctctaccaattgagcagttcttgtaacccagattttgttcctagatacctcatacgtactcacattgaagttttttttaaaaaaaaatatctatttagaaaggacagacattaagat

SEQ ID NO: 20481 - DNA, 395 bp, Zea mays
  Clone ID: cC-zmle18900027g05a1
ctccgtcttttttttttttttttttttatcagcgggagaactttattattacagtgggagagattaaacacctaaaaaatggcaccaccattggtggtcggttgaaataaggaggaaggattcctcccagcctgctgagttaatggcacttaattgttgttggctgaaagaaggccacaatgtttgacacaatttgaggggagaatggtcacttcttctgcttaagaaagaaggcataaatgtttaccccctcttgagggtaaaaacacttccaatgttgttgtcccaagaaagcaacaatgtttgacacaccccggaaaatgaatggctgaacctgctgttgcaccaaaaaagccttattctggcgcggacccgggttttccagaccgggccct

SEQ ID NO: 20482 - DNA, 374 bp, Zea mays
  Clone ID: cC-zmle18900027g05d1
tttgggtttttcacgcgtccggccttcttactgcaacaacagattctgccattccatctgcaatctgttttaacattggtgctttcttgagacagcagcgtgtgtttccattttacccacaaggtgtgggatacattaatgccttcttgcgacatgaacaattgctgccattctacccacagaatgtggcaaacattgttgtcttattacaacatcaacaattggtggcatgtagccaacatgctttgacgaatcctaccaccgtattgcgaccgtccaccattggtggcgccatattttagattctcgatgaattatactgttataataaagttgtcatgctgatgatacgtatagaaaatcatatgtcgatg

SEQ ID NO: 20483 - DNA, 304 bp, Zea mays
  Clone ID: cC-zmle18900027g06a1
atcttgataactttatttttacggtcgggtttatttaaaatttaaaaaatggcacccccaatggtgggcggttgaaataagggggaagcacccggcaaaaaaaaaagcttaaatggcattatttgtagatgattaaaaaaagcaaaaatgtttgacacattctgtgggaaaaatggtagtaatcgtcgcctgagcaagaagggataaatgtttcccacatcttgttggtaaaatggcctctaatgtttttgtctcaagaaagcaacaatgtttgccacagcccgcaaaaggaatggaagaacct

SEQ ID NO: 20484 - DNA, 593 bp, Zea mays
  Clone ID: cC-zmle18900027g06d1
tttgggtttatcacccgtccggatggcctcgagggcgatcctcttctgcactggcatggcggttgtgctgttcaccacctacaccatttttaaggcgtggggcttctccgtgttcggcgcgcacggcgagtacatgattggcgcttcatgtacgtggcgctcatgctgttctttctactcgccttactttggcactccctgtccatctgtttcctcaaccaggccagctttcatataaacaccatggtctgactattcttactcctcctgcgactacgacgccgccgtgctggggctctcgttgacggccacctgggactacatttgcgacgtactggatcgcggttttaccctcaaccttgttggcaacaggcttttctacgcctgtgtgcccctcctgctctggatcttttgcccgctccttgacttcctgtcctccatggtgatggatctcattactttcagcctcgacgtactaaaccttatgggccacaacggatgcgtctctcactgaggcaaatctgcggtgattaaccgttggagcgattgcgcgcttgccgattgagagctgccgacttgtgttctcacaaacc

SEQ ID NO: 20485 - DNA, 380 bp, Zea mays
  Clone ID: cC-zmle18900027g07a1
attcctgggcatgtaatttatttggtactgacttccttgtaataatattccagtgagaggccacaagaactccttgcacaaatgcacagcttcaccgacacgattgaataattcttgttcagaaaagaagcacggtcggtcacacccacccaccagttcatcagcagcacaaacgtaaacaaaagagcactccacccattcacccaacacgacatgccactacgtacgcgctacgattctactgctgctactctgccgactgccgacttctaggcgatggtgacctgcacggtcttggccttcttctccggcggcggcagctttttgacggtgacggtgagcacaccgttcttgcagcgcgccgtaacgccggccgtgtc

SEQ ID NO: 20486 - DNA, 309 bp, Zea mays
  Clone ID: cC-zmle18900027g07d1
ggcggggtaagacgacacccatttctgcacgcgaacttagtttgttctagggagtacgtgcgagtgagggcaggggctgagctgctccatgctggcggcaccaggctagtacatctggcggctgtggtggaccgccttgacgctgctgacggtgaccggcggtctgtcgaccaccatgcggtgtagggtctcagccacggacgctttcacaggctcagcggtggctgccgatcctcgtccgacatcgaggacagccccggcgagttcggcctcccgctggcggtgacaggggtctacatgggcgacatc

SEQ ID NO: 20487 - DNA, 483 bp, Zea mays
  Clone ID: cC-zmle18900027g08a1
gaccagcaacagcaaatatgcattgctgcggcaccaacataaaaacgcctaatgctattacggccggtcttgctaccgccggaactcaaacaaaaatgtgccaaggcctccccttgccgaaaattaccggatatatatccacctagagcgcaccaacaccggtgcttatttcatcagctggacgcctggactttattcgacattcggtccacacagattatgttaccacgagaacaacgaattatgagagggaaacgttgattcctagctaaacttccactgccagagccggaacttgacagtggtttatgtctctgcttccgcctgatctatgaaaccacccgttgcatctacctcccgtagattaggaacgctgcttttccagcttctcaatgaatctgacgaagttgaggatgattttcttgccatcaggggtgatgatgctttccgggtggaactggacaccctggatgtgtttgtact

SEQ ID NO: 20488 - DNA, 462 bp, Zea mays
  Clone ID: cC-zmle18900027g08d1
gtcgacccacccgtccgcggacgcgtgggtggcctccgtcgcacgcccccacttttttttgtcaccggcgagaatggcctgctcccacctggccgtcgtgggtggctcttcccctgccaacgtcgcagtggttcgttccccgacgcattccccagccgccgccttcgcgcgcctccggtcgacgccgcgtttcttgagcgccggcctgtcggttaagggaagcagggcggctctcccgtgggtcgccagcgcggggccggacgtggtggtgcctgtggccgacctggacggccgcccggtcacggagaagcagcccatcattgtcatcgataactacgacagcgtcacctacaacctatgccagtgtatgggggagcttggattgaacttagtagtataccgccatgatgaactgaccatagaagatgtaaagaggaagaaccctagaggaatacttatttt

SEQ ID NO: 20489 - DNA, 350 bp, Zea mays
  Clone ID: cC-zmle18900027g09a1
ttttgaaaagaaaactatacgtatcctgctattgcgctgcggtagcgcagttgatcaatcgttttgggttttggccatatacagacttgagcatggtagtaaagagaagtctgaacttatttgcttacgaagctcaaatagagatctgttgagttgcccattcccccgcgtgatcactttgtgagctgctgctccttgctcgcttcctccagctccctgaggcccccaaccctctgcctaatatcctcgagcatttactacgcgaacagttactccatcgcaaactcctactggtcctcttgcctgttgtagtaccagtgcacggttgcgtcgccaccctggttactgta

SEQ ID NO: 20490 - DNA, 372 bp, Zea mays
  Clone ID: cC-zmle18900027g09d1
ggtcgacccacgcgtacgtgctcgacgaccatggcctggccgctgttcaagtgcttatcttagctcatcgcccccatcaccatgagatccgtgaggacagccaaacgctgccccgccatcatagaccacgtcatgtatcacgagatccgtgtcaagtacctccgctataagaccatctttcaactgaacgcgggcgggcgcttcgtcatggacgggccgcacggtgacgccaccctcgccgggcacgtgatcatgatcgacacactacggcgggtgcggagcccacgggggtggtaccttctccggccaggacaccaccatggcggaccgcagcggggtctacgtgggcaggcgtggcgtctagagcatcat

SEQ ID NO: 20491 - DNA, 279 bp, Zea mays
  Clone ID: cC-zmle18900027g10a1
tttttaggaaaaaacgacaaaaggactgttcctgaccgggtgtggccaccatcataaggcgctttcacctacggacatccacggtttcgatgaggtgctcaataacaagcctatacctgtactatcagcgcatgtagtaatattacgtgtgggtacacgaggatttcccggactacacaaacaaaagcccttccgctgggactggttcctcgagataaataagctcgtcaccctttagtgactccccttgactaacgttcaaaaaccagatttttttca

SEQ ID NO: 20492 - DNA, 327 bp, Zea mays
  Clone ID: cC-zmle18900027g10d1
ggcacaactacattggcacatgctgtgcttgtggcttactattcacaggatacaacaagaagacggagatacgtgtaggtagaccgtacctgtcctgctacaaaaaaaaaagttgaggatttccttgctccatagtaacagtccatcacacattatagcttgggattcgcggaagtggagcccttcctcctggtgcaaagccgggtggtaaaatggacatctgtaaagcactgtatgcgtggggacatgctgccgggacacagattacattttacatggacatgactcaggggtcgatatactgtactgcatgcacgcaatgttcac

SEQ ID NO: 20493 - DNA, 256 bp, Zea mays
  Clone ID: cC-zmle18900027g11a1
tttttcgtttaaaacgacaaaaagattgttcctgggcgcggtgggacaccgtctcaaggcgcactcaactacatacaacctcgtttgcgatgacttgcacaaaaacaagtctgtaccagtactaataacgcacgctgtaatatcccgtgtgggtacacgaggaattcacggtataccaatacaaaagtcctaccgccgcagcaagttcctctatataataaaggctctacccgtctctcatgcactcccctcaaac

SEQ ID NO: 20494 - DNA, 99 bp, Zea mays
  Clone ID: cC-zmle18900027g11d1
ggcacaagggcatgggcacaagcgggacaagaggcttaccaacaaaaggatgaaacaagaaaacggaggagcaggaaggtcaaaagaacctggcgccgt

SEQ ID NO: 20495 - DNA, 366 bp, Zea mays
  Clone ID: cC-zmle18900027h01d1
gatcgtgatagacgtcatgatagggacaggcgccatgaccgttatcgggatagggattatgaccgctcccgtggacatgattcaaggaggagagagcgttcacgctccagggagcgcagcaggcgccacgagagatactaaatgttacaccatgcctgacagatttaggagtactggcggcgtctgttcaagatatggtttgagcttgtgcttcgtatcttctgaagaccggtctacttgacgctaaattcgcatggagtgttaagcatttattaaacgcatctggaatcaaatgaagttgtacttgcgaacggcttcccttaaaattcgtgcaatttcttcctttattatatatatatatataat

SEQ ID NO: 20496 - DNA, 154 bp, Zea mays
  Clone ID: cC-zmle18900027h03a1
acttggttggttttttttttaatatttctttttatacaaccatatttcttcttttaacaccttatcacaacaccaaaaccttttttcaaactccaaaaaaaccaaaacttcaaaaactataccgaacaacaaactcaccaaataccctacaaca

SEQ ID NO: 20497 - DNA, 626 bp, Zea mays
  Clone ID: cC-zmle18900027h03d1
ttttgggttgacccacgcgtccgagaggaataaggccagagaacagcgagctcaggagctcgtgtcaccagattcttctctacgaagaaagttgctcagtgcacgtgatatggctgaacggaaagtaatcacgccagaggagattgtctatactactgaaaaggatctattggagcaggattatgaagtcaaggagtgggagaggagatttaaggagctcgagtcagagtgatggacatgaccgatatacttgacacttgcagtagctctacatggtcctcacaccatacttgtcggtgatttttatccgcatccaacggagtggaagatggatctgactgaaccactcgagcaagcgaaactggatggtactggacctcactaattgtcgcgtcaccaccagcccaccactgaccacttcgctatggaagttttgtggaagctgttggtttaattgaaaccgaccattatttgcaagctgatgttcgtatctgtgccattgacctgcatatatgtatagttccaatcacggatcaaattcagattttgacacgaaaaagaaaaaataacccaggaatatggctaggatgctactcggtttgaatggagtccatccatacatgtaa

SEQ ID NO: 20498 - DNA, 172 bp, Zea mays
  unsure at all n locations
  Clone ID: cC-zmle18900027h04a1
ttttggtttttnttttaaacacctcactccgttaaaattggactgggattaccttaaaattaccataaacaccccctaaatctctctttcttttcaatggaagaacaaaaaaccaacctttttaataaccccttcgaattaacaccgctaaacacctaaaaccatctccaat

SEQ ID NO: 20499 - DNA, 355 bp, Zea mays
  Clone ID: cC-zmle18900027h05a1
ttttgtttttttttttttttgcctttctctttttttatttgttttgggtttattttattttcatttcttcttcttttcttttttttttttttctaccccaccacacccatattgtgtactttttagggggcacacacacaagggggggcccccccccccgcttctttgtggaaaacacaaaaaggggggggctacattcaaaccccgggggggctccacctacccggggagctcctaacccccccccacctgcctgtacactacttttggccccccccccccggataggctatttcaaccctctttttagctccccgggttttttttctaaccaaaaaatcccccccctttttca

SEQ ID NO: 20500 - DNA, 387 bp, Zea mays
  Clone ID: cC-zmle18900027h05d1
ttttgggtttacccacgcgtccgtgacaacttcgttggcttccctgaaggccgcgaagcccagctttgttgttgcgcagggcaaggagccggcgcccaagctgagcgagacggcgacgaagccgtcagccgcgaagagcggcggcgttaacaaggctgagcagaagccccgggaaaccaataggaaggtgaagagcagcctacaggcggcggcggccaaaaagtgacgttcagtacgtgtggagtgtaatggagcttccatgcatgagtgaatccatgccatgttatgaatctaggccttcctttcttgtatcttccatgtgacgcggcgtgtgcgtgccctcatgtgtgatgatgccagatgaatactacaaattagacgttggtg

SEQ ID NO: 20501 - DNA, 540 bp, Zea mays
  Clone ID: cC-zmle18900027h06a1
gttgcaaggaacttagtacagcagttctcgggctcagaagatcaccacgagtaatcttaaacacttgttgagaataatcttaatttaaaacttgtttccagacaaaatcttaggggcggatgaaaacaagtggacaactctaagttcacgttataagcaacctcatgtccagactcagcctagatatagaagtagcaaacaaactacttggtagcgggaaccttctgcacagccttattttccttgacaggccttttaagctttacaccaacattctttttgtagtcgccatgaacctccatgagcttcccaagatcgaacttgggggccttgagtatcttcaccttgcggatgaagacgtttttaaatgggaagatgctggaggtagacttcttaatctccttaccaataacttttggaatgaactatgaaacaagttcttttaagtcacatgtagaagcctggttgatcattttttaaccatcttacggtggatctgaccgttctgggatgctgggcatatcaggtttttttgacctg

SEQ ID NO: 20502 - DNA, 554 bp, Zea mays
  Clone ID: cC-zmle18900027h06d1
tttgggtttacccacgcgtccggaacaagaggatctgcttgggtaagaggggtggcaagaaaaagaccttttaccctttctataaaaaggattggggtgacatcaaggcacctgttgtgttcagtgtgcgcaacatagggaagactcttcgtatgcaggacacaaggtcccaggattgcttctgagggtctgaagcacacagtttgtgagggttgcctagctgatctttacggcgactaggatcaagcatacaggaaaattaggctactggctgaagatgtgcatggcaagattgtgcttacatacttgtggggtctgaattacaccactgatgcactgacatccgctagtgaataagctggctagacatcttactcgatagcgccaatgtgtgagtgttcaaagatcataccgaacatactacatagttgctgttcggttctgcatccggctttaccacagaggcgccccaaccaggtcaagagaacctgctttgctcaagcattccagaatcgtccgatccctcggaagatggttgatataatgatcaacca

SEQ ID NO: 20503 - DNA, 400 bp, Zea mays
  Clone ID: cC-zmle18900027h07a1
tttttctgtttatggagcgcggaaattgatccagaggttctggagctctcattactatatcgaggacaattgaaaacttacagagagttatttttatagaaaaactgcgtcctgacgcaataggtcgggctgatgaaataatggtgccccctctgacttcacgtctagtgcagaataatgtccagactgagcctaccttttaatgaggcaaacatgctgctggcgagaaacccacttctgcacaggcataccatgcttgaaagaggcatgagactcaacatcatcacggttttcgcaggcgcactgcagctaatttaatttacaactatctgtgcttggggcacagacatttgtaagcttgcgtgtgattacgaaaccacgtcggatgatactggacgat

SEQ ID NO: 20504 - DNA, 248 bp, Zea mays
  Clone ID: cC-zmle18900027h07d1
gggtcgaccacccgtccgggcatgtggatcttctccgttcattatgatggtatttatttttacctccacaccttgttcgagatggagggggggggaatccaggctccaaaagggatcaaagggcgcatcatctgtgagacgataaaaaacaaatcccttggtacctcgattgtttattgacggtattcagcacagaccctttgaaggtcgacaaaataataatactatcgtggacgatgacatctacc

SEQ ID NO: 20505 - DNA, 292 bp, Zea mays
  Clone ID: cC-zmle18900027h08a1
gttaatcgaactcggagattgatccaagggtgctgttgctctctttactatattgaggacaattggtatattacacatagtttcttttatagaaaaactacgtcccgaagcttgaggtctggattatttaataatagtgcttctactgacttcgcctctagtgaagaataaattcgattctgtcgaattccttatattgagtcgcatttgctgctgacgagtaacccaactctgagatgggatactatgctggatgaggcatgagattcaacatcataacggttttctcgtg

SEQ ID NO: 20506 - DNA, 93 bp, Zea mays
  Clone ID: cC-zmle18900027h08d1
ggtccaccacgcgtccgaggaacgacttccttctccgttcattattacttgtatttttgtattgacctccacaccatttttctatatatgggg

SEQ ID NO: 20507 - DNA, 391 bp, Zea mays
  Clone ID: cC-zmle18900027h09a1
aacccagaacaatattgtttttgtgggggtggggcatagtagacgaggaccgttacagtggggaaaatgaaatgaagcatggaaagggcaaacaaaagaccaacacttttatttcttcatcccaacatagacttccttccttctgacaacttcatacatgtggtatgatacccttccccttgaatggctcacgtggcctacaattctttatggccgcaaaaaactggccgatcacgctcttgtagtctccggtcaccatgatccttgtggtcaattccaccttgaccggcaggccttagggaatggcctatcgaacagggtgggagatttccatgttcatcacgagatcgttgtcctccaccgctgcacggtacccgaaaactactaactg

SEQ ID NO: 20508 - DNA, 293 bp, Zea mays
  Clone ID: cC-zmle18900027h09d1
ggcgaccctttcttcttccctccacctcccttgcaatttatgttccggcccccctggtaagacacttgggaagtgctcttgtatcttccctgctccaagagacggtttcctcagaacaggctcgaaatgcatggatattcgaagtggcacgctatccatcgttgtaccatcgaatgtttctccttcattacgagatcaggtcgtcatagttatggtcaccctgggggagcggtctatgtgctttacacgcgacttcaagtgcgtgaacgaggaggtcagctacctgagagttt

SEQ ID NO: 20509 - DNA, 282 bp, Zea mays
  Clone ID: cC-zmle18900027h10a1
accccacaaaagtaatgttgtattggccttgtgtctaccatcatatggggctttcacatacggacgttgaggttttagaagtcgtgcttaaatataagcctatatatttactagcagttttttgactaataatacatgtgctttcacaatgaatcgcgaaaagcacaaaccaaaacccatcgggacagatgatatacactgatgaaacaatctttacaccctttatagcctccgcctttaacctatgtccatatacccaagaccttacattcccttagccct

SEQ ID NO: 20510 - DNA, 81 bp, Zea mays
  unsure at all n locations
  Clone ID: cC-zmle18900027h10d1
ggcacgcgtacgttggcgcgtgggcggaccctggggttaagttacngtaccactagtaatgacactggggtacgggccgtt

SEQ ID NO: 20511 - DNA, 481 bp, Zea mays
  Clone ID: cC-zmle18900027h11a1
tttttgaatatacaagtcatgtaaatttcagacttttaactcgttcctccaaaaacaatgtacgatgtgctcctgcatctaagaacagataaaaaaaactccaggaagtctacaaactgttccttaatctgactagcatctgctctcgccattaggctagagaaattcagaaacaggatttgagaaggatatcatcgcaccacttttacccatacaaccagtggactacactgaacacgcaacacaccaataaacctacaactgtgtggccgggcctaaaatcttcctctgcccctgcgttgccctccgccccttcccctgccgtgggcttgaaaatctctcctaccaccacctgcttcgtcagggccactgaaactgaacatgctcattcgtaaccgttcagcatccgagttctcggccccaccatggagaacgcccgcagttgccccaccatgcaagttttttagtctagttgttcctg

SEQ ID NO: 20512 - DNA, 455 bp, Zea mays
  Clone ID: cC-zmle18900027h11d1
ctggtggcaagccaatgaatgaggattcaaacgatgagaacatagacaatattgagagtaaggttgaatctaagcaaattactcaagacagcaggccaaaagaggtcagcgaagctgttccagtccagaaccaagctgccgcgcagaagctactgcagaaaatgtcgcaggttgtgcctgaggacaggcgcggtcgcggtcatagattcaagggcaaaggcaaggaagaagatgctcaggtttttaccctcgatgaatgggagaagaggaaagccatcggttctaagcccgctgcagaaagctacgtgcatgacactagccgagacgaggagctggcgaggcaactgcaggaacaactagacctagaagacttgcatgggggggcagctgcgggcgttctccatggtggggccgagaacttcgatgctgaacggttaccgatgagcatgttcagc

SEQ ID NO: 20513 - DNA, 316 bp, Zea mays
  Clone ID: cC-zmle18900028a09d1
actacgcgtgcgctgcccttatctgtacggtaacatggtcgtgcaagatcgtgtgcacatctgtgctgattgagggcgcccgaggtagagatttccttcgcgagctggtggggtcattcgaaagccggaaagacaatgccgaacatagctacttggtgctattgtacaacatgattcactgggataccagctgttatgggttccattaccagtggtaccttatggagggctatctcatgcatgcatgcgcgtacacaactgctggaggggcgtttgatcctactgaaagggcatttgcttgtccatctggggccta

SEQ ID NO: 20514 - DNA, 520 bp, Zea mays
  Clone ID: cC-zmle18900028a10d1
cccacgcgtccgcacctccgaagtcggaacctccctgccccaacacaatggcctcctccctcgccgcgcgccgcctcctctcccgcgcagccgccgtgcgccgtttccccgtccccttcgcctccgccccagcccccgcgatggctccccgcagtttctccgccgacgcgggaccgcctccgccgctcccgccaccgccgccgcagcccgtcgtcgagccgcccacgtcggagggcgcgggtgcctcgtcctcctccaccaccgctggtgccggaggggcccacaggtcgtcgccgggagccgcggcgggggcgcggcgccagggtggtgcgggctacgaggaggagcaggagaaggtcctccgcgcgtcgctgctccacgtggttgcgattcgaatccactcctccaaatcgacttccatttttgcgtgtcttggtacttaatttagcatataatatggaagatatttactgttcgtgtatggctgtattctgtagccgcgcatggggtggagcgagtc

SEQ ID NO: 20515 - DNA, 321 bp, Zea mays
  Clone ID: cC-zmle18900028a11d1
gtcccgagtacaaagctcctgactacaagagcaaagcaaccaccaaggccaaatctaagaagagcaagagcaagggcaagaagaggaaggtgaaggcataaaagtagcgaacaaatatgccctgtttttggtcttgaattgcatgctcagaaaatgaatcgagaagacgctcaggcctgagatggcttgatccaatcttgcaatgctgttttttttgcatggtcagaaaataaatcgagaagacgctcaggccccaattggctcgatccaatcttgtaatgttgttttcgaagctgtttgtaataaccatttcactgaaaa

SEQ ID NO: 20516 - DNA, 477 bp, Zea mays
  Clone ID: cC-zmle18900028a12d1
tattcgcctcacgcgcgtgccatccgtgatgtggaggatgaggagcttcacagcttcttgtgtggcatgtgaccatgggagttcatcctaatggtggctgataactgaattggcgaggagctgatctaccgcgccgtcattcacggagcactggccgatattttcctgagaagaacggagctaatgaaggatgctcgagggattgcatcactgagtggtatcggtcctgctctgggtccattcgctcagacgttcgcggcagtcatgcactgcagccctcacaggaactcgtttactatcgtggcacaaactacaaaagacgctacgtttgtgggtgacaccagcgatgcgtacgcgcacagggcgtgagaacctcaagatactatttgcagcttggtacgagaggaggcaaatgatgaagatatactagccgcttctggaagaatcttggcttctacctggcttcgaaggatccag

SEQ ID NO: 20517 - DNA, 411 bp, Zea mays
  Clone ID: cC-zmle18900028b09d1
cccacgcgtacgcccacgcgttcgaccaaacccgcacgacactacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggtcaccaccgggtcggccaaggccacgatcttcgatgagtacctcgagaagagccaggccaacaaggagctgaacgacaagaaaaagctggccaccagtggcgccaactatgcgcgcgcctacaccgtggagttcgggagctgccagttcccctacaacttcactggggggccaggacct

SEQ ID NO: 20518 - DNA, 334 bp, Zea mays
  Clone ID: cC-zmle18900028b10d1
cttaagccgtcccattaacgatgaagggttctttttcttgtctatgggcaacactgattatgttcttcaccacgagcctactcaagcgtccaactttgcattccacgcctaccataacaggttgttcaacgtccacaaggacagggttgggtatcgcaagtggtttggtgggaaccccgcctatgggggggctgctggtgcttgctctttttgatggagttctccctggactacacgaagacatgggtggcttatgacacgaaggctatcatgccaggaggtgaaaggacaaacactggtcttgtctctgtctgccgctagacgctcaagtctg

SEQ ID NO: 20519 - DNA, 412 bp, Zea mays
  Clone ID: cC-zmle18900028c09d1
aaaaaaaaaaaaaaaaaaaaaaaaaaaaaaaaaaaaaaaaaaatttaaaaaaaaaaaaaaaaaaaaaaagacagggcagggagagtaaaaaactattgctagaacgagattaagaccatatagttctttttttggggggcttgtttttagttcccgggggtctggtcttcttcggccgtgaatgggacaccccttgggctgcccctcttgatttctttgggggcggtttctctttgggcatggcggggaaagccttgggggccccatctttttgttctttcaaaaatattgcccctctcttttggacgatttgaaccccctcgggttgggggcttttttccttcctgtgctggggctttccccaagggcggcggggtacgccttcttggcccacaatacaccgggggggggg

SEQ ID NO: 20520 - DNA, 507 bp, Zea mays
  Clone ID: cC-zmle18900028c10d1
cccacgcgtccgcggacgcgtgggtgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcgcggtcggggtcggggacgttgagcatgctagctgcttttggaaattgcattgcgtgcatctgcagtgtaatctacattcctatcaattgtacgaagtatgcctttgattatgcaaccatgtattaattgtttttttttgcccgggatttattgtgatgagggtaccatgtgatcatatgttc

SEQ ID NO: 20521 - DNA, 515 bp, Zea mays
  Clone ID: cC-zmle18900028c11d1
gcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgttggcagctcagggtctcaaccccatggccatgatgatggcccagaacatgccggccatgggtggactctaccagta

SEQ ID NO: 20522 - DNA, 585 bp, Zea mays
  Clone ID: cC-zmle18900028c12d1
gcgttgcgtcttgggggagagagagaagtgggagacccgcgagaggctgccgtgtagggactagggaccgtagagtaagcgacagcgaaggagggagagggggatggccgggatcgggccgatcagacaggactgggagccggtggttgtgcggaagaaggcacccaccgtcgttgccaagaaggatgagaaggccgtcaacgccgcgcgccgctccggcgcggagatcgagaccatgaagaagtacaacgctggtatgaacaaggcggcgtccagcggcacattcctcaacaccaagcgcctcgacgacgacacagagaacctcgcccatgagcgagttccaagtgacctgaagaaaaatctcatgcaagcaaggctcgataagaagttgacccaggcacagcttgctcagatgatcaatgagaagccacaggtgatccaagagtttgagtcagggcaggcaatttccaaccagcagaatattggcaagctcgagagggccctgggaacgaatctgcgtggcaagaaataaccaggagcagcataggggaagacaaggcaaacggtctggttattatttgctat

SEQ ID NO: 20523 - DNA, 441 bp, Zea mays
  Clone ID: cC-zmle18900028d10d1
tcatcagttactgaaacagctgaaggcagaagagcgtagtgtaagagaagcagaatggataaaaatccttccaataagaagtacatgtaaattaggcttgccctataactcaagtgtgtatcggtacgttatgtctccgtctgtgctcttgctcgtgagcaagcagcacatggctgaccgtgtagcttgcatttccattgcataataggcttatgaagaatgctttggtaatatgattttacagtctgacaaggattgtgaagcataggcagtgtaccatcaagataatacttctggaagcatataaaaaaatttcgtatatttggatttcaaatccagtctgcttcagactggaaattcaaaaacaaaaattgtttaggaggtggagctaaggccttcatttggtaagaatatacttgagctcgcccagacatgggaaac

SEQ ID NO: 20524 - DNA, 172 bp, Zea mays
  Clone ID: cC-zmle18900028d12d1
cttggtcactgtgatatggctttggtttgcattgcagcggtgcgggttcgaatcttgcgcctgcacctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 20525 - DNA, 444 bp, Zea mays
  Clone ID: cC-zmle18900028e09d1
tgcattgatcattacatggaattctattaagatattatatgaaagtcgaatttcttccattctcatttgagaatgcgaatacaaggaggtattttgtgtttgggaaagtccgaagaaaaaaggatttggaatctaccttttcttttgctttttcccttataaaaataactcaatcaaaatccaattatctactctacaagaatgaaatgcttgttatgcctaatatacttagtttaacctgtatctgttttaattctgttctttgtccgactagctctttcttcgccaaattacccgaagcttatgccattttcaacccaatcgtggatgttatgcctgtcatacctgtactcttttttctattagcgtttgtttggcaagctgctgtaagttttcgatgaaatctttactattctgcctgccaaattgaatgatgtattcatt

SEQ ID NO: 20526 - DNA, 563 bp, Zea mays
  Clone ID: cC-zmle18900028e10d1
ctcaacacccatcaatgcatggtgttcttcgactgattgttactctcgatggtgaagatgttattgattgcgaacccatattagggtatttacacagaggaatggaaaaaatcgcggaaaacagaagtattatacaatacttgccttatgtaacacgatgggattatttagctactatgtttacagaagcaataacggtaaatgcaccagaattcttagagaatattcaaatacccaaaagagccagctatattagagtaattatgttagaattgagccgtatagcttctcatttgttatggcttggaccttttatggcggatctcggggcacagactccctttttttacatttttagagagagagaattggtatatgatctatttgaagctgctacaagtatgcgaaagatgcataaattactttcgcatcggaaggagtcgctgcccgatctcccttatggatggatggattaaatgtttagatatctgtgatttttttttacaaggaagtggtggaatatcaagaacttattacacaggatcccatctttttagaacgag

SEQ ID NO: 20527 - DNA, 372 bp, Zea mays
  Clone ID: cC-zmle18900028e11d1
caagaaacagaatccacaatttttttgtgattttcagctagacaatgatgggaaaatagtgagtattttttggtcacacgcaagtatgcagggggaatatgcagattatggtgatgctgtgacatttgatacaacacacaagacaaatatatatgataaaccactgggcatgtttattggagctaacaaccatctgcagtgtacattgtttggatttgttttgttgggagatgaaacagttcagacttttgaatgggctttcaattcattcaaaacatgtatgggatgcgagggtccgagagttatgctaacaggtatgtggtatgtgaatttgttatgcaaaaaagtcaaataatttattgtgaaagttaa

SEQ ID NO: 20528 - DNA, 481 bp, Zea mays
  Clone ID: cC-zmle18900028e12d1
cagcaatccacacaagcacttcgacgtcgcacgggcgctgcacacagacacaccaagcgtcggcaccaatggcttactaccaggaggtggactactgctcggaggaggtgaggtcggtggccccggccggcttcggtcgccacggaggcggtgtccagcagcacgtcgtcaaggagaagttcgaggaggtcgacacggtcttacgcgccggtgccaaccaccaccaccaccaccatggtcaccacggcggtcacggcttcttggtgcgcgagaccagggtcgaggaggacatcaacacctgcaccggcgaggtccacgagcgcagggagagctttctcgccagggctaactgagccgcccggcggccggcattcacgcccgttcgtgcctgcctgcgtgccttatgtatgtctgtggttgactggttgtgcagggtcatcgtacttggctatcgtacgtgcacgcactcagttcctgtacg

SEQ ID NO: 20529 - DNA, 562 bp, Zea mays
  Clone ID: cC-zmle18900028f09d1
ccggaatttccgggtcgacccacgcgttcgcgcagtactttggggagatcggcgttggctcgccgcagcagaagttcaccgtcatcttcgacaccggcagctccaacctctgggtgccgtcctccaagtgctacttctcgatcgcttgctacttccactcgcgctacaagtcagggcagtcaagcacttacaagaagaacggaaaacctgctgccatacgctatggaactggttccattgctggttttttcagtgaggatagcgttacattaggtgatctggttgtgaaggatcaggaatttattgaagctacaaaggagccagggcttaccttcatggttgcaaaatttgatggcattcttgggctaggctttcaagaaatctctgttgggaatgcaacaccagtgtggtataacatggtgaaacaaggtctcatcagcgaccctgttttctctttctggtttaaccgacatgctgatgaaggagaagggggtgaaatcgtgtttggtggaatggattctaaccactcaagggtgatcacaacgttgtcccaatcactcgg

SEQ ID NO: 20530 - DNA, 360 bp, Zea mays
  Clone ID: cC-zmle18900028f10d1
cccacgcgtccggcgccctcgctcacgctcaccggcaggaagaaggaggccgacaagctgcagacctccgacggctgggccaagttcaccgggggattcttcttcggcggcatctccggcgtgctctgggcctactttctcctctacgtgctcgacctcccctacttcttcaagtagaaatcatcaaagatgcgtatatatatagctccggccgatcctcctctctagctgcatggtatgtaggtggtgtggtccttgtttcatttcactccagcggtgatcagcgccgcgtataaatgtaattcctctgctttgcacatggatggattgggatgtaacctgttcaacttttttttaaaa

SEQ ID NO: 20531 - DNA, 472 bp, Zea mays
  Clone ID: cC-zmle18900028f11d1
cccacgcgtccgcccacgcgtccgcccacgcgtccggctcggaggaggtgaggtcggtggccccggccggcttcggccgtcacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggctgactggttgtgcacggtcatcgtacttggctatcgtacgtgcacgcactcagctcctgtacgaattacgacaatagctcgtgacccgaataaaacttttttgtaatactaatacct

SEQ ID NO: 20532 - DNA, 356 bp, Zea mays
  Clone ID: cC-zmle18900028f12d1
cggacgcgtgggtgctgttattgaaagcctaccttatgttggcgcaatggcagtttccaatcttgaggctcggcagtctctcgtacccctcgggagcgtggaggagctgctagcagcatacgactcgaagcgcgatgagctccctccaccggtaatcgtgtgggagtggggctggacaaagagcgcggagacctggaatggtcgtgcggcgatgctggccgtgctggctctcctggtgctggaagtgaccaccggcgaagggttcctgcatcaatggggaatcctgcctctgttccgctgagccgacagttctgttcatgatggggtcataattttgctgcagccgaaggaagttt

SEQ ID NO: 20533 - DNA, 405 bp, Zea mays
  Clone ID: cC-zmle18900028g09d1
cggaattttgggtcgaccacgcgtccgggcattggtcagaacagacttttgagtgctgcctatctcaattttcagtatcacaaacacattctagagcctgcagcgggggtcattatacctgcgtagatactgaattctattgatttcaaacccttttctgtgttgcggcgtcaagataatattcctcgacttgttatagaaaggtcttatgctttggagccctgaccggttctctcttaggagatgttgcctaccgcttgttgaaaaactcctcttcagtatcagatcttggcttatgctggtggggttactttatatgaccatacattaggtgcatccctatgtgtcctggaaagtagaccaaggtctggctgggtcatttggggccttgataggggtatttgt

SEQ ID NO: 20534 - DNA, 378 bp, Zea mays
  Clone ID: cC-zmle18900028g10d1
gagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacagatggcccccccaataaattcccccgtgcatggtaccccacgctgcttgatgaataaaaa

SEQ ID NO: 20535 - DNA, 185 bp, Zea mays
  Clone ID: cC-zmle18900028g12d1
gagatggcccagtctgcgcgaacgtctcgcagacacaccgcatggcttgacctaccccttactatcgtctagggggctgctgcttctttgttgatgagctgcggctgcccatgcgcatctgacgcctcacaattatcgacctgtaacacgggattacatcgcattactgagcgcactgattcttt

SEQ ID NO: 20536 - DNA, 404 bp, Zea mays
  Clone ID: cC-zmle18900028h08d1
cccacgcgtccgacgatgtggaaagtgtcaaggccaccagcgacgtcaactccccgatctccggcgaggtcgtcgaggtcaatgccaaactgtcagagacgcccggcctgatcaacacgagcccgtacgaggacgggtggatgatcaaggtgaagccgagcagcccgggggaggcggacgccctgctggacgccgccaagtacaccaagcattgcgaggaggaagacgctcactagacccaggcccgcccagccagcaagcgtggatgcttaccacgacagtgcgcgtttggtggtgttgatccgttcagtctttttttattggtgcagaaacttcaccaagcagtccgccaaggccggcgtacctgatgccttcccgtttcttggggctggtcccttattttt

SEQ ID NO: 20537 - DNA, 512 bp, Zea mays
  Clone ID: cC-zmle18900028h09d1
cagcagttggtgattgatgaaggaacaatcagagtgtccagttactattcccaagagttgcttaactcattgactcatgcccttcaaagctcaggtgtagatttgtcccaagccaacatctctgtgcagatcaacatgggaaagcgtgccgccaagagacccgctgctggtgtatccagcaactccaaggaaccagctgatccggcatctagcaacgaattagggcatcagctgacgctgtcgggtgccggtgccgacggcctctctcacgcaacaaagcggcataaacggagcaacagctgatgtccgctctccctcacctcgctccccgacggacggacggatgacggattggtgacattcttcttttccctcccagccaacggggaggctcgtggattggctggctggctgtacattgtgtgctgtgcctggtgacaagctgagacctcccgcgtattctttgatttgaacacccccccgcccgccattccattgtttacgtagagaag

SEQ ID NO: 20538 - DNA, 445 bp, Zea mays
  Clone ID: cC-zmle18900028h11d1
atcagaaaaccacagctttgtggcgagcgtaacacttgatgatctgaaggctctatagagcaatctacatgctggttacaagcaaaatagagcgtgatactactgaaacatcacaagtgtatgtcggagggtatacactggtttcccgtcggcaaattgcccttgaaaaactatcagagatggcaataattggccaacatgagagaccatggctacttacgcagtgaagcgacaccactcaacacattttgataccgcactctagaacctgtgttacaacatatactatgggcatggggcactctggggcggtaattctctggggtgctgcccagattgccgctcgagatcataattgagggtctctttggtggaaagggtacctttacaaattgttttatagaagtgactttttattattatagtaaagaatgtgtggggatct

SEQ ID NO: 20539 - DNA, 533 bp, Zea mays
  Clone ID: cC-zmle18900028h12d1
cagcaatccacacaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagctttctcgccagggctaactgagccgcccggcggccggcatccacgcccgttcgtgcctgcctgcgtgccttatgtatgtctgtggctgactggttgtgcagggtcatcgtacttggctatcgtacgtgcacgcactcagcttctgtacgaattacgacaataagctcgtgacctgaataaaacttcttcgttatactaata

SEQ ID NO: 20540 - DNA, 479 bp, Zea mays
  Clone ID: cC-zmle18900029a01d1
tcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatatcgtggttgtcgtttggttattctgggaagccgccaacccagcctttggtttgaaaatttggtcgtctggaagcattgtgaacttccgatgttgccacatgctggatcagtctgaataagtaagtatgcagctctaggtggtcagctgcgtctaccacaatgagcatgacacgtttggagaattatctgggaaccccattttgtttatgaataaaaatttggtttt

SEQ ID NO: 20541 - DNA, 471 bp, Zea mays
  Clone ID: cC-zmle18900029a02d1
gttcctcactactgggatcttgctgtcaattcctcggagggttcttcctgagcaaagcacctgttcagaaccttggtagctactgctgatctttgctggctacatgctagttatgtgtggccagtgttatagcgcttgttatggtaagacccttaccacgagtatctacatcaatggcctcatcagttgaagtactgaactcagtaatgcctggtgttagggggtgtttatccctccattttatttcatttgtccctagattgccaaatacagccatatttgtcaatttaggaactaaaatggaataaaatgtagggactaaaaattagtccctataaaccgaacaccccctttaatctgttgtgaacatgctatttcaaagatgttattgttggattttcctgcggcctaaatactgttatgtgagcaaccggtgaatttttgcacgctcagcgtgcatttggaataaac

SEQ ID NO: 20542 - DNA, 451 bp, Zea mays
  Clone ID: cC-zmle18900029a04d1
cccacgcgtccggggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgtcggccgcagcagctgtgaggagaggcgcgcggtggacggcgtctccctgcctgggtggaagctcgacgccctctgccaggagtcctgcccgtagtcggccatgagggcgcgctttccctactacttctgaagcttcctcgtgcagtcctgcgtgatcgagttcttgagcggcgacatctggtgcatgctcttgacgactgatggcgctcttgggtgtcttccttgctcagggatttcctttcgtgcacgttcatgtatgtatg

SEQ ID NO: 20543 - DNA, 577 bp, Zea mays
  Clone ID: cC-zmle18900029a05d1
caggaggagatcttactccgtgtatggcactatatgataccatgctaagtctaaaaagtcctattggcactcactgcttgggctttgcattcaacctggcaggattcatccttgcagccggtgaaaagggttcacgcactggtatgcctctatgccggatttcactccaatcacctgccggagcagctcgaggacaggctgacgatatagaaaacgaagcaaacgagcttatccgcatcaagaactatctctatggcaagctcgcggggcacacaggccattctgtcgagaagatccatgaggacctgtctagggtgaagcgcttcgacgccgaaggggctctcgagtacgggatcatcgaccgtattgtcaggccgtcttggatcaagaaagagggctccactgctcaaaggagggacatgcggaatctgggacttggctaataatagacgatcgaaatcctgttgtatcagaattttttgtgcaagggatgcgcttattatgggagaacgagcgatgcactgtttcaagctctacccggcgttaggggtttggtgtgtcagctgtgctttgctta

SEQ ID NO: 20544 - DNA, 141 bp, Zea mays
  Clone ID: cC-zmle18900029a06a1
gggaaagagcagcggctacgcgatagaagctggccagcggccgacctttaggtagaacacgaccaaaatcggggattagataagaggaatacggccccacaaaaagcaaactgtcaaaaacacgggggggaacgccctttt

SEQ ID NO: 20545 - DNA, 106 bp, Zea mays
  Clone ID: cC-zmle18900029a06d1
accacacgtaacgcgacgcgtgtagccaaagaaaaacctaacctaggcgtagacgacgatacgaatttcctgagaggggccgggaccgacgattggccgagactct

SEQ ID NO: 20546 - DNA, 367 bp, Zea mays
  Clone ID: cC-zmle18900029a07a1
ttttgttgtttttttttgttttttgggcgtagttagccatgaaccaaccagcctgtaatgtttactacagtcgctcgcaccacgtggtgctgccagcttattggttccaaccaactacacaactggcgggtcagccgctactggtttttttggacagccaaaacggatagagcactggcgtttccgggcaatctgcaacacacgccaggaaaaaaaaagaggctaaaattttgctgggagctgggaccaccaaagtccattgggtttccagttaaacaatggaatcgtcagcaccagttggccacttcccagactggcaccagaggcccatcagacatgggcacccccacttccatggaaaggaaac

SEQ ID NO: 20547 - DNA, 407 bp, Zea mays
  Clone ID: cC-zmle18900029a07d1
ggaattcccgggtcgacccacgcgttcggtttcctttccatggaagtgggggtgcccatgtctgatgggcctctggtgccagtctgggaagtggacaactggggctgacgattccattgtttaactggaaacacaatggactttggtggtcccagcttacagcaaaattttagcctcttttttttttctggcgtgtgatgcagattgcccggagacgccagtgctctatccgttttggctgtacaaaagaaacagtagcggctgacgcggcagttgtgtatttggttggaaccgataagctggcagcaccacgtggtgcgagcgactgtagtaaacattacaggctggttggttcatggctaactacgacaattaatattcctttttcatattattttatttaatgg

SEQ ID NO: 20548 - DNA, 237 bp, Zea mays
  Clone ID: cC-zmle18900029a08a1
tttttgtttttttgtttgtggaagatcctaggttttggtattgctcacgtggcacaaacttaaatgtctgtatttacctgaccgtcttggtattatctccgtaggaaaaggaagaccgtccttaggtttgcacaaacccagtgtgggtttttcttttctgttgtagcaaccggtgtaggggacgccggattcagtaaccttgtcgttgggtaagggcagggcgtcatcataaaaacc

SEQ ID NO: 20549 - DNA, 303 bp, Zea mays
  Clone ID: cC-zmle18900029a08d1
ccggaactcccgggtcgacccacgcgttcgctaagcctttcggcagaggacgataatccctcaactcaatgaccagaacgcgcaggattgaatacactacatggggcgaccctgattagtgcacagagaggacattgtgtctctgctacaaggcccgacggttgcacgagcagctggactgctggtgcttcattttcacgggcatagtgacattcgcatttatgatgaacttgcggtttgtttgtgccacgcaatccgctgttggaacaacaaacccatctcaggctaccagaatgtcgacga

SEQ ID NO: 20550 - DNA, 464 bp, Zea mays
  Clone ID: cC-zmle18900029a09a1
ggaatcatcaaaagcactggattggtggaatctgtacaaggtagcaaaacttgcactctctccatacgagcatatagacagacatataggagcaaatgcttcatgtttcgtcgctggacttgtgatctttacggacaagaaatgtatacggaaacttgctgtaggcaaaaccagtcgcatgcagttggccatttgcatgaaagggcaggaatgatcaaaaatcaaattccttggccccctacccttacccgaaaactgaaaattacggcaaaaagaaacacgccgatgagcccttctcccaggaagtggtcgaaccattaccaacaaggccaccaatcctttcaaacttgccgctggctgagccctttcagcacgacctgagcgctagtaccgcttcccaagaaacacgccgattaggacagacagcagggcaactcccaggatgaacttgaaggccatgatgc

SEQ ID NO: 20551 - DNA, 588 bp, Zea mays
  unsure at all n locations
  Clone ID: cC-zmle18900029a09d1
cccacgcgtccgcccacgcgtccgcccacgcgtccggtagacaagtcagaaaaagagtctcacatctcaaaactggagcgacagattacattatctgagataaagtacatggaggagataaagaccatgcaagtggagacaactgaaaagaatgaagcactaacagccaagatgcaggaacacacagacctacagcatgagaaagatgagttggaacaacagttgctggaagtgaggaaggaactggatggtgcctaccacaccatagcaaatcaggaagaacaggcttctgtgagggagataaagtgggacgcttttaggaagtacacggaggatcgtctggaagctgagcagcagcgtgctgaggagctggaactacaagtagcagctcttaaacaacagctccaagaagctgagatccattataagcaaaaggaagaacaagtttctctaagggaggttcaatgggaagcggatcataaccattcgctggatgagcttaacgctcagcgtcagtatgccacagacttggagaaacanatcgaagatctgacacagaaagtaacatcagctgatgcacactacaag

SEQ ID NO: 20552 - DNA, 94 bp, Zea mays
  Clone ID: cC-zmle18900029a11a1
ccaaaattacgggaatggaggcggaggtggcggtgatggtatagaagtaagtggtggtgttggtggtttaagatggtagatatgcggtggataa

SEQ ID NO: 20553 - DNA, 440 bp, Zea mays
  Clone ID: cC-zmle18900029b01d1
cccacgcgtccgcggacgcgtgggcggacgcgtgggtggcatcgatcttacttgatcgaccattgacgagcccactaactaccttgaccgtgactctcttggagctttatccaaggccatcatgcactaaaagggtggcgatatcattatcactcactctgccgagttcaccaaggatttgactgatgaagactgggctggtcttgacggtcgcatgactccttccggccacaactgggtccagggccagggagccggtccccgtcttaccgataaaggataggaggaggagaagtttctacgccctgggttacatgatctaatctaccaacaaggcttataagtcttttaactctgagctgcccaaaaagaaaaggaaaggatggccctcccaaggctggccaggaggtccttaccctccagggatattttcgccattt

SEQ ID NO: 20554 - DNA, 448 bp, Zea mays
  Clone ID: cC-zmle18900029b02d1
atcaagttcaaggaaggtaatgcacgaattgtttaatcattcaactcctatcacctaatgtagcaagcaagtgagaaagatttttaaaatatcaagggaggtggcaaatgcaccggggcttgccttcgttctgtggtgagtctggctcggatccacaaatatcaaagtagaagcagtttcctgcctgagaatccgagggtggtagcgtcttttcttcagtgactaccacttcttctgcacgttctaacataaccatatatatacatatataagaatgaatgacatgtaatgctcatgagagtgcgaagataattaagacttattatttaagtcttgaatacaactttccttcacggaaatctctgaacttacggttaccggagatagtaaaggagttcaaagggcaaggagtgggggttctgggggttagtgatcaaacagggtccaa

SEQ ID NO: 20555 - DNA, 429 bp, Zea mays
  Clone ID: cC-zmle18900029b03d1
acccgttcggaattcccgggtcgacccacgcgtgcgtccacgcgtgcgtggtgggagcttactgcaaagattcctatgatgctcgctcatcctaaggaacagacacaatcctaaggatggaaatactcaacttgagacttgggctaggaacaggagatgttctacccaggtctggtaaggattaatgcgtatgtaagcgtgctgtccgaggaccctcatactggtcacatgcctcgtcatgggtaagccttgcctcgggcagactaaggcctgaataaagataacactaaatgggcgtgcatcggtggccagagtagcgtcgtcccatcctggcaagaggctggactgcggtgtatctgtgctatcggtttgcgtgaacctgatctggtcttaagaaccctcggggcgggttgaacatatgcaagggtt

SEQ ID NO: 20556 - DNA, 412 bp, Zea mays
  Clone ID: cC-zmle18900029b04d1
gggtcgacccacgcgttcgtgcgcgatcatgtaccgggcggcggttggcatctctaggtcctcatcagcactgcggaggctgctcgtgcggggcgtggtcggggagctgccgtgtctgttggtgcgagggtatgcggccactgcgaaagatgtttcctttggcgttggctccctcgccgccatgctgcagggcgtaaacgacctcgccgactccgacaaggtcaccatgggcccccaatgtgcgcactgtgtatatcgagggggcccatagaggtcccatggttacgaaggacggggtctctgttgtataaagcgtggagtctgtggtatagcgcgaatattgttggggcgaatctgttgaagcaagttgctgatgcttctaacaatgctgctggggatggtaccacctgtg

SEQ ID NO: 20557 - DNA, 453 bp, Zea mays
  Clone ID: cC-zmle18900029b05d1
gctttcttattaggatcagcccgtcgatcgatcatggtgtcttcgagctcggctgctactactagtggggacagtcagggtctcaaggctcgagatgcctgcatcgtcggcgtcgtccgcacgcccatcggcgcacttctcgggtagctgttgttccttcccgccaccaagctcggctctattgccatccagggtgctctcaatagggcgaaggtcgacccggtgctcgtgcaggaggttttcatgggcaacgtcctcagcgccaaccttggccaggttccggcaaggcaggcagcccttggcgccggtttgccctacttcgtgccatgtaccaccgccaacaaagattggttcctcgggaatgaaggctgtcatgtttgcggctcaaagtattcagctggggatcaacgatgttgtggtctccggtggcatggtaaagcatgtcttaagccc

SEQ ID NO: 20558 - DNA, 510 bp, Zea mays
  Clone ID: cC-zmle18900029b07a1
ttttgatggctgtaatccaagtatatctttaggtctcagagctgctgatgaggaaagaagaagacagaattagctggtgcaaagggtctcgctcatttggctgcacccttggtagagccttagggaggatcaagtagtctgctttgatcccctaatggatctctttttgtatgcctatttctggcctccgtaaggagggtcttctatagaactttctttatctacttaatatataatggggcgcagttctcctgcgcgttcgagaaaaaaaaagaatccatcgatgtcctcgctcggctagaacaccaagcaatcccactcttgacgcaacttctgttgggtggctctgctcgtgcggatattgctgatgtgtgccacggcgatggcatccttggaggtttccttgttcgtgaggacggcgccatctccggcgggacatcaataaggagggcctccagcgcttgtaacacgtcacatctcacatcttctgggcttgcaacttcaccttta

SEQ ID NO: 20559 - DNA, 538 bp, Zea mays
  Clone ID: cC-zmle18900029b07d1
tagaaaatttgccccaaaacctgtctatctctaaaaaatggtataggagcccagttcttcccagaatttttatctatccctgcgtggcgccatggccagccctctctctcctaccacgagtccacaactccagcgtacggcgccgacaggcggctgcacgcgactggcgtgcagcagccgcggcagcagcgaacgcgcaggaggaggagcagacggcacacaacacggctgcggctcgggaggagcgcatcacagcagcagaggctgcagtggcacgcgcggctgagacatcccgccaggccatgacggctgctgctgccctgagcgcagacgcaggttagcgggagcaagacgccatggccgagcggaacgcgagcgcacagggcctttacaggcaccagcgcgtctctcctttcccagagcgggcaccatggccgggacgcgccggacgtgggcgcatggagccctcaagcaccgacatgtctctcattcctcagagaaacaccctggccaccatgggcggcacaagcttcccgtc

SEQ ID NO: 20560 - DNA, 522 bp, Zea mays
  Clone ID: cC-zmle18900029b08a1
ttttggatgatgaggataatcaggatccattacaataatcactggttctgcaatctgcatacatgatacatcaaggctagagccaaacgatctggctggctttcagaaaatacatatacttcactttgcactatcattttccttagcatggccaatttcagagtcaccgtgtgttaataccccccaaaaacttctcttcgactcccagtgatggtcatgactggctacttttctttacatccagaactatgcgacaagagggcgtagaaccacgacataagcgaacactaaaacacgataactaagaatatttatggtttccaaactcgatctagtggcaaagcaaattccacgtcatggtgggtgccgatgctgtgccgacttattatggctgtgttgttgcgtactagctgaggttcaggctggaatccacggcattcgatcctaatacgagccatggctggctctccggcttcttcttgactggtgccgcatcttgaggagcagtttgatatgggggtc

SEQ ID NO: 20561 - DNA, 539 bp, Zea mays
  Clone ID: cC-zmle18900029b08d1
ggtcatcagcttggccgttgctaagaagcctgctcgcacaaatgcttctgatatgcctattatgaggaaggcttgtcttcaccgcttccttgagaagagaaaggaccgcctcaatgcaaagacaccatatcaaactgctccttcagatgcggcaccagtcaagaaggagccggagagccagccatggctcggattaggatcgaatgccgtggattccagcctgaacctcagctagtacacaacaacacagccataataagacggcacagcaacggcacccaccatgacctggaatttgctttgccactagatcgagtttggaaaccataaatattcttagttatcgtgttttagtgctcgcttatgtcgtggttctacgccctcttgtcgcatagttctggatgtaaagaaaagtagccagtcatgaccatcactgggagtcgaatagaagtttttggtgggtattaacacacggtgacttttgaaatggtcatgctaaggaaaatggatagtgcaaagtgaagtatatgtattttctg

SEQ ID NO: 20562 - DNA, 495 bp, Zea mays
  Clone ID: cC-zmle18900029b09a1
ttttgacactttgcaaacatatatcttagattcgagaattgagtcttgatatcacattaggtactcggggaacatagtgtggcgccatagctagatgcaataaaccttaaagtcctctgaactcgaaaatcctaacccaaaagagcaaatagagcgcagtcttctcaaccatcaaacatgacaccattgaaaccaaagatgacactgctcacgcttcaacagcgacccttccagccacttggtccagatcacgccttccctggttggtgatgaggcgtccacccttgggatcgacatcgatgatgcccataatctgcagctgctgcaggatgttgcgtgcaacagcaccactgctcttgcagaagtgtggtgggcgggagccattcctctggcggccaccgtagatcttctgaaagccacccacaccgatgccttgccttaggtagatcttccttgcaatggatgcagccctgatgtagtaccagtcaggatcat

SEQ ID NO: 20563 - DNA, 565 bp, Zea mays
  Clone ID: cC-zmle18900029b09d1
gtcgacccacgcgttcgcggacgcgtgggcggacgcgtgggcggacgcgtgggcagagcagccgcatccacaacctgcctctctcgtcccctggcggcgtccgcgggaggatggcggaatctacggcgaggacggtgaaggatgtcaacccgcacgagttcgtaaggcctactccgtccacctcaagcgctccggcaagatggagctccctgagtgggttgacattgtgaagactgcgaggttcaaggagcttcctccttatgatcctgactggtactacatcagggctgcatccattgcaaggaagatctacctatggcaaggcatcggtgtgggtggctttcagaagatctacggtggccgccagaggaatggcttccgcccaccacacttttgcaagagcagtggtgctgttgcacgcaacatcctgcagcagctgcagattatgggcattatcgatgtcgatcccaagggtggacgctctatcaccaaccagggaaggcgtgatccggaccaagtggctggaaaggtcgctgttgaagcgtgagcaatgtacatcttggtt

SEQ ID NO: 20564 - DNA, 326 bp, Zea mays
  Clone ID: cC-zmle18900029b10a1
tttttgtccaagatcaaatgggccctccctttatttcaacagaggcatgcctatcaaaatgtatcatttgcaatgttatctgcagcagtcagacttgctaagaaaagaacatgtcatgatgttgcgatcatgagatgtgtttttaacagaaaacatgacatggtttgatattgtgatgacatgtgccatgaagaatgacactgggggagcgccatttgcgtcttactctacttgatgcagctgctgcacgacattagcattagactcgttcaattttctgttctgccacccaagattgttttggctccagttgggccatatcaatt

SEQ ID NO: 20565 - DNA, 313 bp, Zea mays
  Clone ID: cC-zmle18900029b10d1
gattgaaatggtacaactggagccaaaacaatcttgggtggcagaacagaaaattgaactagtctgatgataatgtcttgcagcaactgcatcaagtagagtgagacgcaaatggcgctcccccagtgtcattcttcatggcacatgtcatcacaataactatacatgtgatgtattctgttaaaaagaataaatgatgcaaatcatgaatttttttctagcagtctgatgtgtactgaattgcaaatgtacaatttgaactgcatggatctgttgaaataaagggagtgcccatttgatctttgacataaaa

SEQ ID NO: 20566 - DNA, 535 bp, Zea mays
  Clone ID: cC-zmle18900029b11a1
acgggaatgcccgcttaccggcgcgagaatcctttatagcggccgcgcggatgtactaccgcgtaaatattgggaattctggtctctcgttactggatagcgggcgcaggcaaagggaacagccgggggtccaacacctaattcaaaggtcgaacggacactaacccggtgacagaagccaacggctacacggtgctatagatagataagataactcggccgaagccaggatgggcccacacatcaattcctccagccgccgtcgccgccgacggaggcgtcaccaccacccttgtgccgaccgtcgtatccgccaccggctccggagccgtcgtcaccaccctcgtgccgaccgccgtaggcgacaccgtcgacaaaaccggcgtcacggtgcccgccaccatatgcgtcgccgccgagaccgtcggcgtagtcaccgtcggcaccgccaccgtcacgggactgggcctggttaacggtgatgttaccgccgtcgagctccttgccgttcatgttctcaatagcgtacagcatg

SEQ ID NO: 20567 - DNA, 416 bp, Zea mays
  Clone ID: cC-zmle18900029b11d1
ctggcttctcctccccctcttactcaagtcctcctcgggttagggttccttagggctttgtggaggggcgatggcggcggctgatgtggagtaccgctgcttcgtcggcgggcttgcctgggccaccagcaacgagtcgctggagaatgccttcgcctcctacggcgagatcctcgactccaaggtcatcaccgaccgggagacggggaggtctcgcggcttcggtttcgttaccttctcctccgagaactccatgctcgacgctatcgagaacatgaacggcaaggagctttacggtcgtaacattaccgtaaaccaggcccagtcccgtggcggtggcggtggctgcggtggctactgtggcggtcgcggtggcggcggctatggtggcgggcgccgtgactgcggttattgcg

SEQ ID NO: 20568 - DNA, 408 bp, Zea mays
  Clone ID: cC-zmle18900029b12a1
gcccccaaaattttgatgggaaacgatctgccaattacaaaggggggaactgaaacagcaggaaacatggttgttttgaaaagcaaatttgttaaaaaaaacgatgggttcatgaaatatttaaactgggactcctgacaagttaataagcaaaggatggttcactgggccggaaactccggataatggggggtgcacccggtccgagacccaaaagtgcattctggacctgctttgaggtgcttgtcctgacggggatctgcccactcagtttgtggttaaaaccaagttgaactgtcattttcgacccccttccgatggaaaactgggactgcaagtttgcccccaaagcaaggtcccgcccccttttttttagagagagaccctaggttgagagggactgggctt

SEQ ID NO: 20569 - DNA, 496 bp, Zea mays
  Clone ID: cC-zmle18900029b12d1
ggtcgcccaccgtcgctgactctgggcggacacatggcaaaacctcaggagggttcttagtactttcctgggcgacattgtggtaactggactgaagattgaggaccagctctcccttgggaagaggttgttactagttgctagcactggctcgatgtaagcccaaggggacactgcatatggagctaacctggaggcactcttgaaggacaaagacttttcgatagtccagtccctatcacccttgggtctctctctgatgaagtggcgtcgggaccttgctatgggcgcatacttgcagtcccagtttttcatttgaagggggtctgaagatggctttttcgcttggtttgaacaacaagctgattgggctgatcaccgtcaggacaagcacctcatagcaagtccagattgcactttctgggttttgtaccggatgcacgcctccttttacccggaggtttccgtcccagtgaaaccatcctttctcttatta

SEQ ID NO: 20570 - DNA, 456 bp, Zea mays
  Clone ID: cC-zmle18900029c01d1
aattacttgtatattttacgttaccggtttcctgttctcaacatttcagattctagatgatggtacgacaaattattttaggagtgctttgccataatttaaagcttggaagggagctttctatgatttatttttctgactgtttcgtcacatgttctttccctagatgaaagtcttgatttatttttggttctgcaggatcattgcgtctctgcgagctaatcagctctgtgagcgtctcccttgccccaatggcgagtcaactattgattgccatcagatctcaaagatgccaaatcttgcattcaccatagcaaataagactttcaccttaacaccagagcagtacatagtgaagctagagcaagcaggacaaactatctgcatcagtggggttatggcatttgacgtaccgcctccccctgggcctctctggatactggggatgttttatgg

SEQ ID NO: 20571 - DNA, 210 bp, Zea mays
  Clone ID: cC-zmle18900029c03d1
ttttgggtcgactccacgcgtcctacttattagggtgagtttaactatcaacacatatgatttggtgttcatgaaacacccaatctcttaagcattcggaagccctgtcataaatcggcgacttggcgtatttatatacagggttgcttcgtccacctaaccaccgtgtgcggtttgtgaacaccaacatgctaaacatggagccgcttg

SEQ ID NO: 20572 - DNA, 491 bp, Zea mays
  Clone ID: cC-zmle18900029c04d1
cggaatttccgggtcgacccacgcgtacgagaatcccgagtggctggtggtcattggcgtgtgcactcacctcggctgcatcccactaccgaacgccggagactttggcggctggttctgcccatgccatggttcccactacgacatattcgggaggatccgcaagggccctgcgccgttcaacctcgaggtcccgacctacagtttcttggaggagaacaaactgctcataggttaagagctcaaaagctacctgtctatttatctacttcactcaggtgaatccctgctgtgctgttatattgtttcttttttttaccgtgtggctatatttttttgctccaagaagatcattgccatgccaaagtgcgtttttttaagtacaaaataatgtggtacttcgctgatgctaaaatgtaagtggggagctcattggaacatcggttttctggggtcaccccggaagaacattgaatatacatttttctgcc

SEQ ID NO: 20573 - DNA, 509 bp, Zea mays
  Clone ID: cC-zmle18900029c05d1
agatcgggtactggaggtacatcaccatcttcaggcacctcaaggcgaacccggagtaccaggtgtaccccatcttcaagtatttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcattgagaccaaccgcacaacggcgaggatcttccctgctgtcctagacgtcgagaaccccgagttcaagaggaagcttgacaggatggttgagatcaaccagaagatcattgccggcggagagtccgacgaaatccccctagtgaagaacctgaagaggattcctcttggtcgctctttggtgtccgagatcatcgccggataccttatg

SEQ ID NO: 20574 - DNA, 493 bp, Zea mays
  unsure at all n locations
  Clone ID: cC-zmle18900029c06a1
ttttactcagaaaatctaaaatttgactcaataagaaaaacaactctttgagttggtcttaaacttagcccgtataaatgcgttgtgtgggataaggactactatatgagagcacctgtataatctaatctcaatacattctcggctcaacaatagcgttacccaatcctgtgccttccagaagtacaaaaatgtaatgaacaccattgtggtgaacattttaaaagagttaagggtaaaaggcatgtttctcattctgaactccgcgaccttttctttcgtggtctcaactttggtttcttctcaccaccagctctccctgttgccatgtgcttccgctttgctgttgttgcatcagcatccccaaccattaggtgctcataatcatccaggcttgcaaatggagacaacccactcttcttccctgccctccttttctttgtgtaagagacaccgccccttaccagcatcaaccatctngtcatcacttaag

SEQ ID NO: 20575 - DNA, 562 bp, Zea mays
  Clone ID: cC-zmle18900029c06d1
cgggtcgacccacgcgttcgacgacacagagagccttcttactgcaatgcagatcgtgtcagttggtgggagttaacactattggcttcacatgtgcacccttcagtttctactatggctagaacattgctatctggcaacaatattgtgtacagtggtgatccgctgacagacctatcacttcctgctttccttgacaaattcatggaaaagaaaccaaaagggaaccgcatagctgaaggaagatggcatggtggatcacaaattgctccggctaaaaagcttaatctgaatcatcatctcatcggagaggagcttctagaattggcagaaaatgaagtgcctcctgaagatattgttttccaccgtttctatttgaacaagaccggcactgttaagcgtaagacaaagcagaaggactcagttcttgatgaagatgcgggggaactcttagctgattatgacgctgatgaggctagtgacgagagtggagatgagatactggatctgggagatgggttggcagatgatggagaatatgactatgacgaccttgactcaa

SEQ ID NO: 20576 - DNA, 58 bp, Zea mays
  Clone ID: cC-zmle18900029c07d1
aaaaaaaaaaaaataaaaataaaaaaaaaaaaaaaaaaatataataaaattaaaaaaa

SEQ ID NO: 20577 - DNA, 551 bp, Zea mays
  unsure at all n locations
  Clone ID: cC-zmle18900029c08a1
ttttgcacaatgcaacttatcttgttacgccatccatttatcttattattacttcctccgttcagaattacaaagccacatagagcacattcgaggtacatacagactacagagagtttgcagatacatagatattccataatgcaacataacacgtaagattcttaggagcttgtttaggagcttgtttaggagcgaaaaaactttagcccctccaatatcattgccaccaaacaagactaagtgtcgtttgttgccaccacgcagcacttatcttagaccttgtccagcagtttatccatagtttactcaaaacactactgtattttagactactattcacagagtgaaatttgaatatatgtataatatatgaataagctgctggacataataatcttaaagctaccgcgcgttacatatgggccaactatttttttctaaaataaccngctatttcttttattttcttttctcttccactcggaatatcgttttgaaaagctttcacctcgctgtcagcttggccgccagcatcaatagctttattg

SEQ ID NO: 20578 - DNA, 538 bp, Zea mays
  Clone ID: cC-zmle18900029c08d1
aaccgaccaacgcgctttgtaacgcctccgctgcaatcagcccccgcggcgagcttgccctgcccctgattgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctggtggccctgttcgcctgcttgcgctactacgagcagttggatcagcagcactcccaaaagcgcgcgagggtcaaggctggggtttggagcctcacgaccctccttactatcatgttcagttacaaggtggctgagattatgcccctgccagtcaaacttgttgtctggtcgatggcagacgctaccacctgtggcggcttctacgctttcttcgt

SEQ ID NO: 20579 - DNA, 316 bp, Zea mays
  Clone ID: cC-zmle18900029c09a1
ggttttaggatttttttttttttatttaaataaatgataagtcgagtatggggctgactaaaacatggtgttccacattgaaccatacgctggttatccaaaattaatcgcgcaaaactaaaccccatgcatggggagatacagatgattctgagcaaacgatttttacccttaaccttcccttcagactaatgtacaaaccaatcactcctcaacccttggtcccttcaaaccatgcatggattgcaacacggtccggatctggtccctccagattgattaacacacacaaattgatccacaaaggaactctaag

SEQ ID NO: 20580 - DNA, 500 bp, Zea mays
  Clone ID: cC-zmle18900029c09d1
ggacttttgggtcgatccacgcgttcgcagagtacttctcgtcgtctctcatgctgttcgcggacgagttcattccgttccactacgtggagatccggctgtggcaggacatcaagaacccctgctgcgtcaaccacgaccccatcttctaacagcttcatgtctgccgctcgtacgaagtgctggttttcccggacagcgttttttacccgcttaattttgcgcccacgctcgaggccaacgagaaggagctcgccaacgggaggttggcgatgctggcgttactgggctttctgatctcatcacaacgttaccggctaggggcccttcgtcaacctgctgcagcacctgtttgacccatggcacaacaccattatccaaaccttttttggttgagtcgaggtctaggaggtatactacctcttgctggtgagctgatttggactggaagacaaacattgaaaccttaagtttctttctggatcagtctgtgtgtgtta

SEQ ID NO: 20581 - DNA, 425 bp, Zea mays
  Clone ID: cC-zmle18900029c10a1
ttttgatttaacgatttgttccatttctcttcaaaaattgctcaggcgtatgcaagcaccagaacaaacaggttacaagcacggaccacgtttctaggattcggacggatagttatccatgggcacgacagaaagctttgaaccaaggttaatgtctagacgaacatcattcattcactggtcaaccggtacagtatagcaaaaatgcctgttcagattaagctaaactttgagggatttctctagacagccaatgtctccccagatggccagagacacgagctaccaattcatttactcttgcgctcactgttgtagtcatcaatcagcttttcgacatcctttcagaacaggccttccacaagaactccttcctttgtaaaccactttgtcacgctcttagtgaaatggactggcttgtttgc

SEQ ID NO: 20582 - DNA, 531 bp, Zea mays
  Clone ID: cC-zmle18900029c10d1
cggacgcgtgggcggacgcgtgggcggacgcgtgggcggacgcgtgggctcgtcgacgatctcgtagcggcggcgcacatggcgagcgacggtgcggtggctacgccagcgaaggttaccccaaagaaggccaatctcctcgacccgcactccatcaagcaccttctcgacgagaccatctccgaggtcgtgaagagcaagggctacaccgaggacacgcggctgggcaactggaagctggggatcggagccgccgtgattgctgtcgccctactcgctcagttttaccccaagaagttcccgcagaaccgcgatttccttcttggctgcatcgccctgtatgtggtgctgaatgtggtgctgctgatccttagctacaccaaggagaaggatgccatcctattaacgccccctcctaggggttctttcagtagcactggcctcactatttcttctaaattaccaagattctcggccatgtacactcttacaatagcaagtgcggattcacagtttatttttgcaaacaag

SEQ ID NO: 20583 - DNA, 243 bp, Zea mays
  Clone ID: cC-zmle18900029d01d1
gagccattcgtcttattattacatcatttaattcattcttggtaagtactgaaataaggggtgatatctcgcttcatgatattttttcactgttagggctagttttggaacactgttttcctaagcgattcggtgaattgcctctgtatattatattcatcggttcaaaaaaaaagcatatttctgtataatagtattcccgtctctttttatcattcttaaaagtctattccatgcattggg

SEQ ID NO: 20584 - DNA, 441 bp, Zea mays
  Clone ID: cC-zmle18900029d02d1
ggtccttaattcccgggtcgacccacgcgttcgcccacgcgtatggcgcaagctcatggactagatggttgtcctggtcactgaggagtaccgctttgtcgtcgtcaaggagccgcgctttgtcgaggtcttcagatcggctacaccggagaccgagtacggcaggaggaacattggctgccggccagccaagaggaggcccggcggtggcattatcaccctgcgcgccatcccctggatcgtatcctggactcagaccaggtgccaccttcctgtgtgggttgggagtcagcgccggctttaagtatccataggcaaggacgtgaggaacttttaggttcctatagagatagacaacgagtggctatgctttagggtcaccctgcacctggtggagatggttttctccaagggagaccccggtatagccggcttgattga

SEQ ID NO: 20585 - DNA, 340 bp, Zea mays
  Clone ID: cC-zmle18900029d04d1
gaatttccgggtcgacccacgcgttcgggcatggaccccgcgctccgatgcgacatcgacgacgacgagacggtgccggagaaccccgtgcggacggacggcgccaccaaggctagggacgacatcgtgcacaacctgcttcacagcggacgagccggcaccaaattcttctgaattctctcagtcggttcgttcgttccatcagattcttctactatgctgctgctgctactctgtcttccgactccctctcctttcattggattggaaccgcccatggaattgatcattctgtgggttgtttggaaacaaataaattatttaacataattgggcgtgg

SEQ ID NO: 20586 - DNA, 283 bp, Zea mays
  Clone ID: cC-zmle18900029d05d1
gaatgtatcctgtatctatatggtttcaatgtgtgtctgtatgtactgaactgtacaagcttatcgagaaagatcactgcgagtctacaacaatccacacccaacacaggcggtggacacaacccatccaataatctttcatgagtacagtgtcggagtcatcggccaatttcttcaaaattatcattaatttatgatgctcatgtaactatagctccagggataaggcagggccggtttggtttcatcacccggatggggagcaccttttttggcgatcttt

SEQ ID NO: 20587 - DNA, 407 bp, Zea mays
  Clone ID: cC-zmle18900029d06a1
aacaccatcaggaccatttcatcttggtttaaactatacatacaggcgcagctgacacaacccaagggatgcctattatatacacacccttggctttgcttggctggtgttattctgtaagcacgctagctagcttttccagctttccgggctctaacacgtagatgtaaaccatttgctacacatacgtacatagcgggggggacaaaaatggatggatcagggtcttcaggcgtgcgccaacttcttggagaccccgtcctggtacggcgcctcgcaaaactcgccgccaaggtgatcgcacgcctcgcccgggaacaccgtctttggctcgtcctaggacaggtagttcctgttcaccccgaccacacttctgtttgccgccgccgacgccgaggcgggcttgg

SEQ ID NO: 20588 - DNA, 608 bp, Zea mays
  Clone ID: cC-zmle18900029d06d1
cggacgcgtggggtactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttccgatggaggcctgcgacctgcttggtggcgacgcgtgcaacgggcccatgttcccggaggccaagcccgcctcggcggcggcggcggcgagcaggagtgtggtcggggtggacagagactacctgtcctacgacgagccaaagacggtgttcccgggcgaggcgtgcgatgaccttggcggcgagttctgcgaggcgccctaccaggacggcgtctccaaggagctggcgcacgcctgaagaccctgatccatccatttctgtccaccacgccttgtacgtatgtgtagcagatgggttacatctacgtgttagagcccggagagctggaagaagctagctagcgtgcttacagaataaca

SEQ ID NO: 20589 - DNA, 349 bp, Zea mays
  Clone ID: cC-zmle18900029d07a1
gccttcatatatttttatggtgtgttaacttggtgtttttttttgtattgtttttgggttttttcttaaggcataacatggttcttattaatgcgagtgaactctgccttgatctagactgttaagggtgcccggatctgttaaggaggcgctgcaccggagctagtccaatatagcgaaagaaaaaaagaggatcaaaaaaccaagtaccaaaaaacaaaatttatttgggggggtggtgaaaaaactaatagttaggggggaaaaacgtgggaaaaaaagcttatttctctttatttaaaaaaaagatcggggcggtttggttgtaaacatagaaagaccggagggg

SEQ ID NO: 20590 - DNA, 541 bp, Zea mays
  Clone ID: cC-zmle18900029d07d1
ggtcgacccacgcgttcgcccacgcgtccgcccacgcgttcgcccacgcgtccggaagtaacctctttgataggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaataaatataaagctgcagaacaagcttttgctgattggtatcggagggctcaacttgctctttaaaagggtgacgaggatcttgctcgtgaagcccttaagcggcgtaaatcatatgctgacaatgcaagctccttaagatcccagcttgatcagcagaagggtgtagttgaaaatctgatttcaaatacccggcttcttgagagcttgatagcagaggccaagcagaaaaaggataccttaaaagctcgtgctcaatcagcaaagactgctacaaaagtgagtgaaatgttgggcaacgtgaatacaag

SEQ ID NO: 20591 - DNA, 721 bp, Zea mays
  unsure at all n locations
  Clone ID: cC-zmle18900029d08d1
ggagaagaaaagaaaaagaaaaaangaaaaaaagaggaagaaaaaaaaagagaaagagaggagaaaaaagaaaaaaaaaggaaaaaagaaaaaaaggggaagagggaaaagaaaaaaaaaaagaaaaganaaggaagaaaanaaaagaaaaaagagaaagagaaaaaagaaagaaaaaangaaaaaagaaaagggaaaaggaggaaaaaagggaaaaaaagagaaagaagaaagaaagaaaaaaaaaaagaaaaaaagaaaagaaaaaaaaaaaaaaaaaagaaaggaaaaaagaaaaaaaaaaaaaaaaaagaaggaaaaaaaaaaaaaaaaaaagaaaaaaaaaaaagaaaaagaagaaaaaaaagaaaaagagagaaaaaaggaaaaaagaaaagaaaaaaaaaaaggagggaaaggaagagagaaaggaagaagaaaaggaaaagaaaagaaaaagaaaaggaaaaagaaagaaagaaaagaaaagagagaagaaaagaaagaaaaaaaggaaagaaaaaagagaaaaaaagaagaaagaagaaagaaaagaaaaagaaaaaagaaaaagaaaaagagaggaaaaaaagaaagaaaaagaaagaaaagaaaagaaagaaaaagaagggagaaaagagaagagaaaaaaaaagaaaaaaagagaagaaaaaaaaaagggaaaaagaaaaaaaaaaaagaaagaaaaagggaagagaag

SEQ ID NO: 20592 - DNA, 379 bp, Zea mays
  Clone ID: cC-zmle18900029d09a1
gttattatttgtttattttgtgttatttttgagtttttgataagatttttgggtttagtgagccgcaaaaagggaaaccatttggggttacataccccatggggagatgcaaaaacgcccacaagcgagaaccttggtttttgttgaagaagggacaaagcggcgggacccccgctgggtaaaaagccgggcgacgaggtaacatttattaccccggctgggtgaacgcgttacgggcaatgaacaggggccttgatccaaccattggcgaaagcccaggccaggcttaccaaggggggggacaagccaaaaattattatgtttggccggggggtcaaaaagggggtttacccctccctctccgccgggggctggcaaa

SEQ ID NO: 20593 - DNA, 434 bp, Zea mays
  Clone ID: cC-zmle18900029d09d1
gcagaacaaccatgatatgggcaccggaagtaatcctgtactctctgtctgtaaccatacagacataacatgcgggcatgcatcgtagaggaaaggatccctatcgaccatttagatgtgcatgcatgacgcatgcagtatgcgctctatggtaacagtgaaggtctgagactgagagctgtatactgcgagtaatctgtagttgcttaccacggactaggctcctgtacagtcctggctggccgcgggggagagggagggctagaaccccaagatgacacctctggcctacattcatcatcttcgggatggtcacccccttcgtcatactcgtcattggctttgccaatggctggatcaaggtccttgtgcgatgaccgttacgcgatcagccagcctggatcatatatgctgactagtgaaccagcatttta

SEQ ID NO: 20594 - DNA, 180 bp, Zea mays
  Clone ID: cC-zmle18900029d10a1
gggcccctccccccccaaagggccttttaaaaaacttggggtttaatattaaaaggaaaaggttctttttccgggttttttttaacaaaaacatatccaaaaattcgggggccttggtaacccatttattatttttcatctagggcaacctgggggggaccctcccctgccccgggggtt

SEQ ID NO: 20595 - DNA, 171 bp, Zea mays
  Clone ID: cC-zmle18900029d10d1
aatttcagggtcgacccacgcgttcggtctactgtcctcctcaacgttgtcctagatggaagtcttctattatgggttaatcgtatggccactgttatggtcggacgtggggtttctttcattatggtagccggcataacgctaccgttcctctgtttatatttactatcc

SEQ ID NO: 20596 - DNA, 432 bp, Zea mays
  Clone ID: cC-zmle18900029d11a1
gggaatgattcgtgttcatcttaatttttaatgataaatatgcctgtatccaaacatccgggcattcatgtaataggtgaatcataggaacatgctctggaacaagaggcggaatctaagcttgtgcggagtcaattcccctttggtgcacccttctttgcagtctcgggagcggccttctctggttcaatttcggtaacatacgtatgaatctaagcctcttcgagttcatgaaggccgtcctcgtgtgtccatcactgcaatctttatgttgttgccaccactctgaacaacctgaaggagtgctctgatggtgagcttgatgggcttcttaccggacgtctccttgtaattcttctcgagaaactcgcgcatggagttggagttgcggccggttgcgttggccttccaagcggaaaaggtccccgaggg

SEQ ID NO: 20597 - DNA, 600 bp, Zea mays
  Clone ID: cC-zmle18900029d12a1
tacgggggctgcacgcagaccttagcttgtgtactatggagcggtcgaccttttgaatgttttttttgttggtgatcttgggaactttgaactttgactatgtatatagtatgcaaaaaaaaggctcttgagagagtagtgatttacaacaattttttgggtggctgtacaaatgtcactccacggggaaaatgtcgagaaattatccgattccatactctttaacaaacagtgaatgcgcacttgtgttgtaactttcgaaacgcgcaatggagcaatctgcagctgcactatattttcttggaaatgagatgccgtcaggcccgctgaatcgacaaggaatggatctaatattccttggctttcctccgcagctcgtttagcttgctctcaatctctaggtgggggaaagggcgcccaacacctgagttgctgactgctgttctgcctggaggaagctctcctttcaaagagcttcccaacaattcctttttatgttggagagatcatcatcacagatgaagttttagcagtgaaactttctttaaatatcaagtgttactggccagtgccttggttgggattcatcggcaaaacttt

SEQ ID NO: 20598 - DNA, 553 bp, Zea mays
  Clone ID: cC-zmle18900029d12d1
aattttcgggtcgacccacgcgttcgcccacgcgttccgcgccctttctgcatttgagaaaatggaggaaatagttatggtgatggtattctaagcataggcactctgccagttagcaactgatgatttagaaggaaagtttgcactgcttgagactttatctgttgatgatgatctttcacatctgaaaaaggaattgtctggaagctctttgaaaggatagcttcctcctggcagaatagcagtcagcaactcaggtgctgggcgcccttttcccgacctagagattgagagcgagctaaacgagctgctgaggaaagccaaggaatatttgatccattccttgtcgattcagcgggcctgacggaatctcatttacaagaaaatatagtgcagttgcagattgcttcattgcgcgtttctaaagttgaaacactaagtgcgcattgactgattgtttaagagtatggaatcggctaattatccgcatttttcccgtcgagtgacatttgtacaggttttccatataaatggttggtaattacctactctc

SEQ ID NO: 20599 - DNA, 307 bp, Zea mays
  Clone ID: cC-zmle18900029e01d1
agagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaaggttgtccatgaggaatttggcatcttggagggccttatgacaactgttaatgcaacaacagctacccca

SEQ ID NO: 20600 - DNA, 67 bp, Zea mays
  Clone ID: cC-zmle18900029e02d1
ttcccgggtcgacccacgcgtacgcccacgcgttcgagaaaaaaaaaaaaaataaaaaaaattatgg

SEQ ID NO: 20601 - DNA, 470 bp, Zea mays
  Clone ID: cC-zmle18900029e03d1
cccacgcgtccgcccacgcgtccgcccacgcgtccgcactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcatcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctccgtgatgtcaagggcgcct

SEQ ID NO: 20602 - DNA, 165 bp, Zea mays
  Clone ID: cC-zmle18900029e05d1
tccacgcgtccgcccacgcgttcgtgtgatttatcgtaattgttcccgcaagcaagagagtgaatttgttttgagggcttaaggttgtgttgtgcgtgttggattggattgattaaaattcgtagtttcgtacttgagaaataataataatctaattaaaataag

SEQ ID NO: 20603 - DNA, 454 bp, Zea mays
  Clone ID: cC-zmle18900029e06a1
acgggtatgtatcctaccaaagctggaaacctaagagccgtcgcactatcgaatccctcaatttttgttagacgggggggtgggtcttagggatttcctacccatgtcgggggagaacatagtgtggccttctggtctctttgaatccggcacagccctgcctatttattggactgtgtaaccaccagcgagccaaaccacgctttctgggggcccaggataatttatctggcgaagatgttggccacaatattgggcggtttggggatctcctggctcgcaacgggagcggtatctcctagcttggcaacctgcctgggctccccccttgggtcctttttgcagatcttgcaggggggtgtcgacccaaccctcctccacgtattgcccgttgacttttacatatgactggaagaaatcctggtatgtgccaccaatctttcgtctaagtgct

SEQ ID NO: 20604 - DNA, 649 bp, Zea mays
  Clone ID: cC-zmle18900029e06d1
gggtagactccacgcgtacggagctctcctgctgaccccttccaggagcttctcgtttggagcttaccaaaccaggccgagcggtggtggtcctagatcagtgagagcttatgcgatgggagacgaggagggcgactagcagtttctttttggaagcattaccgaggcgctggacttattgcaggttcggtcggagaaggacgccgagctgctgtactaggccagggagttcaccagaggtggagggaggatgactagggagcattacggagcacttatgcggaagattggtggcacctaccaggatttcttcaagtcatatgttgaagtcgacgggcaatacgtggaggagggttgggtcgacaagacctgcaagatctgcatgaaggacacaaggggggagccgatgctagttgacaagctaggaagatacgctcacgttgcgtgcctggagaaaccccaaaccgactgaactttttcgccaaaatcttcgtcagatgaactatgttgggtacgtcgaaagcgttgtttcgcttgctcgtggttagagagtacaatatataggtagggttcgtgtggctatcaaggggacaagaatgtgcacaatttttcaatggttgggttgtactgagagcttctggggtttcat

SEQ ID NO: 20605 - DNA, 412 bp, Zea mays
  Clone ID: cC-zmle18900029e07a1
agcaaacttggatattggattagcttagtttgtagtatgctattacacacgactctagctatagctagctcatatacaaaccatcacatgatatatagatacacatacgcatgcatcatgcatgcacatatatataggatggagtaatctataatacttaattacacgcacgcgcgctatcttttgatcgtgaagaaaagagattgctagctttattccgggccgatgatgatggaggcacatatatatacatagatccttgggtctacaatacgttgacagtaatctgtatatatgcttcgtgtagtgggtttggttggttcttattgtcttcaccgccgtcgtcgtcgtggtggatgacgacaagtcgcccgcgttcgcgacgccatgatcagaacaggaacgccgtcgg

SEQ ID NO: 20606 - DNA, 493 bp, Zea mays
  Clone ID: cC-zmle18900029e07d1
gggttgacccacgcgtccggacacagcagctccgctcgtcgatcagctctcggctgaccactcatcgccagtgggtgcctgccgaccaggtctcgccgccgtcaccgtcgtggtagagaggggagggagagggggaaaaaactggcccagatcgagaggtacagttcgaaatatataggcaagatagataggggaccggagggcggtggtccggggcccaagaccgaggggctcgtgcgcaggaagctgatgaggctcctgtcgctcgtcccctttggctgccgtgctggacccatcgacgacgcgccgccgtccgtggaccacgccgccgccgcgaggaggcgcccgaggaggagggccaacagggtcgcccagctgttgggggctgctgcgggtgcgccgcaacagtggcgcccctcgctcggcgacttctgcgaggagtacagcagctgcactcgacgccgtcaggtcatgaaggcggctgtctgggacc

SEQ ID NO: 20607 - DNA, 307 bp, Zea mays
  Clone ID: cC-zmle18900029e08a1
acctttctattggtctttttgcttgccttgggtgatttttgctttgtctggtttcgcacgacgggggggaaaagaacccctgcgggcctcaatccaccacatttttgggctttctttttttgcaggacatggtcatgatcacccttttttaactgataaccggcaccctttacaggggcccaggccggaccttttacaaacgccccgggccctgcccatattgctctttgccgggaagtttggccacggtgggacacttgacagccatttgccccacccgtcccaggacccgtgggcggacccgtgg

SEQ ID NO: 20608 - DNA, 312 bp, Zea mays
  Clone ID: cC-zmle18900029e08d1
ggtcgatcacgcgtgcgctccacgcgtccgcggacgcgtggggcagatggctgtgaagtgttcatccgtgacagaacttcactgcatagagctatatgtgcatgtacctgtgtgtttctaaatgatcatgtattggccatgtaagtgtgcctgttatcagttatagaagggtgatgatgatcatgtactgcaaaaagagaaagcacatgaatgtgttggattgatgtatgcagtgtttatttttccttctggttgtggaaatatataatattattatatataatatttatatattatttataattataaagg

SEQ ID NO: 20609 - DNA, 257 bp, Zea mays
  Clone ID: cC-zmle18900029e09a1
tttttttttttttttttttttttttttttttttttattaagtggtttgggttttattcaaaccagcagttccacaggcagcatggaaccccccagaagaacccgcaaccaacccggggcgaacaagactcgccacaaaaggggggaaaagggaggcggtagaagacagggggaaacaaaaccccgggcgaaaataagcccacgtcgcacacaaaaaaaacaaaccgccagcagaagaaaaaaaaaaccacggggggc

SEQ ID NO: 20610 - DNA, 422 bp, Zea mays
  Clone ID: cC-zmle18900029f01d1
ctcactcttctggctctctctgggagcgccacctgaactcatacaagctgacgttgcggctggcacccaccggcggcgggacatctaccgacgacggggcatctgccacctacggttaacgtgccacctactgtgcagggcccaccggctgaccaccggccgtggtcagtacacctggcaccggcagcccatgagccgtctctagatactcaggaggcgtcgccaggcgactaacctactgaaccgtcgcggactgagactaatttctaagcacacgcatgcgcgtgccaacagacgaatacaagaccgtgccaactgcagggaacctgcggagatggcataaatccgatccacaggctgcgcgtcgagttcctgaagcattagtgcagcccgacggggacggcctactgataggatcaaag

SEQ ID NO: 20611 - DNA, 405 bp, Zea mays
  Clone ID: cC-zmle18900029f02d1
cgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttggggggtggttgaacaataataagcgaggcccagctggctgccatacataggatttgtgtggtgcgtgtg

SEQ ID NO: 20612 - DNA, 437 bp, Zea mays
  Clone ID: cC-zmle18900029f03d1
ccagtagtcgttgcgtttgcagctaggcagatctgagttagccggcggatccgatccgtgcgcgtgcagtgtgtgtgtgtgtgtgtcggtggagatggccacagcttactctcccatggcgagccaggtgatgaagagcagccttgtcgtgcactcgaggacgaggggcctgtcaggcgctgctgcgctcacgaggcggtccgggcggttcaccgtcaaggccatccaggccgagaaggcaatgtaccaggtggtgcaggccatcaacggcgaccccttcatcggtagcctggagacgccggccacctcgagcccgctcgtggcgtggtacctcttcaacctaccggtctaccgtaccgacgtgagcccgctgttgcggggcgtcaaggtcagtctggagcacggatatcttcttgtggggccctttgtgctcacgg

SEQ ID NO: 20613 - DNA, 530 bp, Zea mays
  Clone ID: cC-zmle18900029f04d1
ccggaatttccgggtcgacccacgcgttcgccagtagtcgtcgcgtttgcagctaggcagatctgagttagccggcggatccgatccgtgcgcgtgcagtgtgtgtgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggtctaccgtaccgtcgtgagcccgctgctgcggggcgtctaggttggccttgcgcacggataccttctcgtggggccctttgtgctcacgggcccgctccgcagcacgcccgtgcacgggcaggccggcgcgctcggcgccggcggccttgtcg

SEQ ID NO: 20614 - DNA, 424 bp, Zea mays
  Clone ID: cC-zmle18900029f05a1
acagaccaaaactccaaataagggagctcactttgccaagccgtacactttgtatgttttctttataccaaatatatatgcatacttttttgtgtgtgcatacaacagttcaaacgagagagcgatgaaactggcaaaaaaaaagggaactgaactgaaccgcactagtatcgatccgtgaggaaatcaacggtggctttaagcgcgtcgacgaaggtatccacctcgtcttttgtgttgtagaagagaagactcgcacgagcacttgcgttgatgccaagggtcctatgcaagatctgcgcgcagtgatgccccgaccgaatcgctacgctatgctgcagatcaagaatctctgcgatatttgtaggatggacgttcttgatattgaaggagcacaacggagcacggtgtacagtctgggaag

SEQ ID NO: 20615 - DNA, 465 bp, Zea mays
  Clone ID: cC-zmle18900029f05d1
ggaattcctgggtcgacccacgcgttcggtaagaagaaaagttgcaaattttatcaacgcagctgatagcagagagattgttttcactcgttatgctactgaagctattaatctggtagcctattcatggggactatctaacttgaaagaaggagatgaaattgttcttacagttgcggagcatcatagtgctattgttccatggcaatttgtttctcagaagactggtgccaccttaaagtatgttggattgactaaagaaaatgtcccagacattgagcagttaaaagggtttctgtcgaacaagacaaagatagttgttgctcatcatgtctcaaatgttctaggttccatgctttctattgaggagattgtaacatggtcaaacagagttggagctaaagttcttggtgacccttgccaaagtgttccccatatgccagttgatgtttagaaacttggcgc

SEQ ID NO: 20616 - DNA, 106 bp, Zea mays
  Clone ID: cC-zmle18900029f06a1
ttttgtaaataattatttaaaattaggtaaagattggagttaaatagtgtagtaaaaggaatattttgtttggaaaagatgaaaatttaatatttgattttgaatg

SEQ ID NO: 20617 - DNA, 264 bp, Zea mays
  Clone ID: cC-zmle18900029f07a1
aactagatgatattttttattattatttcctccataccacagaaatctcttcctataaatatccatcttcagaacaaaggagagagctaagttaagagaaagcatataaaggggaatgttacacaagctactatttataaagccatcatcatgtagtgcagtactgtaccatctaaacaggctgactctgcaggccaacagacgcacgcttttttttcaggggctgcacgtctcgaataatagcgtgcagaggcacatttcgac

SEQ ID NO: 20618 - DNA, 282 bp, Zea mays
  Clone ID: cC-zmle18900029f07d1
gggtcgaccacgcgtccggtcgaaatgtgcctctgcacgctattattcgagacgtgcagcccctgagaaagaagcgtgcgtctgttggcctgcatagtcagcctgtttagatggtacagtactgcactacatgatgatggctttataaatagtagcttgtgtaacattcccctttatatgctttctctttacttagctctctcctttgttctgaagatggatatttataggaagagattactgtggtatggaggaaataataataaaaaatatcatctagtt

SEQ ID NO: 20619 - DNA, 336 bp, Zea mays
  Clone ID: cC-zmle18900029f08a1
gttatttttttttttttttatttttttttagtgttaactttttattttgtttgtgatctttttttctatattaacggtttttagtgactaaaaatctgcttttggggggcaaatataagatgtatttgaccaaaaaaaaaacaaaaaaattaacaacccttaaaaaaaaaaaaaactttctcccggaaaaaaaaaaaacgcccccccccccccaaaaaaaccactcaaaaaaatccttagggtttttaaagaggggggcataataaaacaaaatttttttgggggggggggggccccgaggggccaaatatcaaaaaggagggcccccatctcctt

SEQ ID NO: 20620 - DNA, 357 bp, Zea mays
  Clone ID: cC-zmle18900029f08d1
gctgcttcgagacctgtgagtgctgcctcgaggctatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttttgtgtgtgtgtgcgcgcatcttcatttgcactggaaaatgctttattatttgtgaaggtctgtaaatctgttgtatgtatcttggtcagatgaactctattattgtgccaaattatcttaattttcaatttttttttatgatatttatttattaaaatattatgtatctcttt

SEQ ID NO: 20621 - DNA, 407 bp, Zea mays
  Clone ID: cC-zmle18900029f09a1
ttttatcttttgagcttttgtattacgagctgaacttacaggccatcagagtagttcagtacagaacatagataatccagatttaaaacatcggtgccagaaacgttttgagaggcaaggctgcctgaaaaggtacataaaagagctacggttataatacttcgacaaaatggcctcgatcagcaggctggtatacttcactgcttccttgctgcgacaatgttgacagcctcttttttcacaggctctttcttctctgacaagatcagctcaatgtggcaaggtgaggacatgtagggattgatgcgtccgtgagcacggtaggtgcggcgcctctgtttctgggcttggattacctggatgtgtgaaatatagaggttgtccacatacaagcctttcacatcagc

SEQ ID NO: 20622 - DNA, 326 bp, Zea mays
  Clone ID: cC-zmle18900029f10a1
gggacccaaacccctttttgtttttgctagcatgggccaagggcactttttttcacaagggggggaaggggttaaaaaacccaattttgggggtttttgctccaaaaaaaaaaaataattccgttattttgaaaaaaaagggccctggccatgaatttgccaacccaacttatgggcccccgaaggttggctttggccccaaaaggccttaatttttttccacttttttttccgggcccaagtccttaaatgccattgtttgggggggccccccccgatctaaccgggaaagggaattttaccggttggggaaaccccccagggga

SEQ ID NO: 20623 - DNA, 549 bp, Zea mays
  Clone ID: cC-zmle18900029f10d1
ccacgcgttcgcggacgcgtgggcgcgagagaaggaaacgagtggccaaggactctggaaagaccgaacagcaggtgagccaattggtcgcgcaactcttccaaatgcgtgcaaaaatgcagaaaatgatgggcgctatgcaaggaaaagagtcaccagacatggacgagctcatggaatcgatgaaagctgaggagcaggctgctgtcggtactggacggcgtagaaggaagtatggcaacctgaggcagaggcaactggatgccatgcgtggtttccgcagacggtgagatgctcattgccggctagtactggcggtgcctgcacgaacgatggcatttagggacttgggctcggatatagaagtggaagaagatgaagtgcttttgggtgcaatggcaatcatctgggtacattgagttgagtttgcatattcatgtgcagtgtcctattttgtcatattagctggattattatctttcttcggagcaagaacttcgcaaattgcgttatttgaactctgtccaccgtcgtgggaacgagtgcact

SEQ ID NO: 20624 - DNA, 517 bp, Zea mays
  Clone ID: cC-zmle18900029g01d1
cccacgcgttcgcagttcaccccacttgctctctttctccccagtagcaacgaccgcgcgtcctccgccgccgcactaaaccctactccatgtacccaggtctgcgtcgggcccttgccggcgatgagaacccgtcagttccaaagatggctcgtcgtggattgatggaacaggacttaagcaaactggatgtgacgaagcttcaccccctgtcacctgaagttatctcacgccaagcaacaatcaatatgggtaccattggccatgtggctcatggaaagtccactgttgttaaagctatatctggtgttcagactgttcggttcaagaatgagctggaacgtaacattactataaagctgggttacgctaatgcaaaaatctacatatgtgaggatgacagatgtccgcgaccaatgtgctacaaggcctatggtagcggaaaagaagatagccctctatgtgatgtgcctggatttgaaacactagaatgaaactcctgagacatgtttctttt

SEQ ID NO: 20625 - DNA, 626 bp, Zea mays
  Clone ID: cC-zmle18900029g02d1
cccgaccggaatttccgggtcgacccacgcgtgcgtaataaaatcagtatataataaattcaatcgaaatcatgcttacaatttcatcaatcaacatgagtgaatacaactttatctagaatccacgtataattgaagcataaagaatccaacacaagtattaaacatcaaacatatttaaataccctataacttaaatacaaaagcaagtcgattcagctcaacggccaaatgcagagcacaactattacaacataaatataattagatcacctagacaataagtataaggaataaaaaaggtccaatgttgtgggatgtagcttcaaagtttccatttcttgcctaagtctatcttttttgcctcttagtctccagttgagattggagctcttgcacctttgctaaaaacagagcttgtcttggaggtgggctaaaggccaaccattgtgaaagaatttacttgagctcgacaagacatgggaaacgacttgtgtagaagactatgcaagttgtccatcttcaacagagcttgttttggaggcgggctaaaggccaacattgtgaaaaaattacttgagctcggcaatacatgggatatgacctgtgttgaagacttgcaagct

SEQ ID NO: 20626 - DNA, 503 bp, Zea mays
  Clone ID: cC-zmle18900029g03d1
cccacgcgttcgtgcgagaaggtctcgggagcgataccgagggagaagagagacccgtcgccgccttatttactcggcatcaccggagcacgaccattgggttgtcaggggtgctaactaagactggtggaacctattggtggggtttcgaggctcggtgaccgaccgtggtatacccaattgctcaccggggtgctctactcgcagcagagacgctatttgccatgggcagctctctgggcatcaaatccatcacaggagaagaacatgtggtctaggaggagccttaccacgaggagtaccagcttatctaggtggcgtctcccagtcagcttgatggcgcgcgggaacaatactgaggccgctctattgctcttattcatttttgcgagacttctgctatataataatgatatttgtgacacttatctctatacactctgtaattatatgtgatggacttgtttggcgcacatatgagaacgcacccgtctatatccctt

SEQ ID NO: 20627 - DNA, 430 bp, Zea mays
  Clone ID: cC-zmle18900029g05a1
ttcgtcgacgaggaggtcaccggcctcgacaaggccgtcatccaacctggcaagggcttccgcggcgccctcggcctcagcgagggagggccgctgttcgggttcaccaagtcgaacgagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggcctcggacatgagtcgtgtgcgtttacttttacctgtgactgtgagtgatcgatcgattgctgtgtatcaattactcgtgatgagacct

SEQ ID NO: 20628 - DNA, 367 bp, Zea mays
  Clone ID: cC-zmle18900029g05d1
ctctcttccttactttcactttttctggggacttgggtattttttcttctttttcttccttgctcaactcttctaccccgccctccaaaaaatatattaaatctcattgtgtattaaaaaaaaaacccactcagggccgcccactctttgggggtcccaaccggaaaaaggtactccacatttggtgctgcccccccccgccccggggaaaaaaaaccccccccccccttttgcgggggggccagacttattttttttctcccccaaaaaaaaacctccctctggcgggggtgtggggccctataaaaaaaaagaggcttcaaaaaaacaaggcgtctctttttttgggggcggccccccctcacaa

SEQ ID NO: 20629 - DNA, 348 bp, Zea mays
  Clone ID: cC-zmle18900029g06a1
gcgaacaaaaaccttgctcattcttttctcggctcgtttcatagcgggagcaaacaaagggaacaacaggggtaccaacacctaatccaaaggtagaacggacactaacacggtgacagaagcgaacgggaacacgatactatagatagataagataactcggccgaagccaggatgggcccacacattagtcccttcagccgccgccgccgccgtcgtagccgccaccaccaccctcgcgccgaccgccgtagccgccaccgccttcgtagccgccggcaccaccctcgcgccgaccgccgtagccgccaccgccgtcataaccgccgtcacggcgcccgccaccat

SEQ ID NO: 20630 - DNA, 473 bp, Zea mays
  Clone ID: cC-zmle18900029g06d1
gctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgataccttctcctccgagaactccatgctcgacgctatcgagaacatgaacggcaaggagctcgacggccgtaacatcaccgttaaccaggcccagtcccgtggcggtggcggtggcggcggtggctactgcggcggtcgcggcggcggcggctatggtggcgggcgccgtgactgcggttatggcggcggtggcggctacagcggtcggcgctagggtggtggcggcggctactgaggcggtg

SEQ ID NO: 20631 - DNA, 220 bp, Zea mays
  Clone ID: cC-zmle18900029g09a1
gggggcgaaatcatacacgatcgaccaagagtcaatgcgtgtataccgagagaacaaaactacaattaccgcaaccaatgcatagaaaacacactagctcaaaataaaacaaaataatcaatctatcctcatacccaaacaaccaaatgacgaatcgcaataaaccttgcgtaaaaacatacaaacctcatacgcaatgatcactaaaaccttcacgtga

SEQ ID NO: 20632 - DNA, 79 bp, Zea mays
  Clone ID: cC-zmle18900029g09d1
tggagtttctgcctagatgcagatgtgcgacgtcgtataaactatcccttgagttcgagtgctcttggaaataaaagtt

SEQ ID NO: 20633 - DNA, 439 bp, Zea mays
  Clone ID: cC-zmle18900029g10a1
ttttgggaactgtaacttcaattatcattttgtgtttggagggaagatatgcaactgtctctcctcacatgcatgatgccgggaatatggacaagaaacaggacacattaggtggtgacacacacacacgcacacacatatttaacaaaaccgtgccggcgtcattgatgtccaatctgatcatcgtgaaccggcagctcctttaccatgacaactcgccttctcctccccacccaggagacccagtctggatcccttgacacgaccctgtaccctgccttggagtagaggcctcgagcgccgtcgtcatcctcgtacgccctcagaaccatgaacacgtgcctccattggagccccagggcctcgcaggccttcagcagtgcgggccctaccttcctcctcctgaatgatgggcagactgcaattcctgacacgtaga

SEQ ID NO: 20634 - DNA, 501 bp, Zea mays
  Clone ID: cC-zmle18900029g10d1
ctttctcccccatccgctctcgcgcccctctcagtgcaagctgcgccccacctgccgcgtggtcgcagccacaggcagacccagacctgctccttccaggcccaagagcggcggcgtccatggaggccgccccaagagggggcttcttgcggcatggaaaatgtcgggggaggggcgggtgccctgctagcgtgccgaggaggcgggggtcggtgcggcaggcgtcgcgaaggaggaagacgagtacctggcgcgggaggccgggtggggcgtgcggcggttggcacgggttgaggaggagatgccgtgggtggcgcaggtccaggccgtggccttccacgttctcgacgagctcttcaacgacttgttcttcgactattttaaagccgaggtgctgtcggcgcttatttactgagtgaggaactcgtcgtctgacagatacgcttgtttggtggctgaagaaactgaggcaggcgactcacccgtcaaaggcaccatatg

SEQ ID NO: 20635 - DNA, 251 bp, Zea mays
  Clone ID: cC-zmle18900029g11a1
agcaatcagataatcaattaattggggcaatatgctgaagttgaatgtactaacgatcaaatcccatttgtttgaaaacagaatgactaggatcccagctgatactataagtctgtagcacaagagagagaagcaaccattggcgtcccgtccccagaggaccaccagcaaacatcataaaaaggggtattatttttgttgcagatggacagatgaaccaggtgaataagcagcgtaaattggaatggtcc

SEQ ID NO: 20636 - DNA, 312 bp, Zea mays
  Clone ID: cC-zmle18900029g11d1
aatatctgggccgacctacacttccaggaccatatccttctacgctgattattcacctgtttaaattgtccatatgcagtaaagatgataccggctttttaggatgttcgctggaggtcctcagtagacgggacgccaatggatgctaatttctcttgtgctacagacttatagtatacgctgggatcctagacattctgttttcagacagaatgggtatagagcgatagtacattcaacttcagcatatcgtaccaattatttgataattcgactgcttatataaataaaacattttgtcacttagggctc

SEQ ID NO: 20637 - DNA, 434 bp, Zea mays
  Clone ID: cC-zmle18900029h01d1
gagccgtccgtgtccacgaggacatgcttctcgccgtctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtagtgctgcggggatcaattttgcagtaataaaaatctatcaacgcggatggtactctgttgtttatagtccctgctgctaaccacccttgttgctggtgctgctggagaggcattgtacctgtccatgcatatatgatatatatggtgtaacgctgtgaaagcaaacaatcttgggtac

SEQ ID NO: 20638 - DNA, 303 bp, Zea mays
  Clone ID: cC-zmle18900029h04d1
tttccgggtcgacccacgcgttcgggaggccgctaacctgtccctggagaacctcaagacctaccccttcgttaaggatgggctggccaacgggacgctcaagctggtcggcggccactacaacttcgtgtcaggggagttcctcacatgggacaataagctgccatcatgaatctatatatatacactaatgcatcatgtacgtattcagcatgcagctacatacatatatataccggatcacccaatgcaatgtgtgaatgtgtaataagcaataccatatattctaccgcttttattttc

SEQ ID NO: 20639 - DNA, 475 bp, Zea mays
  Clone ID: cC-zmle18900029h05a1
tgtttttttttttgttttttgtggagttatttatattgttggggggggggattaattggggtttttgataatagtgttttattagttttttatgttgtggaatgttggtaggggacaccaaaaacaaggaagggggaaaaaaaaaaaaagggggggaggtaaagaaaggaaaatttttattgggggggaaaaaaagggggggggggggagaaaaaaaacccccaagggggtaaaccccttgggggaaaggggcagggggggggaaaaaaaaaaaattttttagagggggggggttttttaaaagggaaaaggtgggtttccgcggcgggggggggggtctcggaatgggggaaaaaaagggggggtgccaagggtagtgcaaagaaaaaaaatatcaaaaaccgggggggaaaggagggggggtggcccaaaaaaaaaaaaaccggggatagcccattgtaaagggggggagggg

SEQ ID NO: 20640 - DNA, 524 bp, Zea mays
  Clone ID: cC-zmle18900029h05d1
cgggtcgacccacgcgtacggcgacaatgcatcaacctctccaaggccacaataccctagccaaagcactgcacctacagcgcacatacccaacacaagcaaccagcaaccatcgccaagcttatatgctccaggaaaccctggtctgacacaatgcaagaattccatggacctttaaaacgcattatccagtcccatccggcggagcctgcaggcataccacctaaaacaggacggagacacaaggtactttgagaacggagcaagccgcgacatgaaccccacggcttataacgatacaaccatggacatgcactcggacagcccagatcatgactcctactgagcagctacttatacggaaccggaagaacagcatattcaggcgaagaagtgccaggcctaggaggaatatacaatttaacaccttacgaaggctcttacactaagcgtgtgaagccaagaggcgttgatgctactacataccacctgtagctttgacagaatactgaaatatgcatgta

SEQ ID NO: 20641 - DNA, 457 bp, Zea mays
  Clone ID: cC-zmle18900029h06a1
ttttttttttttttttttttttttgttttggtttttgttttgggttttgttttttttttagatttgttgttttttttttaagtaagttttgtttgttttttttcccacacaaaaaggaaagggggttggttttttttttttttaaaaaatattttaaacaatttggggtttagggggcggaaaaaaaaaaaaactttggggggagaaaaggggaatttccccccttctttttttgaaagggggggttttaaaaccccccaaccccaaattgttacccctttttttacacacgggggggggggggtttaaaaaaaaaaaaaagccgcaaaagggtatttgggggggtttttttttttgcgcggggaagagcgaaactttttttttttaacaggggctaaaaaggggggaatttttaaagggggttttctccgcacaggggttttttttttgggggggg

SEQ ID NO: 20642 - DNA, 499 bp, Zea mays
  unsure at all n locations
  Clone ID: cC-zmle18900029h06d1
cattgtgataaccatattggttgctgctgagggagtacataagctgccggttataaatagcagcaatgacttaaagacagctctacaaaagatgggtgccataccatcaagcaaaatactggcagtcgaggtcctgtggactccgcaaaatgagaatgacacattgtccgagcgagagctccttgaagattacccgctcttaaggcctctgtagaaagataaaagttacagattgcccgtgcaaaggaagaacacgccgtagattcagttttggcggttttcttattagttatagcacagatcctgcgtttgtataataagtgtataataatttgtaattggcgtctctgatagccttcatttcagaacatggaacgtgcaaatctgcaattgtctgtcagtaagtcttgttcaatcttcctgacacaataacacanaattgtaaatagattgttcagagaaaaaataaaacaggacatgctgcatatgtgcgtgaaaa

SEQ ID NO: 20643 - DNA, 490 bp, Zea mays
  Clone ID: cC-zmle18900029h07a1
tttttgctattttaaactccaatctataaaacaatagtctacgatacaaaaacagtgttttacacggtcatatatatgatcaggccatagcctaaactctaagcactcacacaaacatgcaccaccagtaagtaccataaccagaccaaatataactgaggtacccatgcccgaaaaccgaaaattctttccgtggttcataacaataaccagacccaaaaatgaatgaaaactaggaaaacagctagtgttgcagtgagcttactaatcaatttacaaatttctcaatttacgactactttttttttcccaaactcgtatcacgctaaacaataggggtaccacagaacctgatgtacacaacaattctgaagacatctcatgctactgcatctgccatgagtccataactcttacattttctgcacaagctctctgattccagactgctgatcagctgatactcgcaaaccaggtcgttaccttcaac

SEQ ID NO: 20644 - DNA, 584 bp, Zea mays
  Clone ID: cC-zmle18900029h07d1
atgggggggggacgagctactcagccgaactatcagggtttgggtcgttgatactactgaaccagtttgtagatagagcggatggacatgagtctttcgggcaactgctggcttggacatgatctataaatgtatccggaaagatccacgttacaaaaacatatatgcgaggggctcgtataatcatagggatgatgaaccgttgctgaagatggagttagaaaatcctgcacgttcttatctggcaacttggtcacaactttgtataacctgcaaaatagtcagacctggacgttcaaaacattgttctacatgtgatcgctgcgtggagcagtttgaccaccactgcccttgggtatctaattgcataggaaagaagaacaaatgggaattcttcatgttcctcactctagaagtttttgcaatgatcattactggctctgctgccattaataagaattgtaagggatccaaattcctcatcatcctctggtgcttgggttcattattctgcgtttcagcatccatgggtggcttcatttctcgcattgaattgatttcttttttttgggttgcagttttta

SEQ ID NO: 20645 - DNA, 467 bp, Zea mays
  unsure at all n locations
  Clone ID: cC-zmle18900029h09a1
ttttatgaaaaagagggtaagtgttcaaacacgcccaaatcttgaccatgaagtaccatacacattattcaatacatttatgttgcaaacatttgaatactaaggcaattgcaaaggattaagaactcaactattcacacataaactttataaataaattttacattatcaccgcttcaaatgtaaaaaatataaacaaggttccgcacattgcatgggcactgcacaagacatagggaacattctccacaaagtggaaggattctcaacatattggataatcaaggccttcctctctgattgtacatgcagaaacttcgtcattagaaccatatgtaccgatccttcccctgcttccattgtttgccttcttttccattgatttgtaattttgctagataaaactccaccaaatccaaagtgggcaggcttctgctaaacacatancttgtcacctcatagaaact

SEQ ID NO: 20646 - DNA, 538 bp, Zea mays
  Clone ID: cC-zmle18900029h09d1
ggaggatccacgcgtacgatatgttcatgaaatgatcaatgagatttaaaatgaaagataacataagcttactcaacatcggcggttgtcgtgccgtactggcacatcggaccgagtccgacctgtcgcggacgctcgtcgccccacggtccgatgcctaggcagtggtggcggggtggacctcacaggagtcaagtgggagatcaagcggcagttcgacgtgtgctggggctcaccgcgctgtaggcttgccacgaaccacatcaccaggttctatgaggtgacaaagtatgtgtttagccagagcctgaccactctggatttggtggagtcttatctagcaaaattacaaatcaatggagaagaaggcaaacaatggaagcatgggaaggatcggtacataaggttctaatgacgaactttctgcatgtacaatcagagaggaaggccctgattatccaatatgttgagaattcttccactttgcggagaatgtttcctatgtgctgtgcagggaccatgccatgtgcggaaactt

SEQ ID NO: 20647 - DNA, 286 bp, Zea mays
  Clone ID: cC-zmle18900029h11a1
acgggtctgcacgcggctggcggttgaatgctctgacgggccgtcctgtgaatatttggtagcgtgtgacaaaataatatctaacacgtagctgcctcccgttgccttaggatatacagctggccatgaccacgatagccagcttacctctctggattcttagaataactacaggaggaatacgtacttacaactaacatgtgtttgcccacctgggtcatatggaaaaacttaaggagttcctctctttaaggagaaaaacccacgcttccgctggcgcctgggg

SEQ ID NO: 20648 - DNA, 455 bp, Zea mays
  Clone ID: cC-zmle18900029h12a1
gacgaaagatttataccatgccattatgccaagataaatggtcacagtggctaaagggtaattaaccttttttttaccgtggccttacaagtataggtaggagcactatatcacaacaccctacatttacgttactacgtatggtccggatctgactcagggacgatccctccgtaccgctccgctttcacttgctcatgaaagcgatgcccttctgaatgctctcgcccagttccttctttgccgattccagaccagctctctcgaaatcattcaaagggccaagcgggaggatctcctgggatccaccacggccaagcctcactttcgttgcaaagaacggcagttctgtcacctcggatgcaacatatgagcattccacgattccagcttcgccccgcatagctcgcaagcatgcgtcagcgaatttagaagcagcaaaagcccggacgcgt

SEQ ID NO: 20649 - DNA, 357 bp, Zea mays
  Clone ID: cC-zmle18900029h12d1
ggcttttgctgcttctaaattcgctgacgcatgcttgcgagctatgcggggcgaagctggaatcgaggaatgctcatatgttgcatccgaggtgacagaactgccgttctttgcaacgaaagtgaggcttggccgtggtggagccgaggagatccttccgcttggccctttgaatgatttcgagagagctggtctggaagcggcaaagaaggaactgggcgagagcattcagaagggcatcgctttcatgagcaagtgaaagcggagcggtacggagggatcgtccctgagtcagatccggaccataccgagtaacgtagatgtagggtgttgtgatataaaggcttctacctattc

SEQ ID NO: 20650 - DNA, 373 bp, Zea mays
  Clone ID: cC-zmle18900030a01a1
aaaagcaacagggcgcatttatggacttgctttaacccaaacggggtttgggttttgaagattcccccatttaattttttttccccattttgtaaatggggggggggaaaaatcccttttattaactacaaaagggccgcctgtttttttccccccaagattttttaaaaagaacctggtggggaataaaacccttttccctttaaaaaaaagctatttttttgggggggccttggggggacccaaaaaaacttttttttcacttcaggggggaagggaatgcccccccggggccccccatctacttgggcgtgtttttcccagccggggggccagccgggttaaatttatcccaggccttgatccaggggac

SEQ ID NO: 20651 - DNA, 376 bp, Zea mays
  Clone ID: cC-zmle18900030a01d1
cggaattttcgggtcgacccacgcgttcgcccacgcgtccgaaaataacttaggtcatctgcgaccacttgagcctgggagtcaagactggcttgccatacatctggcacagcaaggctagcaaccctttcgttaacttgaagaaggaatacaagggcattttctggcaggaggacatcatccccttcttccagaacgtgaccattcccaaggattgcgacaccgtccagaagtgctacatctacctctctggacaggtgaaggagaagcttggcaagatcgacccctactttgccaagctcggtgacgccatggtcacctggatcgaggcctgtgaagagctgaacccggctggtcccgcggttgggaaaaacaa

SEQ ID NO: 20652 - DNA, 481 bp, Zea mays
  Clone ID: cC-zmle18900030a02a1
accatgtgcaatacagtttccggtctcaataagatcaatactagtttgttgttacaggcagcaggctggccatgcatgaatcatgaccgatgcaacgcttcaggttcctttacaacacgcatgcatctagctttccacagcaaacaactggcggcggcggcagcaggtatgctgatgcaccaacgttctagtggaacttgaggctggtgagcacgttgttgttgacggggtcggcgaggtggtcgagcaggttctggaacgggccaacgccggtgacgagcccctggatgaagtaaccgaggatggcgagcatggcgagcctgccgttcttgatctccttgagcttgagctcattcatcttcttctcggtcttgccgaaaccgagcgggttgaagaggggcccgccggggtaggacggggtcgcggagccggcgaggaacttcttgaggccgaggaagtactgcttgcccatggagcccgg

SEQ ID NO: 20653 - DNA, 592 bp, Zea mays
  Clone ID: cC-zmle18900030a02d1
gcgagcgcacgcacgtaagcacgttgtcggaagctcaagttataagaagcaccagtgactgatcgatggcgggccaggctctcctctccggtcggcagctgctgggccgccccgtgcagtcggccgtttctaggtcgacggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccatcgccccggagatcttcggcaagatgggcatcatccccccggagaccgcgctgccgtggttcaagatcgggcgtattccgtccccgggcacctacaactactgggccgacttctacacgctcttcgttataacatggcgctcatgggctttgtcgagcaccggcggcttcaggactggaacaacccgggctcatgggcaagc

SEQ ID NO: 20654 - DNA, 377 bp, Zea mays
  Clone ID: cC-zmle18900030a12d1
gtgcacatggcgtgcgtgagggtagggattatgatgcttaacaattgctagtgaggctttccgtgcatgttaatcaattggtcaaacttattaactgggatgttgggtgccatcatatatacattgtactgctggacttggaagagctcctgctgttgcattggcttatttgttctggatctttgggtacagtctctttgaaggacatcggctgcttcagagtaaaagggcttgctttcctaagtttggaagccattaagtaggcaactgttgacattctgacaggataatccttatatcacattcactttgaagtgggaagctgatggttcttcctctgttgaaatttctgggctcgacattgcctggggtcagag

SEQ ID NO: 20655 - DNA, 435 bp, Zea mays
  Clone ID: cC-zmle18900030b01a1
aagactaagggtgttttgcctagtgttgaggcttctcatatttttttaaagatgtaatgtaacctgtagttacatctttttggtacagagattagtaactagtaataattatgtcttaagattctagcccacgcgacgcgagaatcagtactgactaatagtaaaagcctctcctgagtcaaccatcaagatgagagccgactgccaaatgacatgcagcgtccagctgcaggtggagcccggacaccggactccggaggcccagcgacgtgatctcaggaagacgaagcggcggcgttggcactgctgccattggtgttggtgaagcagtaagccggcgcctgccacttggaggagtccagcagcactgcccccgcctcgaagctcagcacatgccgctgcagcccattgaagttccagctgacggggcgttcg

SEQ ID NO: 20656 - DNA, 424 bp, Zea mays
  Clone ID: cC-zmle18900030b01d1
cggactcgtgggctcccgtcttctttctcgaccgctaaccttaccggttcccaaatgtcgcctctcgtgctgttgctcctagcgcacctacttgccacggtcactgtagtgggagcagcgccgaccatggacgactggccttctgttccgtctgtgatgtccccgtgggtgccggtgactacgccgtcgtggtcggaccagtttcacgcggtggtggtcacgaacctgagcgcgcgcggcggcgggctgtagctgaacgacctgtactacgactggccgtgagggcgcgacctgaacatcggtcgtgaccagctgtccggcgagcggcgctggagctggaacgtggagtggagcatcggcaccgcctttctgttcgacttcgtgttctgccgcacatatcagttcgtcgtgggcctcctgtcgc

SEQ ID NO: 20657 - DNA, 490 bp, Zea mays
  Clone ID: cC-zmle18900030c01a1
accacgaatatgagaatatctataaactgcatctgcaccaaactgtattgggaagagagagagagagagagagagagagagaagagattccagtcattgcatgtgtcccaaaaaaatcaaacttgcatatctaggggccgctggaaggtactaaccggaatgcaacatttgagacggcgatccttgacctttatttgctgcagaaccgattggttttctgaaattttgaaaccagtagcctatccttggcacatacagtcaggggcaggataagggtagatggattgcgttgcctttctcaaccggatttgcccgtatcttcctttgtgtcctgcctgtacaacctgctgaaactttggccactccatgctcttattcgcaaaggtgcccccaagcagtgccatgtttggccttatgggcttcaagttcttatagcttcggggagccaccaaagcattgtgcatgtttccggaaatgcagatatgaaaat

SEQ ID NO: 20658 - DNA, 518 bp, Zea mays
  Clone ID: cC-zmle18900030c01d1
cccacgcgttcgaaagattcttaatgctactcttgtgatcccacatcttgaagtaaaccctgtttggaaggattcaaggtgcctctgtagtttgaaactatatattccatgttctcctgttgaggcagaaatatttttttttatatattatactgggtcattttttcctggctgcagctcatttgaagaaatttttgatgtggatcactttatcaactccctaaaagatgaagtttccattatcaaagtgcttccaaaagaattttcttggagcacaagagagtactatggcacaggcattcgtgctacaagaataaaaactgcacctcttcatgcctcagcaaattggtatttggagaatgtcagtcctatcctgcaaagctatgggattgttgcgatcgctcccttttctcaccgccttgcatttgatgatctgcctgtggatcttcaacgcttgcgttgtaaagttaactttcaagctctggtcttccgttctcacattatcttacttggagaaa

SEQ ID NO: 20659 - DNA, 302 bp, Zea mays
  Clone ID: cC-zmle18900030c12d1
cggaagacatcaatggtgatggcgtcttctagcgggctgaggagctgcagcgccgtgggcgagtccagcctgctggcgccgtcataccggttcggccgcctggtgccgatttgagccaacgccaccacctttgggccgctgtaccaagttccgcggtgtggattgtccggtcaaggcatctcatgtccaactacactagttactatttcggggtctttggctttctatccgctgggcctcgtgatcgtgctggagaacttcgagcggttcaaggagtttcaggtgtatccattgccgttggg

SEQ ID NO: 20660 - DNA, 253 bp, Zea mays
  Clone ID: cC-zmle18900030d01a1
ctgttggtttgtgggtgctggtcaactggacattacgacaggcagacgagtcctgtcattaatcataacacgggggagctttattacccctcgggataagaccgccagagggtttatggacgaaaactacaattccttttgaatagaggacgactctggtacatcacacactccctgaccgatttaaaatcgaacacgctattctgcacacagtgaacgaaaaccttacgttctaagacatcatgaaggacgt

SEQ ID NO: 20661 - DNA, 320 bp, Zea mays
  Clone ID: cC-zmle18900030d02a1
tttttgacattgaacacaattattccttgtcgattgaacaatagtttacattatggtacaaaccgaaaaccagcgtgcgctcacatgcatccggacacctaaaggtcaccggcggcgccttcctcacttgccggggacaaagttggtggcgtaagcccaagcgttgttgttgacggggtcggcaatgtggtcagtgaggttctcgagcgggcccttcccggtgacgatggcctggacgaagaatccgaacatggagaacatggcgaggcggccgttcttgagctccttgaccttgagctcggcgaaggcggacgcgtggt

SEQ ID NO: 20662 - DNA, 387 bp, Zea mays
  Clone ID: cC-zmle18900030d02d1
acttagctgagctgatggacaaggtgctcaagaaccgtcgttttgtcatggcttacatgcccggatattctgcatgggcaatcttgactgggaagggaccactaaagaacctggctgacaacatagccaagaaagcctacaacaacgcgtggggctacgccaacaactttgttcccaggaagcgaggtacgcaccgtcggggaccatgacgagtactgatgcatgggagcgcacgctggtcttctaatgcgaccaagaaggaactatggctcagacgacaaagaatcattgagcatattgtccaaaaaaaaaaaataagggaaaatcggacttgaggatccaacgatgacgtacgccgtgcatcgccaggggggtaaccactcacta

SEQ ID NO: 20663 - DNA, 297 bp, Zea mays
  Clone ID: cC-zmle18900030d11d1
gacccacgcgtacgccacgcgtcctacctcactgctcgttgccgactgcccccgtggccctggccagttcatcccctagattgctccccaactgcagcgggcagatctagatactatcattcattctcggaccggaagcaggaaaggaagggttgaactttgaattccgaggctgattacttgatgctgaacccagacgctccgctctatattccggaggcgtagttgcaggtggaggacttctcgtcgcagcggtgggacctaattatcaccactgtctggtctcgagaccactgg

SEQ ID NO: 20664 - DNA, 367 bp, Zea mays
  Clone ID: cC-zmle18900030e01a1
gaagcacaaaaaaaagggggaaatttgcaagggattttttaattaccggttttgaaaaaaaagcccgggggggggggcccccggaagaaaaaaactatttggggggttggtggggggaaaaaaataaaaccccttaattgggtttggtgaggggagtttactggggaattaataaagggataaactttcgggctggaattgggtgggtttggaagaacaaacagggttagccgcccggcgcgctgggggtacctcttggggctttttaaacaggggggggggggaaacaaacccccaagcccaggggggggggccttctccgtttctttgaggggcccacgggcccggccttgaaaaacttgggaaa

SEQ ID NO: 20665 - DNA, 418 bp, Zea mays
  Clone ID: cC-zmle18900030e01d1
gtcgatcccacccgtccggacgtggaggtgtgcctggactagctcatccactacccgtgggaggaggcgcgcgccatgaaccgccgcctcgcgtagttggcggacaagcggctggtcatcaacttcacgcccaggacgctctacttcgacttcctcaagcgccgggggcgagctgtttccgggcccgtcaaaggccacgcgcgcctacctgcacgccgaggccgacatcgaggacgcgctccgtcaggccggatggtgcgtcgctaaccgcggctttatctccacgcagttctacttcgccaagctcttcgacgccgtgcccgtcggcttctcgacgtatccgtgtaggccgcccgccgtgtgcttgagtgtctgtttgcctcacgcgactgtctatagagctccagacggttcctct

SEQ ID NO: 20666 - DNA, 381 bp, Zea mays
  Clone ID: cC-zmle18900030e02a1
ttttagggaggaagagtacattgatttaccatgtgcaatacaggggccggtctcaaggagatcaatactagtttggtgtgacacgcagcacgctggccatgcatgaatcatgaccggtgcaacgcttgaggttcctttacaacacgcatgcatctagctttccacagcaaacaactgggggcgggggcagcaggtatgctgatgcaccaacgttctattggaacttgaggctggtgagcacgttgttgttgacggggtcggcgaggtggtcgagcaggttctggaacgggccaacgccggtgacgagcccctggatgaagtaacctatgatggcgagcatggcgagcctgccggtcttgatctccttgagcttgagctcat

SEQ ID NO: 20667 - DNA, 428 bp, Zea mays
  Clone ID: cC-zmle18900030e02d1
gaattactgggtcgactccacgcgtacgcaccagtgactgatcgatggcggcccaagctcttctctccggccggcagctgctgggccgtcccgtgcagacggccgtttctaggtcgtcggtgaggaaggcgcccttcttcgtcagggccagctccagccctccagtcaagcaaggtgccgacaggcagctgtggtttgcgtccaagcagtccctctcctacctcgatggcacgctgcccggcgactatggcttctacccgctgggcctctcggacccggagggcaccgggggcttcatcgagcccaagtggctggcctacggcgaggtgatcaacggccgctacgccatgctaggcgcggtgggcgccatcgccccggagattttctgctagatgggcaatatccccccggagaccgtgctgccgtgg

SEQ ID NO: 20668 - DNA, 372 bp, Zea mays
  Clone ID: cC-zmle18900030f01a1
caaaagaaagaggaatgggttttcttataccagggggggggcccaaattcctcacctaaaaaacccaacatttttttttttcagaaaaaaaaaaaccctggcccttggttttttaaccggatattttaattaaacgggggggttggccctaaaaaaaacattccttggttgcgcccttttttttcataattccagtgaaaaaattaaacattttgtaaaaccccaaaccgcccgggtgatggggggccttaaaaaaaaaaaacctttggtgggtccccactgggaaccaacccccccccggaaaattcaccaccccttttttttacattggttttttggggacttggggtttaacccaatttccagcccctt

SEQ ID NO: 20669 - DNA, 522 bp, Zea mays
  Clone ID: cC-zmle18900030f01d1
tccggaatttctgggtcgacccacgcgttcgtatgaaactgcaaccagtgccctcatggacatgtactccaagtgtggggatgttatttcttcctttgaaatctggaaggaattgaaaaacaggcaaaatataatgccatggaactccatgattgttggttttgcgaaaaatggttatgcaaatgaggcacttcttctctttcagaagatgcaagaatcacaaataaagcctgatgatgtcacactccttggtgttctgattgcttgtagccatgctggtttaatttccgaaggcttacatttcttcgattctatgagccaagtttatggtatagtacccagagtagatcactatgcatgtctcatcgatctactcgggcgtggtggtcaccttcaaaaggctcaagaagttattgaccacgtaccattcaaagctgatggtgtgatctgggctacataccctgcaatatgtcaaatgcactaggatgaagagagagggaaaagttgcagctaagaaacttg

SEQ ID NO: 20670 - DNA, 306 bp, Zea mays
  Clone ID: cC-zmle18900030g01a1
ggggaagggggggaaatttatggggcccataaaaaaaaaaaaaaaaccggggaaaaaaaaaaaaaattttgaaatgggccccgggggccacccgggaaattcgggccggggccggggggggccccaatttttcctataggggggcttataaaaaccgggggaaaaaaaggggaaaactttttcccgggggaaaatgttaatcccctaaaaatcccaaaaaaaaaggagcgggaaggaaaaaagggaaaaccgggggggccttaggggggggccaaccccaattatatggggggcgcctaatgcccc

SEQ ID NO: 20671 - DNA, 378 bp, Zea mays
  Clone ID: cC-zmle18900030g01d1
attcaaacatcttgctatctgtgccaggtttgcatgttatatactagggaccaataaagatcaacacattgcagaaaaaaaaaaaaaaaaaaaaaaaaaaaaaaaaaaaaaaaaaaaaaaaaaaaaaaataataaaaaaaaaaataaaaaaaaaaaaaaaaaaaaaaaaaaaaaaaaaagggggggccgttttaaaggatcaaagtttacttccccgtgcatgcaatttaatactttttttatagggcaacctaaattaaattaatgggccgtggtttaaaaacgtcggaacgggaaaaaccctggggtaaccaaaataaatggctttgaaaaaaattccctttttccaagttggggataaagcaaaaaggcccgaac

SEQ ID NO: 20672 - DNA, 479 bp, Zea mays
  Clone ID: cC-zmle18900030g11d1
gcggaaccccgggtagacccacgcgaacgaagcccgattcccaatccagcaaaccctaccagcctctagcaaactcagagagggacccgaaggcacccaaggcggagaagaagccggcggcgaaaaagcccgcagaggaggagcccgcggccccggcggagaaggctcccgcagggaagaagcccaagggggagagccgcacccggcgggaaaatgcggcggcctggaaggcggagttgacaagaaggggcggaagaaggccaagaagagcgtggagacgcacaagatctagatcctgaaggcgctgaagcaggtgcacccggacatcgggattcctgcaaggccatgtccaggatgaactccttcatcaacgaccaactcgagaagctcgccggcgaggcggccaaactcgcccggaacaacaagaagcccaccagacctcccgggagagccagaacctcgatcggctcgatctaccc

SEQ ID NO: 20673 - DNA, 482 bp, Zea mays
  Clone ID: cC-zmle18900030h01a1
ttttaggaaagccatacgacgcactttattgattatcaaacatgttacatcgtttaccagtctgaagaataacaccagagggttcatcgaccccaaatacagtttcctttcaagagagagctactctgctagttcatgtgccacctgtgcgtttgtaaattggacacagcattctgggagcagtgcacggcatcctcgtgaaaaatgagaagaaaaaaaaggatatttcttcactgcctccgtcttctttcatctccggtatacgtatagctggacaagacacacatctatacagatcgcatcactggtaaacttgcacagagtaaatgattacacgtccagctctttatgcggctacagctagaggtctttggctggtctttattcctttgatagcttcagcgtagtctggagccccaaaaactgcagaacctgcgacaatggcatttgcgccagcttcaataaccttgtaggcatttttt

SEQ ID NO: 20674 - DNA, 507 bp, Zea mays
  Clone ID: cC-zmle18900030h01d1
cctccggaatttctggatcgacccacgcgtacgctgtctgcaaactatgcgaagcttggcgatcaggttaaagctgtggaggtggctggatgcgactggattcatgtggatgtcatggatgggcgctgtgtgccaaacatcacaattggacccttggttgatgatgctctgcatccagcgactgatcttccgttggatgtacatttgatgattgtggaacctgagcagcgagtccctgattacatcaggggaggtgctgatattgatagtgtacactgggaacagacattgaccatccatcttgcaccgaacagtcaatcagattaaaagtctaagatcataggcacgagttgttttgaatccagtgactgcactcactgcaattgatgacgtacttgatgttgctgacctgcggctgattatggctgtgaatcctgagtctggtggcccatagcttctatcgagagtcaagtcaagaagattgccgaactgccaaggtcatgtgca

SEQ ID NO: 20675 - DNA, 422 bp, Zea mays
  Clone ID: cC-zmle18900030h11d1
gggtggatccacgcgttcggattcattcacgatgccgccgacttctatctgctggttctctttcttcttagactctccgtgcctgggcccggtgtcgcgaccaacagtcagacactgaatgcgcattgcctagccgctcgacaccgcgctttatgggtccagacaacattgaggctaccacgcttatacgatcattgtcagtcgaccttcgtcgtcgccttatcgaccccagctccaccgttggcaccggacacgctaaccgtgcttccacaggagtgctgcccggcattataggggtggtgcatctgctcgtgtcgttgggcaatatctgcttcgccatggacaagttcctcaagcaggcatatcgcttcgcgttcattaagtacccgagatgccctttgtggcatgattcgtgtcaatct

SEQ ID NO: 20676 - DNA, 567 bp, Zea mays
  Clone ID: cC-zmle18900031a01d1
cgaacacatgacactatatgttatgcatacgcggacgcgtgtgctgactcggaattcccgggcagctaccatgcgtgcggcacgctaccgcccgcgcgcagggcgcggcccttctcccgtcgacggccttccttggccactctacccgcctcggacgcaccgcgtcgcccacgaggcgcagactcaaggcggaggccaagggcgagtggctccccggccttccctacccctcctacctcgacggcagcctggcgggtgacaatggctttgacccgttgggcctggcggaggaccccgagaacctgcggtggttcgtgcaggcggagctggtgaacggccggagggccatgcttggtgtggccgggatgctcattccggaggtgctgaccaaagccgggctgatcaacgcgccgcagtggtacgacgccggcaagtcggagtacttcgcgtggccgttcacgctgttcgaggtcgagttcatcctgtgccactacgtgggagatccgcgggggcaggacatcaacaaccccggcagtgtctaccaggaccccattttaagagctacag

SEQ ID NO: 20677 - DNA, 587 bp, Zea mays
  Clone ID: cC-zmle18900031a02d1
gcgatggtgaacatgtgggccattacgcacgacccagacgtgtgggccgagccgacggagttccagccggagaggttcatggggtccaccgagttcccgatcatggggtcggacctcaggctcgcgccgttcggggcgggccggcgcagctgccccgggaagagccctcgccatggccaccgtggccttctggctcgcgacgctgctgcacgagttcgagctgctcccctcgcccgtcgacctgtcggaggtgctcaagctgtcgtgcgagatggccgtcccgctggcgctggccgtgacggcgaggccccggcaagcggttcagaagtcggttggggtatcagtctcactgtgagcaatagcatggcgggctggcgctactgtacatggaaagtgcttctgcttgcaggttgctactactcggtcgacatgggtatatgcttttcatgttactgtctttgatgtgtatcgatcaggtgccgaatgtgatactttggcttgtactggtagctcttttcctgggtgctctattctttctttttcttagtactcgctgtaagactcgtcaaatgtatatgctggtttgg

SEQ ID NO: 20678 - DNA, 446 bp, Zea mays
  Clone ID: cC-zmle18900031a03d1
cgaactatggagcgtgccccaggcgtgggcggagctggataagtcgacgcgggcagccaagaacctatgaagggtcgcggatcaggcattctccgccgcgccgagccggactggaccacaggcgccgttgcctgattttgcgcaccctgacgccgctgacgctggcgtcgtgcgcccgctccatgggacgccgggcgtaccacgcgggcccgcacgagagccaaggtccgggcgaagatcctggtaggggcggaggcatgggagccctggcctgccttcctggggctgcttccgaccgacgacataacaagggctgacgccaccaccaacgaggggctgaacggcgtggatcctgacattgagaggggccacctccgttctctcccctagggggagctataaggtggccgacaccccggtcctgcacatggaggggggagaaaaca

SEQ ID NO: 20679 - DNA, 458 bp, Zea mays
  Clone ID: cC-zmle18900031a04d1
cccacgcgtgcgtggacgcgtgggcggacgcgtgggcttagattatagacagacggcagtgtcattgtgaaggagggttccaggtgcagcctaaggactcattaggtgtacagtgacttgaatgttgactaccttaagatgttcctcctaaatgtttcatcctccaccgtagctttgggactgttctttttcattgatgaattgactggttttgagatcaatgtgtttcagctgtcagagccttttggattcattttcacatggtttgctgttttgtccctaatattgatcttagcgcattcattgactaaggctatagaccaagaatttttaatccttaaggggtcatgttataattgtggttctgtaaaccttttttttttgggactatactgtcagtcttcacgggagtacaacatacaaagtgaaatgtgcaaattgctgttccgagctggtat

SEQ ID NO: 20680 - DNA, 495 bp, Zea mays
  Clone ID: cC-zmle18900031a05d1
ccctgcctgatccctcccaataagctccccagctacctcatcgccatcagcggcgagaagaagcccgccatgagggagatcatcatcgacgtcgagctcgccacccgcctcctccccagggggttcatctggcccgtcgcggcctaccgcgagcctctcaacggagacctcgtcgtcgacgacaaggacatcggctactactagctgctgcacctgtgcttgcacatcgctgctggcgagttgggcagtcgtcgtacgtgggaaacatggcttttggtgtaggaggaaggaatggaagtggtctgttgtacttaaagaaactagatgaagaagtcttgtataactgaaacttcacccctctcttgtgtatgatgtattcaccttcgtcttgaaaattcttgagaacggtttcatcttgcatacattttgctagtgaagggtcgaatcagctggccagatgagataaataagagacaatcatcattctttgctttc

SEQ ID NO: 20681 - DNA, 524 bp, Zea mays
  Clone ID: cC-zmle18900031a06d1
aacaaaacgctcatccccttcctgattctcggcctccgtctccgcctcttcctcctcgccttcaacgccgccaccacagtcccggccccgtgttgttcctgcaccccacccgtcctgcgaggctcctccgccatgccgtcatacgcgcaccaccatagcagccctcttgatgataccaggatggacgcgctgaagtgtaacaacaacagcgccccgccggaggagaccgcggaggacgccgacgccgccggggcgctcgtcgagaaagacgggttctcggtcgaggacttgctggacctcgaggagtttggcgagcctgacaaggacggcgccgagcctgaggacgatgacgccccgccggtacccgccgcggccgaggagaggtcgaaagacgactcgcagccgttgtcggtcgtgacgtacgacctcccgtcgccgccgccggagatggttgaactgccgtcgcatgacgtccaggagttggagtgggtgtcccgtatcatggacgactcgctctctgagct

SEQ ID NO: 20682 - DNA, 504 bp, Zea mays
  Clone ID: cC-zmle18900031a07d1
caccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccggcggtggactgtatctcccaggccgccagcctgatcgactgcatcgactacgtccagaaggggagcagcgcgcgccgttcgtccgctgcctgctgcggcgaggtcaagaccgcagtggccagccccgtcatcgtgggctgcctctgctccctcgccggctccaactccagtaacctgggctttcccatcgacatgaagcgcgtgctggcgctccccggcgcgtgcggcgcgttcaacgccgcctttagcaagtgcaacattttcgcgctttccccaaccgaagcacctgcaccgtccgccggcggggggtcttcgagcggtggcgcggcgggat

SEQ ID NO: 20683 - DNA, 555 bp, Zea mays
  Clone ID: cC-zmle18900031a08d1
cctggatttggccgccgtcaggaaggacgccatcgattggatttggaaggtcattgagcattacaatttcgcaccgttgactgccgttttgtctgtgaactacctcgatagattcctctccacgtatgagttccctgaaggcagagcttggatgactcagctctcggcagtggcttgcttgtctttggcttcgaaaatcgaagagacttttgtgccactccccttggatttgcaggtagcggaggcaaagtttgtttttgagggaaggaccatataaaggatggagcttctggtgctaagcaccttaaagtggaggatgcatgctgttactgcttgctcatttgttgaatactttcttcataaattgagtgatcatggtgcaccctccttgcttgcacgctctcgctcttcggaccttgtcttgagcaccgctaaaggtgctgaattcgtggtattcagaccctccgagattgctgccagtgttgcacttgctgctatcggcgaatgcaggagttctgtaattgagagagctgctagtagctgcaaatatttgga

SEQ ID NO: 20684 - DNA, 274 bp, Zea mays
  Clone ID: cC-zmle18900031a09a1
ggaactcaacggcgcccaatccagaacggacgacccagatgttaatcaaccgatcgagaacaattcttcacacctagtaaaaaaaaccgaacaaaaaaaaaaccatacgatacagctggcacgcacgggtaattaattaaccacagcgttacacttacacagtccaggtcctcaagatacctgccccttgtgtagctgtgtgcgtacgtaccgctacgcgcccagaaacaacaccgccgtcccccgcacgttacacgtacgtcacgccggggcg

SEQ ID NO: 20685 - DNA, 274 bp, Zea mays
  Clone ID: cC-zmle18900031a09d1
cgccccggcgtgacgtacgtgtaacgtgcgggggacggcggtgttgtttctgggcgcgtagcggtacgtacgcacacagctacacaaggggcaggtatcttgaggacctggactgtgtaagtgtaacgctgtggttaattaattagccgtgcgtgccagctgtatcgtatggttttttttttgttcggttttttttactaggtgtgaagaattgttctcgatcggttgattaacatctgggtcgtccgttctggattgggcgccgttgagatcc

SEQ ID NO: 20686 - DNA, 378 bp, Zea mays
  Clone ID: cC-zmle18900031a10a1
ggggccccaaaaaaaagggggggggaaatataaagattgggtgtgagcgcaaaaaaaccagggggggggggggggcaaacaaacaaaaaaaacccccctggaaacgtaaatttttattttgcccccccccacacttttgggggtgcttatggggggggcccactttttgcccactttttggggggggcaatcccccccttgcgcccaagggggtaggggcccctcttttaaatggtttaggggcccttgggggaaaggcccattttgaaaaagcttttgccggcctccccccaaatttttttgttctgggggtacaaaaaccggtgtttttttgttgtgggggagaaaaaccaccccttgttcgcccggttttttttt

SEQ ID NO: 20687 - DNA, 542 bp, Zea mays
  unsure at all n locations
  Clone ID: cC-zmle18900031a10d1
cggacgcgtggggcccgccgccgcccgtagggcctcctccccttcctccgcctcattgagcttcgccacgtcgcagctcgccggcctctccctctccgccggcgttgcaactccaaccgccgtcgccctcctccccaagaggcagcagctccagcccattgtcgcgcggcgtgtgtgcccgttcacggacaagaagacgaaccgggcgaacaaggtgtcgttttccaaccacaagacgaagaagcagcagttcgtgaacctgcagtacaagaagctgtggtgggaggccggcaagcgcttcgtcaagctgcgcctttccaccaaggccctcaagaccatcgagaagcacggcctcgacgccgtcgcgcgcaaggccggcatcgacctcaacaagaagtgagcaagaagtgagcccatccgatgagcagccaaactagtgtggggtggcactagcttagcattcacgttcgcagggtcgtctcgtctgtctgtctgcctgcctgcctnctgctgttctttcgcaatcaaaccatatcattata

SEQ ID NO: 20688 - DNA, 544 bp, Zea mays
  Clone ID: cC-zmle18900031a11a1
ttttagctttaatatacctgaaatatctgatatgaaagcactgtccaaacaggaaggagcaatggatttaaaaactacgtcttcttaacacaaataggtgagacaagaaagcactgctagtccagatatagatctcaaaaccaagaggcgaataaggactgaaaactaggcggtgagcacgacggcgccgccggcggctttgatcttcttctcggcgaccttggagatgagcttggccttgacgacgatgggcttgggcggcagcacccccttcccgagcaccttgaagtagccgaactgcgtgacgtcgatctgcggggccttgtcgccgacggcttccgccgccttttcggcgggcaccatcgaccagaggcgctcgatgttgaccgcggggcactagaacttgttgcggagcttgtggaagtagcgcatgccgaccttaccgaagtagccgggatggtacttgtcgaaaaggatgcggtggtggagcatgccacccgcgttaccgcgaccttcgggatgcttccggtgcttgtcgatgcgg

SEQ ID NO: 20689 - DNA, 564 bp, Zea mays
  Clone ID: cC-zmle18900031a11d1
accacgcgtacgtccactcccaggcgccgcacaggtacgtcgccggcggcgatgacgacgcgcttcaagaagaaccgcaagaagcgcggccacgtgtccgccgggcacggtcgcatcggcaagcaccggaagcatcccggaggtcgcggttacgccggtggcatgcaccaccaccgcatcctcttcgacaagtaccatcccggctacttcggtaaggtcggcatgcgctactttcacaagctccgcaacaagttctactgccccgcggtcaacatcgagcgcctctggtcgatggtgcccgtcgaaaaggcggcggtagccgtcggcgacaaggccccgcagatcgacgtcacgcacttcggctacttcaaggtgctctggaagggggtgctgtcgcccaagcccatcgtggttaaggccaagctcatctccaaggtcgccgatatgaagatcaaagctcgccggcggcgccgccgtgctcaccgcctagttttcagttcttaattcgcttttggttttgagatctatatctggactagcagcgctttcttgtctcacctattt

SEQ ID NO: 20690 - DNA, 519 bp, Zea mays
  Clone ID: cC-zmle18900031b01d1
caccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgacttcggcctgcagacgggtgaccccgtcgggttcaccctcgccgacacgctggcctggggcgccgtcggccacatcctcggggttggcatcgtgctcgggctcaagaacaccggcgccctcgaccagatcatcggctagatccctacgtcgccggtgtgaagatcagactcagcag

SEQ ID NO: 20691 - DNA, 584 bp, Zea mays
  Clone ID: cC-zmle18900031b03d1
aagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagatacaggaacccttgtttattcaggtggtcgtttttctttgttacagaagtgttcaaggcttttcaagttctcccctagaaaaaagggtgagcagtcatcagaacaaccatcagagaggaatatatcttttggtgcaagactcgaggaagcaacacagagcgatggagattatgtgccaactcctgtctatgagatagcccacgattctttcaatgcagaggatgagctcccttctgacggtgaaaccagggagaatgaagagtctgaaaggcatgacatagctgataatgcccagatggagtcttctgttggtgtagcagaatacagtatagatattctcggtactaagtcatttggtggtgctaacgacatggcagttgaagcaactattgtctctgttgatcaaaatggcgaggactctgttgtttctgctgaagc

SEQ ID NO: 20692 - DNA, 488 bp, Zea mays
  Clone ID: cC-zmle18900031b04d1
cggaattcccgggtcgacccacgcgtacgccagggctgaaccactggacaggcggtggaaactaccaagctggagccacggatagcaaaggcggcacactcagctatccagcgaaagagatcgagacgcaggagtcatggtcaccgttagcgccgccgaggtgaccaccatcgttggccgcgccgcgaacgccaggtccaatgctctagggctgcctgcgttgcgggcgaggagcgagagggtgcggagcatcttcgccctggatgccaagaacgcggtcctagtcagcaccaagggcgcaggccgcgtcgctgcttgtcgcagagggcgcggtgaccggtttggtggggcccgagctggcgctcgtggactagcgcatgtacacggagggcaccgggctgagcctctggctcagcaacaacctgctggggtggattcttctgagggattttggcctcatgtggtgctctacaccatctactcctgtg

SEQ ID NO: 20693 - DNA, 519 bp, Zea mays
  Clone ID: cC-zmle18900031b05d1
gcccaattgggagctccactccaccccacccaactcgccgccacctctcatggtgactgctgcgaccaccaccaggaggccgagcggccccgtcctctcggccgtgcactaccgatacgccttgcccacgcgcgtctcgctctccggcgccgggcagtccgatagcgttagcgtctcgttgtcgtcgcggggccgacggatctgcatgtgctcgccgaccagccacccgggctcgttccgctgcagtctgcacaaggagcgcgcgacgaagccgccgccgccgccgtcgtcgcacgggcacggcaagccgacctcctcgccggcgtccctgaccaccacaagccgtctgtgcgcggcgggcaggcggatgggcagcgcgctgctgcggatcggcgccgtggagggcggtcagtgtgctcgccgcgcgctcgcgggcaccacggtgcagaaccgcccgacgcgtttgtgtttgcgctcgggcccgtccggacccggacccagccgtcttttcgtcgtttt

SEQ ID NO: 20694 - DNA, 571 bp, Zea mays
  Clone ID: cC-zmle18900031b08d1
ggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaagaggagttctgcatcgagaaagtggagttcgatgacaagaaggagaagaaggtggtggtggtgcgtgggaagttcgacgccgagaagctctgcaagaaggtgtggtccaaggccgggaagatcgtgaaggggattgtcatcgctgaggtgtggccaataccagccccgcccaaggagtgcaagcctgaggcaccgaaatgttgcgactgtgacaagtgcaagcccaagcccaagcctgagccaccgaaatgttgcgactgtgagaagtgcaagcccaagcccaagcctgagccaccgaaatgttgccactgtgagaagggcaagcccaagcctgagcctcccaaaccagagaaatgctgcaatgcctggtgtcactgcaagcctaagcctgatcccaaaccgctgatatgttggggtct

SEQ ID NO: 20695 - DNA, 478 bp, Zea mays
  Clone ID: cC-zmle18900031b09a1
tttttggacatatttctttgtattatttgataaacgattgactcaaaaactttcatcctcaccttggtgcgtcttatatcctcggtcacctcaagatggatgtgtacaagtgaatgcatttattcatcactggttcatatattacaaatcaccaaatccgagcggtagctctcctaattaacgagacgtaagcacgacgggttgatcaatcttgtcccataccctctctcccattcatcacaaaatgaaacaacgcacgacgggttgatccatctccaggctcatagagatctatcatagttaattcaagaccacgtttcgatcgatggacggagcggatcaatggcgggcttaagaggatcctccgaacgtgtcgaagatggtggtatggagtgggtcgctaaggtgggtggcccagttgctgagtggccccttgccagtggcggcggcctgcacggcgaagccgaagaggcgacca

SEQ ID NO: 20696 - DNA, 651 bp, Zea mays
  unsure at all n locations
  Clone ID: cC-zmle18900031b09d1
ccagaacctggccaagaacgaggccggcggcatcatcggcacccggttcgagtcctccgacgtcaagtccaccccgctccagccctacagcgaggtgttcggcctccagcggttccgcgagtgcgagctcattcacggccgatgggccatgctcgtcaccctcggcgccctcaccgtcgagtggctcaccggcgtcacctggcaggatgctggcaaggtggagctggtggatgggtcctcctacctgggccagccgctgccgttcaccatctcgacgctcatctggatcgaggtgcttgtgatcggctacatcgagttccagcgcaacgccgagctcgacccggagaagaggctgtaccccggcggctcctactttgacccgctcgccttggcggccgaccccgagaagaaggagcggctgcagctggcggagatcaagcacgcgcgcctcgccatggtcgccttcctcggcttcgccgtgcaggccgtcgccaccggcaaggggccactcaacaactgggccacccaccttagcgacccactccataccaccatctttgacacgttcggaggaacctcttaagcccgccattgatccgctccgtgcatcgatcgaaacgtggtctngaattcactatgatagaactctat

SEQ ID NO: 20697 - DNA, 440 bp, Zea mays
  Clone ID: cC-zmle18900031b10a1
ttttataataagaagtccggttttagtatatatatagtatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggcctcgccggactccgccgcggcctcgacgaactcgggcgcggcctttttctccggggccacgccgagga

SEQ ID NO: 20698 - DNA, 600 bp, Zea mays
  Clone ID: cC-zmle18900031b10d1
cggacgcgtgggtgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggctgatcccgatggcttctgctggaaccatatattaattggtccacgatgatatgatgtgatactatatatttactaaaaccgggcctcttattat

SEQ ID NO: 20699 - DNA, 474 bp, Zea mays
  unsure at all n locations
  Clone ID: cC-zmle18900031b11a1
aagtataacatagcatcttatttatgttcaagtgcgatagctacacatctttactcacgactcggccattcaatcaatcaatcaacgagtgtttttttacgttcatcgagtgaaatagccgtcaagaagattcaagatgaaagaagccggcaatgagcatgagccaattccaatcactagccgatggagtgcctccgatccttggtcctggacggcttggtgcgcactttggcgccacccacggcgtcaggccgcaggaacgggttcagccgcccgagcttcttggacacgttgttaatgaaccccccgctgccgcctgccgccttcttcggcagcgggcggcgccccgatggtggagcgtcnctgtgctgcgggggcgccgacgggtccctcaggttcatcttcagccgcagcagctccatcttgagctcctcgttctcccgctgcagctgtgacatctcgtccggcacgctc

SEQ ID NO: 20700 - DNA, 503 bp, Zea mays
  Clone ID: cC-zmle18900031b11d1
gaactccatgtccgtgagcttcctctcgatgctgcttcgagcagcgctgtgcctggacacgaccctggcgtgccggctcgacctcgagaagcggatggccgcgcagctcgggcaggccgtgctcgacgacctcctgatcccgatcttcttgcccgacgccggcaacacgttcgacgtcgacgcggtccagaggatcctggtcgggtacctggagcacgaggccgaggcggaccggctggactacaacaccgacgacgacttcacctcgacggcgtcgccgcccaacgacgtcggaatggtcggcaagctcatggagtcctacctggctgagatcgcctcggacgtggacctgcccgttgacaagttcaccggcctcgccgagatgatcccggaacgcgctaggttcaacgacgacggcatgtaccgttccatcgacatctacttgaaggcgcatccgtatctgagcgaggccgagcggaagacggtgttgccggtgatggact

SEQ ID NO: 20701 - DNA, 371 bp, Zea mays
  Clone ID: cC-zmle18900031b12a1
gcacaaaaaatcccaaaccagcacaaactttaaccagttcatagcaaggtataccagatcaacatcgacactagtaaaagggcaaactcttccataggcaaattcaagggctaaacagttctgtctccaggcaagcacactcacttgaagcatttcgcgtcaagcaaggcctcgccctcaaagggctcctggtcctcaatcatcgcattgacacgctccttctgggcctcatcagagatgtccaccttggtccactcgtagagctccatgtcatagacctcgtccattacaaacttgggaacatcctggccacggaagagccaaaggcccttcagcttgaagggtggctcagagcctatcacgagcatctt

SEQ ID NO: 20702 - DNA, 501 bp, Zea mays
  unsure at all n locations
  Clone ID: cC-zmle18900031b12d1
ctttgtggttctgtgactacaagtacaatgatgagaacaccgtctcctttgtgaccctgaacaaggttggtggattcctgcagcggatggacctgtgccgcaagtacgcctttgggaagatgctcgtgataggctctgagccacccttcaagctgaagggcctttggctcttccgtggccaggatgttcccaagtttgtaatggacgaggtctatgacatggagctctacgagtggaccaaggtggacatctctgatgaggcccagaaggagcgtgtcaatgcgatgattgaggaccaggagccctttgagggcgaggccttgcttgacgcgaaatgcttcaagtgagtgtgcttgcctggagacagaactgtttagcccttgaatttgcctatggaagagtttgcccttttactagtgtcgatgttgatctggtataccttgctatgaactggttaaagtttgtgctggtttgngattttttgtgcctctcaaaaatcta

SEQ ID NO: 20703 - DNA, 573 bp, Zea mays
  Clone ID: cC-zmle18900031c01d1
ggcgagccccgagagcgggtttagttagaggctacgggcggtcgggcgcggcggcggcggcggccatgagcagcgggagcgagagcactaccgccagcaggtggctcgagctggccacgctgcgcgcgctggcgcgcgacgccgcggagcagcttccgctgccgcggaccggcacgtcggcgtcggcgttgtcgacgtcgccgtggcgcgggcgcgaggaccacctccacggccacggtaagacggccaaggtgatgcacctgctgctctggggacccaagtgaagcggcggcgagaggccaccgtaccgccgggctctcccgccggcgttgctcgttttgctctgcctgcaatccgccccgcacggactgtactgtacctatacacctatatactacgacgtgcacctgtactacgacgtgctgctgtaccatactaatactagtgcgctgctgctcccttgccttcttgcttgcaccagccactcccgctttatttgctcgaacgatcgactgctcgtgtcgcgtcgggccacggcccgtcgtcagtctgggtgtgccactccactgtaag

SEQ ID NO: 20704 - DNA, 535 bp, Zea mays
  Clone ID: cC-zmle18900031c02d1
aagacgacactctagctctacttgtaggatcaagttcattggtttggctgatcgctgggctgatcagaactgccgcatttcttgcagctcctataggtttcttgaagcacttctaaagactgcaatactgcatttaagttcctggtacatggagtcctacagaatagcaaccataaacacttgtgtcatgtggagatattgcggaaccgaccagccgtgcagcaaatctaaaggctgaaaatactgagcttgagttgtgcaggtgtacagcagatctaaagccatgcagcaaccataaacagttgaagattttcagctggcaaatttgccaacgcagctgagtgcatgcatggctttggcaggatccggttgttactagcaacatttcagaatttaaaatatcattttttcacagctcagattatatttgactgaagccacaacataataaagggacttccattgatagatacattcttgtacaatatctgtatctgatttctagtgggaactagatggtacatacctgagcagt

SEQ ID NO: 20705 - DNA, 537 bp, Zea mays
  Clone ID: cC-zmle18900031c04d1
gcttcctcctcgatgccgccgccattcttcttgctgctccccttcctcctccgtctctccgtgccgggcccgggtccgaccaacagcagcactgaagcgcatccctgccgccgacaccggcttcatgggtccagccaacaatgaggccaccacgcttaaacgatcatcgtcggccgaccttcgccgccgccttatcgtccccagctccaccgctggcaccggacacgccgccagtgcttccacaggagtgctgcccgccattatcggggtggcgcatctgctcgtgtcgctgggcattctgctcgccatggacaagttcctcaagcaggcattcgtcgccgcgtccatcaagttcccgagtgcccttttcggcatgttctgtgtcttctcggtgctcgtagtcttcgacacattcgtgcctcctctcgcgaaggcgttcattggcttctttgagcccgccacgctgttcatccaaaggtggctgtccttgttctacgtcccgacactggtcgtgctgccgctcgccgtcggggatat

SEQ ID NO: 20706 - DNA, 430 bp, Zea mays
  Clone ID: cC-zmle18900031c05d1
cccacgcgtccgaaaaaaaaaaaggaaagaaataaaaaaaaaaattttaaaaaacaaaaattacaaagaaaattaataataaaaaaaatagaaaaaaaaaaaacaaaacaattaaggggggcccctttatgggaccccataacgtaagcctctgcgtgatttgcaaagaagctatggctttttttttggggtcccccaaattcaataaaggggccggtcgttaaaaaccagaggaaggggaaaacctcggggttgcccacataaatctgttggatacaaatccattttctgccgtttgagaaaaaagaaagagggcccatccttttaggctttccaaaaatgggctctgctttaaggggaataggtacacccttttagctggggtttaaatggcgttggaagggggggtattcccctggaagacggatca

SEQ ID NO: 20707 - DNA, 583 bp, Zea mays
  Clone ID: cC-zmle18900031c06d1
caaaaacttcatatttgttcatttgtctccagcaatataatggattactcgtctactagggtcgtcgtgtgtttagctctggcgttggccatggtcgccgtgacgccgtgcgcggcccagaactcgccgcaggacttcgtgaacccgcacaacgcggtgcgcgcggtcgtgggcgtcggcccggtgtcgtgggatgagaacgtggccgccttcgcgcggaactacgccgcgcagcgccagggcgactgcaagctggtgcactccggcggcgggcccaaccactacggggagaacatcttctggggcggcggcagcgcctggaaggcgtcggacgccgtcggcttgtgggtgggggagaagcagaactacgactacaacagcaacagctgcgcggcggggaaggtgtgcggccactacacgcaagtcgtctggcgcaaatccaccgccatcggctgcgctcgcgtcgtctgcaacaacggcggtggcgtcttcatcacctgcaactacaacccggcgggcaactttcgtggacagagaccctactagctaccaagctaccgattgaataagccacaaactaagc

SEQ ID NO: 20708 - DNA, 650 bp, Zea mays
  unsure at all n locations
  Clone ID: cC-zmle18900031c07d1
cggacgcgtgggttttgccatgtaaactggaaagggatctaggacgtcgtttggtctctctgctgccttcttcctccttcctccacccctgccttgctcaaagtagtcagtcgtcatcgtctcctccgatcgcctccagttcattccagttagcgccgctgatcccctccctaatcaccatccatccatccggtaggattccccagccatgtcggcgaccgcggtgaagtttcccgtggaggcgccgccgaggacagtgaaggtcaccaacgtctctcttagtgcaaccgtgcaagacattaaggagttcttttccttttcaggagatattgaacatgtggagatgcagagtggtgatgagtggtctcaaattgcatatgtcactttcaaagatgcacaaggcgcagaaactgcacttcttctttcgggtgccacaatagttgatctttctgtgatcattggacctgctccagagtatcagccaccccctattgcctctgctccaccaatgagtggaaccagagttccagttggtggagacaacaacgttgttcacatagccgaggatgtngtgagcactatgcttgccaagggtttcgtgcttagaaaagacgcggttggcatgggccaagcgtacgatgagaagcacg

SEQ ID NO: 20709 - DNA, 240 bp, Zea mays
  Clone ID: cC-zmle18900031c08a1
aagggaaaactggcccggggtcccatttttttttttttgacccccgggcccaaaaaaagggggggttatccttattaaaggcccctctcattcaaagcaaaacttcaagaatgggcgggggagattcccccaaacccattgggggggggtgccatccccggcccccggctgggaaacaactaacctaacccggttggttgaacaatcccccccgtccggggcccggttgggggccgcgaa

SEQ ID NO: 20710 - DNA, 493 bp, Zea mays
  Clone ID: cC-zmle18900031c08d1
cggacgcgtggggaaatttcgtcttgggcagttcggctgacagaccaacctacggcctggattggagacttatccgcgacccctcctccccacttcagcttcagcgcaagccatcttcccgccacaggctcaaaagcaatcaagcgactcctcccacagtcccacttccactcccacccacccacacgcacggtcgcaggcagcagcaccatgtggtcggcagcaacggcggcggcggcgcgcgcggtgtccgtgtccccagtcccggcgccttcgctcctcagcggccggcgcggcgggtcgcggggcggccgggggtcggtgtcggtgcgcagcacggtgtgggacttcgtgggcggcgacctggtgcggccggacctgggcaagtggctggacgacgtggagaagcacaaggcgctggccatctacccgccgcacgagggcggctacgagggccgctacctgaaccgccttcgttaccagggctactact

SEQ ID NO: 20711 - DNA, 333 bp, Zea mays
  Clone ID: cC-zmle18900031c09a1
ggggttggtttttatttaaaataaatttatatccattataacatgccagcgacaccaaagaccggcaaccgggaacgcccagcgaaaacaggggcgcgacacagggaggggaaaagagggccaaaaaagggaaggggaaggacagaggagaggggggagaaaggggggaaaaaaatgacaaaaaaaaaagccgacacaacaaaaaaaaaaaccgaaaaaaaaaacaacgagggacccccaagggggggaaaaggggaaacaaaacccaaaacaggcagggggcaagcaaacacaaacaccccggggagaaccccccacccaaaaaaaggaaaa

SEQ ID NO: 20712 - DNA, 345 bp, Zea mays
  Clone ID: cC-zmle18900031c10a1
ggggcgggggaaccaccttttaatttttttggacaaaaataggtgggaacaaaaaccttgcttattttttttttgtctcgtttcatagggggggcaaacaaagggaacaacgggggtccccacccctaatccaaggggggaacggccccttacccggggacaaaagcgaacgggcaccccattcttttgatagataaaataccccggccgaagccaggatgggcccacacattatttccttcagccgccgccgccggcgtcgtatccgacaccaccacccttgggccgaccgggggaaccgccaccgtttctgtaggcggcggcaccacccttgggccgaccggt

SEQ ID NO: 20713 - DNA, 592 bp, Zea mays
  Clone ID: cC-zmle18900031c10d1
gtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctactgcggcggtcgcggcggcggcggctatggtggcgggcgccgtgacggcggttatggcggcggtggcggctactgcggtcggcgcgagggtggtggcggcggctactgaggccgtggcggctactgcggtcggcgctagggtggtggtggcggctactgcggcggcggcggcggctggagggactgatgtgtgggcccatcctggcttcggcgggttatttatctatctat

SEQ ID NO: 20714 - DNA, 238 bp, Zea mays
  Clone ID: cC-zmle18900031c11a1
aaatgaaaccccgggccgaacaccctgggcccaacccggaaaaaactgaaccggccccgggaaggggaccaacttcccaaaaagggggaaaaaaaaaaccggggggaaacccaggaaaaaagggaacccggggaaaaaaaggaaaaccccaaaaaacccaaaaaaaaaacgaaccggaaggaaaaagtgaaaagccggggggcccaaaaaaagggggaaacccaaaaaaccggggggg

SEQ ID NO: 20715 - DNA, 477 bp, Zea mays
  Clone ID: cC-zmle18900031c11d1
cccacgcgtccgaaaaaaaaaaaaaaaaaaaaaaaaaaaaaataaaaaaaaaaaaaaaaaaaaaaaaaaaaaaaggatataaagaagatttttttaagggggcggccgttcttgaggatccaagttttcgtccccgtgctggctgcgttataatctttcttttggggtgcctatctcttatttttcgcccgctgttttacaaccttgcgattgggaattccctggcgtttcccaattaaatggctttggcgcacatccccttttccccatatggcgttatttttaaggggcccgggccgttcgccctttccaatcgtttctcgccctgaatggggttggggcccccccctgttgcggttcttttggcccggcgggtgggggggtttccccctgtgggaccgcttccctttgctccgccctaacgccctttccttttctttcttcccttccttttttcccccgtttgccgggtttccc

SEQ ID NO: 20716 - DNA, 574 bp, Zea mays
  Clone ID: cC-zmle18900031d01d1
gtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggttatggaacagtagaggaagctgtgatacaaggaatgaatgctatgagtgctgaatttttggctgcaaggaaaacaattagtggggaacaacatggtgaagcaggaggggagatctatgt

SEQ ID NO: 20717 - DNA, 591 bp, Zea mays
  Clone ID: cC-zmle18900031d02d1
gggtcgaccacgcgtccgattagcaatgagtatgctggcctttgctggaaaagtttgtcacgtcgctgaactgtcggacttgctaaggtgtttttcatcttccaaaattgacccttacctaagaataggtgaagacttgcaactctatgtaaggttgcaatcggatctaggcagctatggttctgaaagtgatcaagagattgccaaatccatgctttctgactgcaggacaaaagtagggattaacgatcatcgagtgcttgatgttattgcctctgcactttctaatttcattgagatgggcaaggatgtaatagtgaaggagctgactgagttgttcacgcctgaagagatgcctctgtttgggtcgaattcagcacttgactgggccaacttcaatgcacaagcattttctgatgaatccctttcttttgatgaggaatgttcaagaacctcttcagtagattgtggcttgcacgagtcaccaatcaccaacactgctagctctatctcaaagattactctaccacagtctgttccacatgttttaggtgtcggtcaattgttggaatcagcactacatgtggctgg

SEQ ID NO: 20718 - DNA, 621 bp, Zea mays
  Clone ID: cC-zmle18900031d03d1
gaatccccgggtcgaccacgcgtccgctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgagggacgcagccgtgtggaggccgagctcgtagaggcgctcgccaacctcgaggcgcagaaggaggaggctgtcaaggcgctcgacgcccagatcgcctcgctcagtgatgagatcgtcaagaaggtgcttccatccgcgtgatgaaaccaaaccggccctgccttatcctatgactatagttacatgaacatcataaattaatgataattttgaagaaattggccgatgacttcgacactgtactcatgaaagattattggatgggctgtgtccaccgactgtgttgggcgtggattgttgtagacttgcagtgatcttgctcgatagc

SEQ ID NO: 20719 - DNA, 651 bp, Zea mays
  Clone ID: cC-zmle18900031d04d1
gatattttggagtcgacatccgtgccattcaagattattctctacaattcaaagatattgtgcactgccgtgcggaaattagggattttgatgcttttgatttgcgattgaggcttcctgctgtggttagcaaattgcacaaacttatcaactgtaatggtggtgtaacatatatacattgtactgctggacttggaagagctcctgctgttgcattggcttatatgttctggattcttgggtacagtctcaatgaaggacatcggctgctacagagtaaaagggcttgctttccgaagttggaagccattaagttggcaactgctgacattctgacaggattatccaaaaacacaatcactttgaagtgggaagctgatggttcttcctctgttgaaatttctgggctcgacattggctggggtcagagaattcctttgacatatgatgaggagaaaggagcttggtttcttgagaaagagttgcctgaaggacggtatgaatacaaatacgtagtggatggcaaatggctatgcaacgagcatgagctgataacgaaaccgaatgctgacggccacgtgaacaactatgttcaggtctccagagaccgcacgagcgatgaagagaagagcttatgagcggtgactggtc

SEQ ID NO: 20720 - DNA, 231 bp, Zea mays
  Clone ID: cC-zmle18900031d05d1
ggcgagacctactccgtcaccctcaccgtgccgggcacctacggcttctactgcgagccgcaccaaggagcaggaatggtcggcaagatcacagtcaactaaagctagctatccattccatgcatctcgatctgtatgtactccgcccgtcgatggatgatgcattcatctctacttgttttcctcacatgtacaacaattaatgcaacaaattaagtacgtacttgagag

SEQ ID NO: 20721 - DNA, 458 bp, Zea mays
  Clone ID: cC-zmle18900031d06d1
gcctgttctgttcttgtggcttcagcagcgcaaccttcagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggaaaaaaaaaaaaacactgcataatggatctactgtaacaaggaaagatgctactgctagtttgtaagatataactccgacgacatgagaatatgcaatccatgaaactggggggggg

SEQ ID NO: 20722 - DNA, 577 bp, Zea mays
  unsure at all n locations
  Clone ID: cC-zmle18900031d07d1
atataatcgataattgatgatgtattgaagaacagagttttgaaccatggagcagtttggaagaattggccgcacatgggaaaaaatgtaaacttgaacgatttgaagtgcctgccgctgtcaagctttgccgtgaagtatggtcgcctgatatgggtttggtcacagccgctttcaaacttcgccgtaaagacattcaaaatcgataccaacacgaaatcaacagaatgtgcgcttcatgatctcgttatttttaaaccgcctcttatcccggacgggcgtcctttgttttatcccgcccttatgccacatcacagaattttaatcacctctttctctcactttggagataactcaaatcttttttatacaaattatatttatatacttataaaaactggcaaatatatgtatataatatgtgtaaagacaatgccatttatgtacagtgtatatcaaaaaaaagtcttagtattgtatatttgnggaataaaacaaagtctgctttgttgacaattatttttcttcgtaaataataaagggttaacggtcaaaattagatcaatttttttaattt

SEQ ID NO: 20723 - DNA, 377 bp, Zea mays
  Clone ID: cC-zmle18900031d08a1
gggccattatacaaccaaaattggtcaagacatagacagaaaaaaatctgacgcatggcacaatggctttactacctggccggggataccctactaggtacagtcaggccacccccaaccggatcacagcccgttgaacacgagaggtgggatttagctggaccgtaccaccttacggcttgggcttgcacaagaacctctgcttatgatcaaacgccaggacggggccgtgcccttatctgcacgatgttttaatcctctcgagggtgatcttctgccccgccctccggggggtctgcttcctgagggacggggggagggcccccaaactattccttggacccacaccggaggccttgatcatcaagttgtgaccc

SEQ ID NO: 20724 - DNA, 362 bp, Zea mays
  Clone ID: cC-zmle18900031d08d1
cccacgcgtggggggaaaggttatgaggctctggtcactcgttggggaggtacccggcttccctgtacgacccagaggggtcttccaataggtgtttgtatgagggcatggcattcggctagggtctcctatacggctggttgtgctggtcaaaatgggtaccactgccgcactgtgatgaacaagaaggtttacaagatcggcataggctggacaagagacccacgatgcctccacatagactgacaggactgagaaggacatcacttccatgggtggattcccccattatgggatcgcgaagggtgactacctgatcatcaaaggctgctgcgggggtccaaagaacagggtggtgaccc

SEQ ID NO: 20725 - DNA, 295 bp, Zea mays
  Clone ID: cC-zmle18900031d09a1
ttttggtcaaagttgatgagatatactgtatatatataatagtgacatacggccatggatgggatacaaatacaatacgtacgtagatacatacatacacacggttgcactgactgactgacgacgacaaggatgatacgtagtatatagatagagatggtatttaatttatccctcagagtgatcagagggcgagcaggagtcccggcagggagttggtggcgctgtcggggcggcggctctgccagacgcacttggcggcaacggcggcggccaggcgggtgacggtgaggtc

SEQ ID NO: 20726 - DNA, 141 bp, Zea mays
  Clone ID: cC-zmle18900031d09d1
aatccccgggtcgacccacgcgtgcgcctcctatccttgcacgcacacgcaaacgcatcccatcctgtcctcgcgttactactagttagttagagagagacagagaggatcgatctgctggcggcgtctaagctggagaaa

SEQ ID NO: 20727 - DNA, 293 bp, Zea mays
  Clone ID: cC-zmle18900031d10a1
tcctgtatagcggccgcccttgtccttttttttctgttttcaatcacaccaatcaactctcttcataggggataaggcgggttacattattcaccacatcacacattactaacctacgggctatttagcctacacaccacaaccctgatgagaaaattacttttccgtccatcgccacctgagcgatcgcaaattgtacactacattctccgagcagagcacggatttcttttcaacatatatactaacaacaaggttcaaaatggtgtgcctgccccctctttcttgagggg

SEQ ID NO: 20728 - DNA, 354 bp, Zea mays
  Clone ID: cC-zmle18900031d11a1
cgagggaagcaattcttattcattgcactgtcattcccaatttcacaaatcacaagttgagaagctgcaggaccagggagtccatctatccattattccgacatcaacaacacactcagaatcccgaaactgagaccctgcagcctgtaatcagaggctcgcgggcgttggagcatctccgacgacgaagtccaggaccatcacctcgtccagcagcggcctgaccaaggccttggcctcctccaccttgccgtccccttccacggcgtccagctcctccacgctgtcgaacaccgccaccatcccgaactggtaccccttggcccgcgccgagaaaaagttctccccgaagct

SEQ ID NO: 20729 - DNA, 483 bp, Zea mays
  unsure at all n locations
  Clone ID: cC-zmle18900031d11d1
cccacgcgtccgcaaagccatctcatcccctctccacctcccgaccctccgccgcctcacccccacctcctccctccgcgccgccgccgccatgtcctcctcctcgtccgctgtggccgccccgatcgagcacttcgtgctcttcaaggcccgcccggaggcggtggcctcgggcgccgcggcggcgatggtctcctcgctgcaggcgctggccacgctcgtcccgggcctggcctacatccacgcgggaccggtgctccgcctccggtccccggccgcggaggcgctgggccccacgcacctnctgcacacccgctacgccaccaaggaggacctggcgttctacgcggcgcacccggcgcacgtggccgccgtgcaggggcacgttctccccaacgcgctcgacatcaccggcgtcgactgggttaacgccgcgccgttcccgttcctcgcggtccccggcagcgccgtgcgcctcacgct

SEQ ID NO: 20730 - DNA, 327 bp, Zea mays
  Clone ID: cC-zmle18900031d12a1
gtttttggatcgaagcaactagcactggaggccacacatacatatataatagagggctaccgtccagtatatatatatatcgatcgaggactagtgcacgctggtcctggcgacacagatagctttatgttattccttccctggcttgatgactcgtgcagcgcgcggggcgtacgcgcacgatcggcagggttattagcttggtcggggtaacttacctgagcttgtatgactcggtggacatgctgatggtgaatgcgacggagacgcctgacttgccggggatggaggcgactgggcccatgctgacgctcatgacgctgcggg

SEQ ID NO: 20731 - DNA, 541 bp, Zea mays
  Clone ID: cC-zmle18900031d12d1
atccacactaacgaacgaactcttgctccgatcacgagctatctgaggtcgacgatggcggctgtgctgaacagcaggaagacgccgcaggtggtggccgtgctggtggtggtggcgctgctggcttcgtccgcgtcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtacacgtacgccccgcgcgctgcacgagtgatgaagccagggaagaaataaaataaagctagctgtattgccaggagcagcatg

SEQ ID NO: 20732 - DNA, 401 bp, Zea mays
  Clone ID: cC-zmle18900031e02d1
cggacgcgtgggcgacgacgctgatgctgttcgcggggcggttcgggctggcgccgtccgcgaaccgcaaggcgacggcggggctgaagctggaggcgcgcgactccggcctgcagacgggtgaccccgccgggttcaccctcgccgacacgctggcctgcggcgcccgcggccacatcctcggcgtcggcatcgtgctcgggctcaagaacaccggcgccctcgaccagatcatcggctagatccctacgtcgccgttgttaagatcagactcagcagcctcgatcgcgccgtcggccggcaggtgcaggtggtgactttgtaacgtgtgtgcgtgcgtacgtgtacattgcatccatcttggttccaatggacatatagctcctgttgctcctctaaaa

SEQ ID NO: 20733 - DNA, 69 bp, Zea mays
  Clone ID: cC-zmle18900031e03d1
aaaaaaataaaaataaaaataataaataaaaaaaaaaaaaaaaaatttaaaaagggcggccgtattatg

SEQ ID NO: 20734 - DNA, 515 bp, Zea mays
  Clone ID: cC-zmle18900031e04d1
cggacgcgtgggcggcagcagagcaagaagagaaccagtgtgctagtgctacagctacggcctagctacctactacggcgcagctagcagcggcggacatgagcggcgggcgcgaggagagcaccagcagcaggtggccagagctggccgccctgcgcgcgcttggcgcgcgacgcggcggcccgggccgggagggagacggcggggtggcgcggtaccagatccaacaggtcaatacagctggcattttacctgtagcactcttgtgtctccaacaatcattagccctattacatctgttgcctttggtgcatatattggcacaaaacagtagggcacaacaactacaacaacttgtgctagcaaaccttgctgcctactcttagcaacagcagaatcttccattcaaccaactagctgtattgaactctgcttcttatttgcaactacatcatcctaccattagtcagcatcctgtagtctacccccagcaatttttttcattcaaacaactg

SEQ ID NO: 20735 - DNA, 530 bp, Zea mays
  Clone ID: cC-zmle18900031e05d1
cccacgcgtccggcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggtctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggactaggaggcgctgcacctgagggtggacatgccaggcctggggaaggagcacgtcaaggtgtgggcggagcagaaca

SEQ ID NO: 20736 - DNA, 650 bp, Zea mays
  Clone ID: cC-zmle18900031e07d1
cgcagtgaaagcaaggcagcatgcatgtcgtcgttgaccacaaatgtgtttggagtgccccagccagggtggtacagggtttattacatcattaataatattcaagagttagtaaccgctctgacccaagagcatccggtggtgctgatgttctgggcggactggaaccagccaagcaaggccacgtactgggatctggccatcgctaaaaaggatgaggccgtattctgccagctggactttgataagtttaaagatgtcgtagagaagttcagagtgaaggctctgccgacgttcctcctgatcaaggagggcgaggagcagcgcagggtcgtcggtgccaaggtcgaggagctcaacatggcattatcagatatcggataatctaggcagctatagcgctcacattctaacttcatcaaattattctaataaattaataagctggaaataagtcttaaaaatacaaatggctaattaatgcattttcgatttacaaagattgaaattcaagaaaaggtgtattaattatattatatactactactacacatgcatgcaagccatggttggattttgttacaaaatattgtgtcaaagtgatcaacccctatctgacagtttccttcaaaggacacaccccttgggag

SEQ ID NO: 20737 - DNA, 391 bp, Zea mays
  unsure at all n locations
  Clone ID: cC-zmle18900031e08a1
gaaccaaatagtaattctggatatacattcacaccatcgagcattgctcggcgtgcaaggctttacacacatgacaaaaattgcaaaccaaccaactcggcacacacagacacagagatgaatcgcaaacaactcacacacaagctagccactaataagcatcactacactgccactgaactctaagcatgatcgccagagccccgccaaacgaaaatcaccagctacgacctgagcttgagtgattccaggccgtggatccccttcttcaggatcccatggaccggccaaccaccactcctcaccttngatctctccaccgcaccaccgtcttgctcgcacgcgttgttctctgccacgcaaacgcctttgcccttccgccgacgtgcgc

SEQ ID NO: 20738 - DNA, 532 bp, Zea mays
  Clone ID: cC-zmle18900031e08d1
cttgattcagttgctgaatcgagcttcgacatgggagtttgcgccgcaagcgttagttctatagttgttctctgaaagtggtggtctttttgctgtatctgtgagacggtaccaaaatcaaaactgcttttggttgaagcagaacggtctgtgggaggctgagttctgcgggggggaagctgaagatgattggtttggtggcctcatgattcacgaacaagccataggcgttagggtaatcagtagcctttgacgactggattgagagattttcttatccttcttggccagcacccaacagttagtcttaattgctttgtcaacgaacatcaaatttccatgcttaagtccaacccagaccgagccgagcctgctctgttggtgagattctgaccgccgtttcctcttgcatatatttgcaggtttacaggctgacagctgcggccgtcttctgttattgctgtctgaagctctgaactttgaaagacaactcttcttagcctcagcggcttggtgcttgaactgtgactgc

SEQ ID NO: 20739 - DNA, 281 bp, Zea mays
  Clone ID: cC-zmle18900031e09a1
gggggcgcactttttaaattcgtttatataaacacacgtaaattcacattattcaggacatctttcgatacaaaaaaaaggagataaaatttaaaaaaaaagatttttgcccacccacttattcaaggcctgatttgatcttgatacaaaaacgccggggaccgaccaacacagttcctacgtccatgcaaatatgggtagcccaaataaaggcctggccggcccacagtaaacaaagacgaggctggaagaacagatggaacagcaaccgcgacggatca

SEQ ID NO: 20740 - DNA, 455 bp, Zea mays
  Clone ID: cC-zmle18900031e09d1
gtcatatctagctatagtagctcccttgagaagcatttgagggaggagccatgtctgaggagaagcaccaccaccacctgtttcaccaccgcaagccagaggaggagggcgcctccggcgaggtcgactacgagaagaaggagaagcaccacaagcacatggagaagctcggcgagctcggcgccatcgccgccggcgcgtacgccctgcacgagaagcacaaggccaagaaggacccatagaacgagcacgggcaccgggtcaaggaggaggagggcgccgtcgccgtcgggggctccgccggtttctttttccactagcaccacgagaagaaggacgccaagaagcacgcccacatctgatccgtcccggatgctgtaccatctgtttttacagcctcgatttcgtctactgtgtgccggccaggccttgatttgggctaccgatttttgcat

SEQ ID NO: 20741 - DNA, 444 bp, Zea mays
  Clone ID: cC-zmle18900031e10a1
ttttacatcttacaacacctttattaggataatttgcatggcaaaattttcgatcacgagaaagcgaccgctgagagcgactctaatacatgacgttgcaattatagtgcataaacactcaacaaaaattacagcgctctgcttgccaccaacctgaaccaattctaagtacagctaggctagactagacgatatacatatacaccataccattaccatcaacaggcctctgaatccagtaggcttcattcttaagatgtcagctacttgacgcgaccaaaaaaaaaaacaaaactggcaatcagattaatccgatacccgatccgacggctagctagctctgtagcaaccatgaccaccagtcatcctccatgctaactcggcactcatcgatctccatacggcagctgcccaagatcttgtacaattaccagttgcacgtcg

SEQ ID NO: 20742 - DNA, 444 bp, Zea mays
  Clone ID: cC-zmle18900031e10d1
cgacgtgcaactggtaattgtacaagatcttgggcagctgccgtatggagatcgatgagtgccgagttagcatggaggatgactggtggtcatggttgctacagagctagctagccgtcggatcgggtatcggattaatctgattgccagttttgtttttttttttggtcgcgtcaagtagctgacatcttaagaatgaagcctactggattcagaggcctgttgatggtaatggtatggtgtatatgtatatcgtctagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaaggtgttgtaagatgtaaaa

SEQ ID NO: 20743 - DNA, 319 bp, Zea mays
  Clone ID: cC-zmle18900031e11a1
gggggggggggcccctttttagggggaaaatttaaatttttaaaccccaaaaaaaaaagcccccccggggggtacaaaaaaagggccccccccgggggttaaggggggggaaaaaaacccccccccccccgggggggatttttcttaatcccccctggggggggccccaaaaaaagggtttggggaaacccaaaatctggggtttttccccggggaaaaatttctgggggggggggggggggccccccccccccccccgggggggaaaaaaaacccggccccccctttttttttgggaacccccccccgggggggtccc

SEQ ID NO: 20744 - DNA, 287 bp, Zea mays
  Clone ID: cC-zmle18900031e11d1
cccacgcgtccgcgcgagagacagacgcgtatacccaggcggtggttgaggaggaggagaagaagaagaagaagatggcttcctccgcgtacgcctcatggtccaagcggtggatccgtcccgaggtgtacccgctgttcgtgccgatggccgtggccctgggtatctgctcgtaccagcttgtgcgcaacatcacgggcaaccccgaggtgcgggtgaccaaggagaagagggcggccggcgttctggacaaccacgacgagggcgagaggtaccccatgcacggc

SEQ ID NO: 20745 - DNA, 354 bp, Zea mays
  Clone ID: cC-zmle18900031e12a1
agaggagcaacaggagctatatgtccattggaaccaagatggatgcaatgtacacgtacgcacgcacacacgttacaaagtcaccacctgcacctgccggccggcggcgcgatcgaggctgctgagtctgatcttaacaacggcgacgtagggatctaaccgatgatctggtcgagggcgccggtgttcttgagcccgagcacgatgccgacgccgaggatgtggccgacggcgccgcaggccatcgtgtcggcgagggtgaacccggcggggtcacccgtctgcaggccggagtcgcgcgccttcagcttaagccccgccgtcgctttgcggttcgcggacggggccaacccg

SEQ ID NO: 20746 - DNA, 517 bp, Zea mays
  Clone ID: cC-zmle18900031e12d1
ccactccgcgctagctgaggacggtacagcggcacagaggtgcgacgtacgacgacgacgacgcaggcgccacacatggcatcccagctctccgccgccgtgccccggttccacggtctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgccgggttcaccctcgccgacacgctggcctgcggcgccgtcggtcacatcctcggcgttggtatcgtgctcgggctcaagaacaccggcgcccttgaccagatcatcggctagattcctacgtcgccgttgttaagatcagactcagcag

SEQ ID NO: 20747 - DNA, 287 bp, Zea mays
  Clone ID: cC-zmle18900031f02d1
ggttgagcttcctaatagggttccttatggatttcatgccttttttgtaactgaggaccaactggctcgacaggcggaggggcagtgaaaatacggcacctgcagattctgcacacgcgggtacaggttggaaattattgcagaggacatgtatatgtatatgacaaagtttattacacatgtattcgaaccacacattacacgagtttattgcaggacgtgtattcgaaccacacattacacatgtatatgtataggacaagtttattacagtcctggttgattgc

SEQ ID NO: 20748 - DNA, 393 bp, Zea mays
  Clone ID: cC-zmle18900031f03d1
cccacgcgtgcgacaacccgcacggctctataggccttgatacgccttggtcttctaccgatggcgcttcactcctgctgcacaaaagcgagagcttctgcatcagaacaactaatcacactcctgacccgctcggggccaaccaaacctcgacacccaatttgcatgtccgagcttggcgcccagctagcatatgtcttcggttccagcgctgaggcagatgctgcggactctgctgctgctcctggaacgaatgattatgtgcatgggcccatcccatgtctcaacggccgcaagagtctgactacagcccagggggtgcagaatgagtgcaggtattgctagatcctgaaggatgtggagaaggaattctgatctaagggaactgacatt

SEQ ID NO: 20749 - DNA, 530 bp, Zea mays
  Clone ID: cC-zmle18900031f04d1
agcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccaccttgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcatgagtgggcggccgtccccggcgggcaggccacgtacctgggcgccccggtgccgtggggcacgctgccgaccatcctggtgatcgagttcgtggccatcgcctttgccgagcaccagcgcaccatggagaaggaccccgagaagaaaaaataccccggcggcgcct

SEQ ID NO: 20750 - DNA, 610 bp, Zea mays
  Clone ID: cC-zmle18900031f05d1
ccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcaggacgatgatgatgacgttcctgagcttgtccctggagagacatttgaggaggcccgcggaagagaaaaaggagtccctcatgattttgctacatgcct

SEQ ID NO: 20751 - DNA, 454 bp, Zea mays
  Clone ID: cC-zmle18900031f08a1
tttttaattaaatatatattatattcaaatatttaatgggacatgaactaaactttagctagggaaccaacccccacccacaagcacgcaaagtccagcatcaataaagcaagacggcgcctatactcagactctgccacaaacatgaataatccaatgttaactgcacttacaatccaattgggaaaaaagattagcccctcattcttttgccgtcgctgcttgttaaagggcacgttaactaacaaagccaagcacaagggacgaacaagcaggtacaatcgcatcgtgtgcctgatcatctcatttggactatcccagcacttacaagcttctgaatcttttgcataactccagggttcttcaggtgctcctgggccgcccttgggttctcctggaaatcatttagcacctgtctcatgatagggtcggtaagaatggtctggatctctgg

SEQ ID NO: 20752 - DNA, 648 bp, Zea mays
  unsure at all n locations
  Clone ID: cC-zmle18900031f08d1
ccggaatccccgggtcgacccacgcgttcgcccacgcgtccgaaggccatggaaacctatcaggctggcctgaagcatgacccgaaaaaccaggaactgcttgatggtgttaggaggtgcattgaacaaattaacaaggctaacagaggtgaaataagtcaggatgaattgcaagaaagacagaacaaagctatgcaagacccagagatccagaacattcttaccgaccctatcatgagacaggtgctaaatgatttccaggagaacccaagggcggcccaggagcacctgaagaaccctggagttatgcaaaagattcagaagcttgtaagtgctgggatagtccaaatgagatgatcaggcacacgatgcgattgtacctgcttgttcgtcccttgtgcttggctttgttagttaacgtgccctttaacaagcagcgacggctaaagaatgaggggctaatcttttttcccaattggattgtaagtgcagttaacataggattattcatgtttgtggcagagtctgagtataggcgcccgcctgctttattgatgctggactttgcgtgcttgtgggtggnggttggttccctactaaagtttaattcatgtcccattaaaatttgaagttaatatatttttaatt

SEQ ID NO: 20753 - DNA, 303 bp, Zea mays
  Clone ID: cC-zmle18900031f09a1
gacgttcataatcatatttaattcaagtatgatatggcacaatatactaccacactatccacctgtaacagtcacaaaccaaagctatagtacaaaattcgaatgaaggcgatcagcatcgcctcaaattttttacagtacaaaccccaaaaaaataaaacgaagactcgcccgatttctgtggcgtgtgtcgggagatgtggtcacctatacgaggggcgatagggggacctgctacggctagggcttcggtccctacggaccctacggccgctgtaccgttcgggtgatggcgaccgccga

SEQ ID NO: 20754 - DNA, 240 bp, Zea mays
  Clone ID: cC-zmle18900031f09d1
ctctacctgacctggtctgcatccttccgctcaacaagcttcatgccagacttccatcctttacgaaggctctggtgctgtggattcgctccaataccgctccgttgagctttaaatcgtgcacggcacaatgcatcacgaaccgtcacgtacaggtgattccccagcccggggtgggcaggtgagcatcacccgagcagcaccgccgccggaggggtcaagctggaaccaagccagtag

SEQ ID NO: 20755 - DNA, 493 bp, Zea mays
  Clone ID: cC-zmle18900031f10a1
ttttgtcaaacaaaacatatcatacaaatccacggggggttttgttagttccaaatttccgaattccagtcacttcacccacagcagcgaggaagtaaaagcttatttcacgactcatctagcaaaacacggtggcaagcctatccccgaaagtccatgtgtggaggagtaaaccttagccttgcagtgctacaccaaggtccgaaacaagatgacacgcaaagctggcagaacctgagtagcagcagcagcagcagcggatctaggcgtcatcgagggcaaggacaccaggtagagtcttgccttccaagagttccaagctcgcaccgccgccggtcgaaatgtggctcatcttgtcggccagcccagccttctcgacagcagcgacagaatcgccgccgccgatgatggtagtgacacccttcgtggttgtaagctcagctagcttcttggcaatcgcctcagtgccagctgcaaacttctcgaactcaaa

SEQ ID NO: 20756 - DNA, 606 bp, Zea mays
  unsure at all n locations
  Clone ID: cC-zmle18900031f10d1
cgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgattctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctgctactcaagttctgccagctttgcgtgtcatcttgtttccgaccttggtgtagcactgcacggctaaggtttactcctccacacatggacntttcgggataggctcgccaccgtgttttgctagatgagtcgtgaaataagcttttact

SEQ ID NO: 20757 - DNA, 368 bp, Zea mays
  Clone ID: cC-zmle18900031f11a1
ggggaataataagataattggtttaaaaattcaaaacaattaccgggtttattcactgtagacagatgtgctgaccacgattaccgtagattacagtaaaaaaacgggtgaattgagcaagagccttttgggggcgggaagatttgagattccctcaaaattggcaagggcttgcgcatgtaaaggcaccccacttgcaagctgacaaatcaactcaggcctatgatgcttgaatcacaaagactttcgagttcattagaagtaatataacttcagccgcccgcaatagaatcaactcagactagcaaatcaaacatgtttttatgatatctccaacaaagctggatctgaaaaacaaaaaacttttt

SEQ ID NO: 20758 - DNA, 617 bp, Zea mays
  Clone ID: cC-zmle18900031f11d1
gccatgacgcctcaactgagtttgacaggaccgagaaggacatcactcccatgggtggtttcccccactacggtatcatcaagggcgactacctgatgatcaagggttgctgcgtcggccccaagaaaagggtggtgactctccgccagtctctgctgaagcagacgtctcggttggccctggaggagatcaagctcaagttcatcgacacctcgtccaagtttggacatgggcgcttccagaccacagacgagaagcagaggttctttggcaagctcaaggcctgagttgctgatggtgtcaagcgaaatggaaatgtattaccagatagttttttgtttttcagattcagctttgttggagatatcataagaacatgtttgatttgctagtctgagttgattctattgcgggcggctgaagttatattacttctaatgaactcgaaagtctttgtgattcaagcatcataggcctgagttgatatgtcagcttgcttagtgcgtgactatacatgcgctagcacttgccaattttgatggaatctcaaatcttcccgcacgcaatatgctcttgctcaattcaccgtttttttactgtaatctactggtaatcgt

SEQ ID NO: 20759 - DNA, 280 bp, Zea mays
  Clone ID: cC-zmle18900031g01d1
ctgacgcgtgggaacagatcacagtgaattccgacaccaaggtctttcgcgcaatgtacttcatgacaggctatcgcggcagacacatccctgtgagagacggctcgcgaagactgcggatgggccacgccggtgaccttggacgtcctgtggtgaccgttcaccggcaggtcctgtgccctctcagtggatacttccgaggaggctactagggcctcgtgtgcagtgacgactctctgggattctgtccgtcagtgctagccgcctttgtattgccagt

SEQ ID NO: 20760 - DNA, 502 bp, Zea mays
  Clone ID: cC-zmle18900031g02d1
gcgcgggtctccgcgcccgtggactcggcgctccagctgaagactatccccgcgcagcgccgggcggacttcgccgcgagcgggtccgtatgggctctgcgactacccaccgacgccgaattgcgccggttcagggtggagtacgagcgctgtctttttagaacacgtacggagtggaggccacggacgaagggcggaaggaggtgttcggcgccgacttcgccgcgtgggcgcggtctgccgaggccgacgacactgtttgggccgacgcggaggaaagcctcacccctcccgccgcagcaccagggaaggacctgcttaaggagttcgaggaggaggccggcgacggcgacagcattcagagcctcgcgcttggggcgcttgacaacagcttcttagtcggcggcgccgggatacaggtggtcaagaacttccgccacggcttgcacgggaagggcgcgtcggtgaagatcttgggaggccgtggcggcagtgggagcgc

SEQ ID NO: 20761 - DNA, 477 bp, Zea mays
  Clone ID: cC-zmle18900031g03d1
cccacgcgtccgcggacgcgtgggcgagcggtggcgcggcggcatctacaccgcgcgcctcggcggcgagctcttctccgatgacggcgaccgccctgttggctgccgtggcggctcccctgctcgcctactactgctgataccttttctgagggtatccttctgctgatgctgccgtctaggctgagtgacctatttctatgtatgtgacgatacaagttaacttgtggagcgcggctgcgcgtgcgttagtgcttgtgcagtcgccactgttgctgtgttcttgcgatactcttgtcacttgagaggtggtgttgtatggactggtttagctggctcccccgtgcttccatcgacccgctttgcgcttcatgtttactacttgcgatactgttgttacttgcgattgatgatgataaaagccaccgcctgtgttactactgctgtaacaagttcgacagaagaaccattcaatgc

SEQ ID NO: 20762 - DNA, 327 bp, Zea mays
  Clone ID: cC-zmle18900031g04d1
aaggagatcaagaacggccgcctcgccatgttctccatgttcggcttcttcgtccaggccatcgtcaccggcaaggggcccctcgagaacctgctcgaccacctcgacgaccccgtcgccaacaacgcctgggtctacgccaccaagttcgcaccagggtcttaagctagctaccgggccgcggcgtgccaggacattgtgttgtacactactcgtttctgtcgtgatctgtaccatgaacgaatgcaaatattcttgtgctctcccagaaggaacgaactggactagttttgctcttcctaaaaaaaaaatataaattttaatatg

SEQ ID NO: 20763 - DNA, 462 bp, Zea mays
  Clone ID: cC-zmle18900031g05d1
gaattcccgggtcgacaccacgcgttcgggatgaagtaaaggactcaggcctagtcaacagaggtcctcggcggctgtctagaggggcggtctccctgttactgcgccgctcgccggcgctgatcatgtgcggggaccgtgtggaacgtgcctgctagaggaggctactggtatgctgacggatgatgccaggaggcttgtgaccgatctgctcaagatggacaatgcttgggggtgcatgcctcgcgtcgaggacgagcggcgtcctcagatccttcgacggcaggaggcacggtcaggtctggacggccagcgaggtgattgtggtgctgggcctgaggggccgccccgtcgagaccctggactacaacaggatgccgaggacaggcggagagggcgccaattcttacagtggccggacatcattgcacgacgagggcaggaaggtcatgggcgaggaca

SEQ ID NO: 20764 - DNA, 485 bp, Zea mays
  Clone ID: cC-zmle18900031g07d1
cccacgcatgcagggacgcgtgggcggacacgttaccgagaggttgtaggagaccatggaccttttactgctcagagccgggctctgtgtgaaggttgccaggtggtgcctctagagagcaggagaaggcacagaactctgagcagcttactgtctttcttggagggcatggggcaggtgttttgacgacttactctggcgacataggggatggacctgatgcccttgggcaggaagggcggacctgtggtactggacggggagatgtctcagccctatgcacctgcatgtgctggcaccgacaaggacgcgcctgtatacggcatcaccaagtctgctgctcaggctgaggctaacaagtgtacgcgcacaaatgcatctgctgtgccaattatgtggaaggcttctttttggcgctttctttacaagagaattgaccgtgttaaggcatatgcaccataacaaacttttcttttagacgctgc

SEQ ID NO: 20765 - DNA, 375 bp, Zea mays
  Clone ID: cC-zmle18900031g08a1
ggtcaaatattttctgccctatattaggcataatgttcaccctctcgctcagcctattcccctacaccttgatcaaataaacttttgcgtgagccttcaaaataaataatatttcaattattttcctttccaaaaatataaaacataaggaaaatacattttgaccaaaaaaaagtttgatagttgcatgatgcttaaatcagagtctacgagataaggttttaaagcagtctagcgggctgcttgacaagcattaaaatacagcacacaacagattgagttttaatgaagcactgcattgcaagatctgaagtcctatagtagcttagatgtaaatataactttgaagaaatcaattatgtggatgcttcgcta

SEQ ID NO: 20766 - DNA, 491 bp, Zea mays
  Clone ID: cC-zmle18900031g08d1
cggacgcgtgggacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttggtcaaaatgtattttccttatgttttatatttttggaaaggaaaataattgaaatattatttattttgaaggctcacgcataagtttatttgatcaaagtgtaggggaataggctgagcgagagggtgaacattatgactaatatagggca

SEQ ID NO: 20767 - DNA, 524 bp, Zea mays
  unsure at all n locations
  Clone ID: cC-zmle18900031g10a1
ttttatatatagcatcaaaattatgtaatgaagagtagcactgattattgttacatgacgaaggttgagcatccatggaggctagattatagacagacaccctgattttacatgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggagcanacgaccgccaatgaggaagcgcggcggccgaggggcggcaggccctgaggcgccaccgccagagctgacgaggagatcatgg

SEQ ID NO: 20768 - DNA, 626 bp, Zea mays
  unsure at all n locations
  Clone ID: cC-zmle18900031g10d1
cggacgcgtgggcggacgcgtgggctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctaacctncatggatgctcaaccttcgtcatgtaacaataatcagtgctactcttcattacataattttgatgctatatat

SEQ ID NO: 20769 - DNA, 411 bp, Zea mays
  Clone ID: cC-zmle18900031g11a1
ttttatagaaattatttttcctcagatctcgccgtcaagcatacatgcattatctcagacttcgcagtggcgagctcgatcgatatatatgatgactagcatcagtactaaaatagtattgtatcagggacacacgtacggcatcgaccagagcaccatgcatggtccatggatcatatcatcattatcatggcttcatgggatgggaatggatcggagtacgtgcttaaccatgatcagtacacacgtatctctcggaggggcggcggtatcccgggtgatggccgggcgattaattagtagctgtagttcttgacgaacattccctccttggcctcggcggcctcgccgtcggaggtgtacttgccgagctgcgccagggagttggccttggcgcgcagcagcagcgcg

SEQ ID NO: 20770 - DNA, 561 bp, Zea mays
  unsure at all n locations
  Clone ID: cC-zmle18900031g11d1
cggacgcgtgggcgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgncatctcacaggacaacgggcttgtgccgatcgtggagccggagatcctgctggacggcgagcacggcttcgagcgcacgttcgaggtggcgc

SEQ ID NO: 20771 - DNA, 389 bp, Zea mays
  Clone ID: cC-zmle18900031g12a1
gcagcaccaagaagcaccattttttgcttaagattaacttagaataaagcctgacgggggtaacagcatccatcgatccgcagtccatgctgtttgatgcatgggtctgctgacaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgtcgtagccgtcgacaccaccactgtagccgtcgacgtcaccgtagccgccgccaccgcc

SEQ ID NO: 20772 - DNA, 520 bp, Zea mays
  Clone ID: cC-zmle18900031h02d1
cccacgcgtccgcaacttcagaaatcagaatgacttccctggacgaggacggggttcacctacaccagggaacagttactaccagaacgggaatgggaggttcagtcgcgtgaacaatggcgccaagcaagctcctgtggccgcgtagaggcatcaaggcggtaggcttacatcaaactaggaagcataaggctacattcaagtgagctgagtgcaaggattattcttagtaggagcattgctgtcagacagcttggttatttttttttgtgccgtgttgggtcgctaagagattagtagttgcagtcgtccgtggatggtaggtgaattttgttgccgttgatgagcttgtcaactgggtgttggaccatggttcgtaactttgtgtcatctgccaatcaggattggtgggaggttagacactaatcttatgaagcggtgactgcaaaaatcagtgtccatgttaaatgctattattgtcatggtattcgataatgcgaagtatgtccatgtttagtgc

SEQ ID NO: 20773 - DNA, 423 bp, Zea mays
  Clone ID: cC-zmle18900031h03d1
cgcgcgctgcgccttactcgggcactacgcctacggcatgaacgggatcctcggctgcatgcggagccctgagctattagacaagctcggactcatcggcgcgtagcccaaggtcctgaacgaccacaacgaccaaggcgggctcgagctgtcggagcaccagtgggcgatcgacgcgatggaggccaactactccgtgtgggcgaccgggtacgccatgttggcggggggcgcggacaggccgactgctgtgcacggagttagccgcacatgtgttcaatatgcggtcggacatgtccctgcacgggggtcgcagcgggcgcaacaccgacctacgacgtgcgctgggcatggtgcggtgcccttgcgtggcggggcagaccagacgagacgtatacgggctggattttgtcaccgtctacc

SEQ ID NO: 20774 - DNA, 393 bp, Zea mays
  Clone ID: cC-zmle18900031h04d1
accaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttggccggtctgagcgcctggccaaatacaaccagctgctcaggatcgaggaggagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctaaaa

SEQ ID NO: 20775 - DNA, 561 bp, Zea mays
  Clone ID: cC-zmle18900031h05d1
cggacgcgtgggcggacgcgtgggccgcttcccggagcttcgccgacgagaagcgccgccgccgcgggcagcctgtgccctcttcctcaccagttccttcggcaagcgccaccccgacggcctcctcttcgtcgtccacctcgactgctccgttcgcgcacctcgtcgccgtcgtctgttcttggacccgccaccaaggaggcgccgctgaacccgcagtccccggagctggtcgcgacaccaacgctcgtcctgccgtccgatgagtccgcggagctgccggacgacccggagttctaccaggaccttctccgcggcctgcagctgccagacatcagcccgatggacttccgtgccgggcttgacgctctggacgtctccgatgcgcccttcggcctggacgatgagcaggacctgctgcttggggacttcggggacgaggaactggagatcgacctcgacctcgacgatatcaacgacgtctttccggagatgcctggctgcgacctcggccgcggcatggacgatttcctgcaaaccgttgatttctgcgtgtgaatt

SEQ ID NO: 20776 - DNA, 443 bp, Zea mays
  Clone ID: cC-zmle18900031h06d1
ggagctcgacggccgtaacatcaccgttaaccaggcccagtcccgtggcggtggcggtggcggcggtggctacggcggcggtcgcggcggcggcggcggttatggtggcgggcgccgcgacggcggttatggcggcggcggcggctacggcggtcggcgcgaaagtggcggtcgcggctacggaggcggtggcggctacggcggtcggcgcgagggtggcggtggcggctacagcggcggtggcggcggcggctggagggactgatgtgtgggcccatcctggcttcggccgagttatcctatctatctatagcatcgtgttaccgtccgcttctgtcaccgtgttagtgtccgttctacctttggattatgtgtgggtaccctgttgttcgctttggttgctcccgctatgaaacgagacgagagaagaatgagcaaggttt

SEQ ID NO: 20777 - DNA, 385 bp, Zea mays
  Clone ID: cC-zmle18900031h07d1
ctgagagctcaactaaattgcaaggccaagcagctgcgtaccacaagccatagctgcgaccatcaagagttgctgggtttctgctaggcaacttcctgcttgatgtggacagtccagaaaacagaagtgaatccgcaatacgtccctgccatttcaaatttgacttggttacacctatctgtgacaatgttaatgtaatgagatcccatggcactagtgaagttcccaggtgtccacctgggattgcttgcggttgagagagacgatagtctgatgacccatgtatacatgaagcccatgatctcagttgtacagtcattagccaatacaaatatgcagtggactaaagggtgattcaaaaaaaaaaaaaaaaaaaccatatttt

SEQ ID NO: 20778 - DNA, 466 bp, Zea mays
  Clone ID: cC-zmle18900031h08a1
cagcaaataacaatataacatgaaagtatgccgtgttggccggcacaagcgccagcatgcaacgcacgctttgaaagttccacatctcaaactcaacaaaaggactcgttccattatttagacatcacacacctatcatgttaacagaaaacactaccgaatacatatggcctaaaatccacacggcctcgcatggtggtggtggacacaaattagctcctcttgttggcgtagctgacaggctcatcgtccttgaagagatcatccatgatttcatcattcttgttaccgacaccaggtgtgccggcagagaacccatcagcgccactggaaccacccattgcgccaaagctaccagcagggttttcaccaaaaccactgtcagcaaagttactgctgccaaagctgtcgctacctccagaagcaaaactggcttcagccccacctgcaactccataatcaccac

SEQ ID NO: 20779 - DNA, 364 bp, Zea mays
  Clone ID: cC-zmle18900031h08d1
cccacgcgtacggccacgcgttcgggctgctcaagaatgctactagttcaaatatgtctggttaccaagcaatgagcatgcatgttatcatccacgctttttgtaggaggggcttcttatggaaccgcatgatcacagtctcagagacgagtctgccaaatatggacaaccatatcgaacgctgagattatcctcgatccgtagcctgggaggtccagaggatgagactctatcacttacacgtgtactgacgaggctactgctgccataacgggcatggctggatagactctggatggaccgaacatacggcttaatcactgctgcgagaggacaggtggcttccgccgcactggcggttata

SEQ ID NO: 20780 - DNA, 482 bp, Zea mays
  Clone ID: cC-zmle18900031h09a1
gaaggactggagagaaatgtgaattagccaactgagtgaacagaatgcagataggatacaatgtccaatcagccatccacactctaatccaaccaatttgcaaatcgtcctggcccaaaatccatgcaattcctgactcaatttattccggcccacgcatgacaaaaatagttttttctcctcgtcactctaacgtgcctgttccatgcctagtaaaattgtttttcactagaaagtattattacatggtgaaagaaccctatggtgccgctgcagcagctgctgctggagccttcttgggcttctccacaacgattgcttgggtagtcagcaccattccagccacggaggcagcgttctgcagggcgcacctagtcactttggcagggtcgatcacaccagcctccaccaggttctcgtgcttgtccgccatggcggttgtaaccgaactcccactcgctttcccggattttatccacaat

SEQ ID NO: 20781 - DNA, 543 bp, Zea mays
  Clone ID: cC-zmle18900031h09d1
gcagatgctgctagcaaagacgatatccaggccagaatcgcgcagctgaagagagagctttctcagacggactcgacgtatgactctgagaagttggcagagagaattgcaaagctttctggtggagttgctgtggttaaggttggagcatcgaccgaggcagagctagaggaccgcaagctccgcatagaggacgcgaagaatgcgacttttgcagcaatagaggaaggtattgttccaggaggcggtgcagcatatgttcatctatcgacattcgtaccggctatcaaggagacgttggatgatcctgaggagcgcctaggtgctgatatcattcagaaggctttggtggcacctgcagcgctgatagcccataatgctggggtggaaggtgaggtgattgtggataaaatccgggaaagcgagtgggagttcggttcaacgccatggcggacaagcacgagaacctggtggaggctggtgtgatcgaccctgccaaagtgactaggtgcgccctgcagaacgctgtcttcgtggctggaa

SEQ ID NO: 20782 - DNA, 212 bp, Zea mays
  Clone ID: cC-zmle18900031h10a1
ttcctagcgtggacgagccttcggcccaagccgatgtccccgcagtacgggcctagcagagacgcctgacggatgatcgtccactcagacgggaatcacaggtaccgggggctatttgtcactaaccaactggctagcgcgacactctgtcggctaaaggctggaaaccgtaaagtatgtgggcggacccccggggctagcctggaataaca

SEQ ID NO: 20783 - DNA, 426 bp, Zea mays
  Clone ID: cC-zmle18900031h10d1
gaatccctgggtcgacccacgcgtacgcacacatacctacactctccaactgttcccgaacgtatggtctaactctgttggtggtcatagatgacaatcgcacgagaacaggcaggacattctggcgataccatcattacgtttgatactatctgttggaattgcattggtggcggttctatgctactggaggcttgtcatagctggtgccgttagccgatattgaggatccacactgcctgatctatgtatgcatagtactaacatcactattgtgttcacattgttgatggagatcaccgaccccaacatcagaagcaaacccgtaggcggtgatgtgacttcagttgatagtttacggcagatgctacatatcggattgctggtactgaaagacataggcgctctgatgaatgattgcaacag

SEQ ID NO: 20784 - DNA, 451 bp, Zea mays
  Clone ID: cC-zmle18900031h11a1
acttcctgagaaggatgatttcattcagctcaccatcgatacagatatacatgagcagaaactccaaaaaaaaaacaggtcgtaatttacaaaactcaagacacaacaacagtcgccgaagcttaaaacgagaggttgtcctcgacgaggcagccgtcgtcgaagctccacagcggcatgtcctggtccgccgcggcggcggcgttgctctgcacggcgtcggcgctgaacaggctgtccagcgactcgtacgcgccggcgtcgaagaaggcgaactggtcgccgaagaggagcgagtcgaacagcgcgtccgactcggagtcggaggcccggggcgacgcctcgtccgcggcgctctccggccgcgcctctaaagtcaaggccgggcgcggcgcgggggcccttgttgtacgccgacgacacgccctgccacgaagagtccgggagcgcg

SEQ ID NO: 20785 - DNA, 296 bp, Zea mays
  Clone ID: cC-zmle18900031h11d1
acacacgcgaagaaaaggagatagagtacaggttacagacaggcagagagcaaagatgtgtggtggtgcgatcctcgccgagctcataccgaccacgccggcgcgccgtggcggcgcggcgtggcccgccggcaagtgcaagcggcggaaggcgaacgacttcgaggccgcgttccgggagttcgactaggactccgaggaggaggaggaggactactagggggtggtggagagcaagcccgtcttcgtcgtcgtcgccttgttcgcggggacgcagcccagggcgcgccaggagc

SEQ ID NO: 20786 - DNA, 302 bp, Zea mays
  Clone ID: cC-zmle18900031h12a1
gaaggggttgccgaaagggttcgcggggttctgctgcatctgcatcgggtggtggaccgccggcgccggcgccatcatctgctgctgcagcatgaaaacctgctgctgctgctggtggtgagccatcgccgccatctgcacgccgtgcggcgccgcgtacccgttcgaggcgtagaacggatcgtgcatcgccggcgccatggtggtcatcatcggggcagacgcggttgcatcccaggggttgtagctcgccggctggctcgctctccggttcgcctcgatcgacaggctatcaagggtca

SEQ ID NO: 20787 - DNA, 521 bp, Zea mays
  Clone ID: cC-zmle18900031h12d1
cggacgcgtgggcggacgcgtgggcggacgcgtgggcggacgcgtgggcgccaagaacgcactgagtccattcctcctcttcccctcctatcgcctctctctgcccctctcctccccggagattcctgctcctcccgactgccaagggttatcctattcactctgcctgctgccaaggccaactaggatatcaactaggaggagttgaggaggaatggctgttggcggaactcaaccggtcctcaggaagtacctaggtgccctcaaggacacaacgactgtgagcctggcaaaagtgaacagtgattataaggaattggatattgcaattgtcaaggccacaaaccatgttgagcgtccatcaaaggagaagtacataagagaaattttccattccatttctgctgctaggccacgggcagatgtagcttattgcattcatgcccttgctagacgtctttcgaagacgcgcaattgtgcggttgcgctaaagacattgatcgtcattcatcgtgcccttc

SEQ ID NO: 20788 - DNA, 363 bp, Zea mays
  Clone ID: cC-zmle18900032a02a1
gccacaaggtcaacatcgatctggtagactggtagtagtagtgtccatggggaagaacaatggatccgatccacaatatggttacatacaaaaaccaagaactcttgttattaactactaatacacagcagtgtatttcttatctaacagcggttttcttgcataatacttctatgtttcctcgtaacaaatgctatatttctaacctattaacccgcagcgggctgcagtgcagcaacacttgttttgtgttgtgccgctggatctttccgtccaccgttacaccgtacctaccgccttcctggccctcctgcaaacctcctggcagtgccgaagatgaagggcttggtcaacaacccaccg

SEQ ID NO: 20789 - DNA, 532 bp, Zea mays
  Clone ID: cC-zmle18900032a02d1
acatcataggccgcaggatatgggcgtctgggaagacattttactgtgtgaccaagggtgttcctcgtccctccgttccaagacaaaacaaacctcgccgtgtggacttgtactactctagctggtgcatccgtccagttgagtcgagaaaaggcgacggtgcaatgagtgcatgcgaggtgctcttgttccaccacgaggacatggggattccatgggagatcgcgaagcttggcgtccggcaggggatgtggggctgcgtcaagaggatagagcctggccttcgggcgtaccaggttgggaggaccgccggagaggctgtttccaagtgtgctgccatggcacaggtcaccaccaggttcagtgccgacgagctcgtcatcgcagggcccggcaacacggaggccagttcttcttcgtccggcgacggcgcagaggttgacaaggcgacgaagcactgggcgaacagcatacccaaggttctcatggtcggtggcgctgtggccctggcctgctgcaccttcgacggtgg

SEQ ID NO: 20790 - DNA, 371 bp, Zea mays
  Clone ID: cC-zmle18900032a03a1
ttttcagaaagcaacacaagatgccattgcagttgatatacagcatttatttacagaaaccatggcgtgcagacgtgcagttattccgcctgtacagtacagcacgcgccgatcgatcgcggaggcggcggcggcagcggcgggtgagcaaggggcccgctcagctgggcgcgaaccggtcgaggaggaggtagagcgtggtgtcggacatggcgccgccgcacctcgcgacgtccccctcccgcctgtccgtcccggccgccgcggctcctcgcaacgccttgttgttgctgctgctcctgtcgtcgcctcgccacggcctctgctgctgctggcacggcagccgcgggttcgtgtcctcgccgagcccg

SEQ ID NO: 20791 - DNA, 214 bp, Zea mays
  Clone ID: cC-zmle18900032a06d1
cgggtcgacccatcgcgtccgaatctaatctatgaggggaggtggggctcatagctgccagcggacattgttactatactttagatagatatttgttgattgccaatttatatgggtcgggggaggtaatttttgataaagtgagcatgtccccttatttgtatatattatggattggaatattaggttgccaagtggtcttccagcaataaaa

SEQ ID NO: 20792 - DNA, 451 bp, Zea mays
  unsure at all n locations
  Clone ID: cC-zmle18900032a07d1
cgggtcgatcccacgcgtccgcggacgcgagggcccacgcgtccgtaaaaatggcatcgaggtttatattcttgggatgggcgctgctgttctcggcatgcaagctactgtaggagcttaggtagcaaaagctctcacaacctctgcagtaccctattatcaagctgcaggccaaagccctgtctaggctttagaagttttcctagttcaagcttcagcgaacaccatcctgtcgcatttcctaggagaggcgagctccctggagctgctgcgctcggagtcactgcctccagcagaatccgccgtcccggccccggcccctgcacgggcctgagccatggcccgttgagcaggncaagaaaaatccttaatccttggctttggctctagacagtagctatttcttgatagcatgtacaacttgcatcaagaatacctacacatcgatgcc

SEQ ID NO: 20793 - DNA, 369 bp, Zea mays
  Clone ID: cC-zmle18900032a08d1
tcctcaaccaaattcaaagtcacagaggcgaaactctcggcgaagtctggccgcggcatgggcgggaagggtctgggcaagggcggagccaagcgccaccgcaaggagctgcgtgacaacatccagagcatcaccaagccggcgatccgcaagttggcgaggaggggcggagtcaagcgcatctccgggctcatctacgaagagacccgcggcgagctcaagatcttcctcgagaacgtcatccgcgacgccgtcacctacaccgagcacgcccgccgcaagactgagaccgccatggacgttgtctacgctctcaagcgccagggccgcaccctctacagtttcagcggttaagtcgcccctctcccg

SEQ ID NO: 20794 - DNA, 483 bp, Zea mays
  unsure at all n locations
  Clone ID: cC-zmle18900032a09d1
cccatcgcgtccgcccacgcgtccgcccacgcgtccgcaaaaccataaaaaaaaccagagcgagctgaagcatccaggctctggaatcatcgtcgggatgtctgagccagcatcagcccaggagcctcacaccatacgatctgctgggagctgctgcttcaagtcgtcgcatcaactatctgcgcagaatctgggccgacatcgcaagaggcgggggtccggaaagttgatgatcctttccacccgaggcgagcttgagtccagaaacggcgcacatcctggaggccttatgtagtgaaagaatgtcgaggagcacatcatcctgctcagagccaagcccaacatctcagacgctgaagataaagacatgctggactacctatacacatcgcagtaccagatgcgagggatactcgcggnctcgctaggccgcatcgatgaccccaacagcgacaacttcacgcacgctgtgttcatgcgttt

SEQ ID NO: 20795 - DNA, 385 bp, Zea mays
  Clone ID: cC-zmle18900032a10d1
ggaattcccggagcgatctatagcccatatccgtagtcagcttatatagggattgtattttccatctctttgagttaaaggagttaaacacttctatgtttctagagactgcattttaaaagattagagcttatatctacaacaaagtctttttgtctcttgcaagttagataggctagggtttattaccgaaacacctccccccaccccccttattattgttctgtcacatggataagagttttccatgtacttctatttaagtctaaatctttagatatatatcatcattagaaaccttcttttaatttttttttttattttttttttttttttttttttttttttttttttttttttttttttttttttttattttttatgg

SEQ ID NO: 20796 - DNA, 377 bp, Zea mays
  Clone ID: cC-zmle18900032a11d1
cccacgcgtccggttcctaccagcactgagccacctagccatggagaaccctgccgcctacttgcatgagcagctgcttgcatccaacccacttgctctggcgatcgtagttgcaaaccagcaacaacaacagctacaacagtttctgccaacgctctgtcaactagccatggagaaccctgccgcctacgtacaacaacaacaactgctttcatctagcccgctcgctgagggcaatgcacctacatacctgcaacaacaattgttgcaacagattgtacctgctctgactcaacttgctgaggcaaaccctgttgcctacttgcaacagctgcttccattcaaccaactgactctgtcgaactctgctgcgtacc

SEQ ID NO: 20797 - DNA, 455 bp, Zea mays
  unsure at all n locations
  Clone ID: cC-zmle18900032b01a1
ttttgatactaatatctgcaccatatgcattatcttatacacaaaagtgacagcttcactgttcgggtgattgctacgtacgctatcgtcggggtggctgtgttaatcaatcaaattaatcgccgatcgaaaacgttcaaagaaatcacacgatcccccccccccncccccccngagtggttcacgctacggggagcgaaaaactcgcctctccaagggcaagggggcctacacgtacggacttgctgctgttagctatagcttcagagcttcggtccccgccggccgccgacgacgccgttggtgcggttgcattgaacctcgagttctttctatgtacaggtcgctcccttggccggcggcggctgggtgtcgactccgatcagaagaactccatcttcatgtggccccttttgtgattgaagctgaccatggaagctttgggctgaaactga

SEQ ID NO: 20798 - DNA, 424 bp, Zea mays
  Clone ID: cC-zmle18900032b01d1
gcgagggggaggaggggagccccgtgaagctgtccaagccggagcaggccggcagcgacagctccgtcgaggacggcggcgcgcagaaccagaagccgccgccgccggggaaggggaagaatgccaagccggtggagcctcccagggactacgtccatgtccgggccaggagagggcaggctaccgacagccacagcctcgcagagagggtgagaagggagaggatcacccagaggatgaaggtccttcaggacctggtgccaggatgcaacaaggtgatcggcaaggcgctgatgctcgacgagatcataaactacgtgcagtcgctgcaacggcaggtcgagttcctcttcatgaagctcgcaacccgtcaacccactgggacctgagcaacctgcccacgctccttcaaaaaagattatgt

SEQ ID NO: 20799 - DNA, 472 bp, Zea mays
  unsure at all n locations
  Clone ID: cC-zmle18900032b02a1
aatcgataattgatgatgtattgaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttctccacaaatgcccaccttcaagttaggcctagctttgcggcccctctctgtagcaagcttcaccagctcgcccactcccctttggtccaggacctcgaaggggtcatgttggagattgccctgagcangatagacgggaatg

SEQ ID NO: 20800 - DNA, 543 bp, Zea mays
  Clone ID: cC-zmle18900032b02d1
ggcattttccgtgctatggatggactcccggtgaccattcgactcctggaccctcccctccacgagttccttccagaagggaacatcgcggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggctcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggga

SEQ ID NO: 20801 - DNA, 381 bp, Zea mays
  Clone ID: cC-zmle18900032b04a1
ttttttttttttttttttatttttctttcttgggggaaggttttacttttttttttaaaattttcccaccattccctcgcttttactatttttaacttattttctttcctcttttaccattacattatttgaataccccacccctcattcaaaaaaaacctattgtttgcgggaagacaagaactttcctcaaaaacgccaaaggggcccccccgcaaaacccccccactgggaaggtccccaaggctccccttccttatatgggggggaacccccccctctgggggcattttttggtactaaaaaaaacccccccccccccggcccccctcaaattttaaaagggggcatgggctttaaaaattttcaaccagccccatc

SEQ ID NO: 20802 - DNA, 471 bp, Zea mays
  Clone ID: cC-zmle18900032b04d1
cccacgcgtacggtcaagaacgaccgggcaagatcctctcatgggtccaagacgaagatatcgggggtgatgacaggtgcagctattacactatcggctgacaaaaccgtgatggatgctgctgttctcatgctcaagaagaagatccacagattaccagttgtaaaccaggacgaaagagttataggtatagttacccgcgctgatgttcttcgcgtgttggaaggcatgtcgaagatttaggagcgcacatacccatgctcggaagccacagcctcttgtaaatatgtagatgtgcccgggcatggagtattgactagcagcaaagagatctaccatgtataggagtttctccttgtaaataataatagcacgccaggagactccatcccaggttctcgactgcttgcgcgaccagatgctgtaaactagccagatacttgaagaccaatttaaatggatatgtctaaa

SEQ ID NO: 20803 - DNA, 367 bp, Zea mays
  Clone ID: cC-zmle18900032b05d1
cggaattcccgggtcgaccctcgcgtccgatctagcgcatccttacatggatgattacgctgatgcactacgtcgtgttggtgtgtgtgtgtattgtgcctttgcgtccacgcctcgcgttcaccatcgcccagcctctcgatcgctgggggatcgggcgtgatcacctagtcgtgctgatggtgcatgtggtctgcagatcatggaagttggcgggggagacgtatagcttgccggagataggccgaatcctcaccgggaatcctcgggcggcactgctgcgtcgaccggccgcatcgtcgtcttctcgagagcgtgaggatacgtgtcatccgaagtgcaagtaggtacctggaatctcaagtcc

SEQ ID NO: 20804 - DNA, 406 bp, Zea mays
  Clone ID: cC-zmle18900032b07d1
cccacgcgtccgcaaatcagtcattatcccaattttagctatagcgtttagtatcttcctcagcttcagccttgctgccatgtatggagttgctgaggctgctcttggaaagctgagcaccattgccacaagtctagctattgaagcatatggccctatcagagataatgctggaagaatagctgaaaaggctgggatgagccataagattcgagagagaactgaagctctagaagctgcaagaaataccacggctgcaattgggaagaggttttgccataggctctgcagcctaggtttcccttgcactatttggagcgtttagaagccgggctgctatctccactgtagatgttctgactcctaaagtattcatcgggcttattgtcagagctatgctcccgta

SEQ ID NO: 20805 - DNA, 417 bp, Zea mays
  Clone ID: cC-zmle18900032b08d1
tagagggtcaaattctgagaaaacggactagaaagaactctacacaaaacataagggcaacatgaacaggcttttctgcacaaagattagctcaaaaccaaagcttgattctcaccgcttcaaggatataattgatgaagcgataggagaaagagagctaaagtcaactaaagagtatgagaaaagggctaagaagatctcaaggatggagccaccaacaaatccgctagagaggagagcgaaagctgagcggaaaaaacagttcaactccatcctctcgaacatcatgtccaagagagactccaaagcgagcagctcggagcccacagaagaagagcttgagcaggcgcaacagatgctggagagcagaaaggccaagaagcgcaagagatgctgctgccagccttcttgccctat

SEQ ID NO: 20806 - DNA, 402 bp, Zea mays
  unsure at all n locations
  Clone ID: cC-zmle18900032b10d1
ttatcctccagggtcaaacagcagaggataggacttgcactcactgcaaggttgttcagccacctcgtactcggcactgccatgactgagataaaagcgtccttcaatttgatcatcactgcatatggcttggaacatgcattggcaaaaagaaccatagtcgntttaggaggtacatatctgaagaaacaatcttgagtatctggactgctgttctctacattgagtcattgcgtttagatgtcgacaaggcctggaggaaggatttagtcggagagatcctgtaggcagagcttatctttatcctgatattcctactactattgaggntgtttcattcgtacatagctagaacaaatcaaacaacctacgaagttgccagaaagaagcgaatattctacc

SEQ ID NO: 20807 - DNA, 92 bp, Zea mays
  Clone ID: cC-zmle18900032b11d1
ggaattcccaggtcgacccatcgcgtccgcccacgcgtccggtctcttcgtcctaatcattttcgggatatgaagagtttaggcaaaaacat

SEQ ID NO: 20808 - DNA, 385 bp, Zea mays
  Clone ID: cC-zmle18900032b12d1
agcttacgctcccatggcgagccatgagaagtagtgctgcctcgtcgagcactcgatgccgatgggcctgtcaggcgctgctgcgctcacgtagcggcccggccggttcaccgtctaggccatcctgcccgagtaggcaacgtaccaggaggagcagcccatcaacggcgacccgttcatcggcagcctggagacgccggtcacctccagcccgctcgaggcgaggtacctctccaacctcccggcctaccgcaccgccgagagcccgctgctgcggggcgtcgaggtcggcctcgcgcacggctacctcctcgaggggcccttcgcgctcacgggcccgctccgcagcacgcccgagcacagccaggccggcgcgctcggcgcc

SEQ ID NO: 20809 - DNA, 350 bp, Zea mays
  Clone ID: cC-zmle18900032c01a1
aaaaaaaaatttcaatttttttcctttccaaaaatttaaaacataaggaaaattctttttgaccaaaaaaaaagtttgatagttgcatgatgcttaaatcaaagtctaccaaataaggttttaaagcagtctagcgggctgtttgacaagctttaaaatcccccccacaacagattgggttttaatgaagccctgcattgcaagaactgaagccctatagtaccttaaatgtaaatataactttgaaaaaatcaattttggggatgcttcgctataaaaacaaattcttttgggaccaaccatttcgcttgtcggcccccggttttcctttgtttccacaaaacattttt

SEQ ID NO: 20810 - DNA, 522 bp, Zea mays
  Clone ID: cC-zmle18900032c01d1
aggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaactttttttttggtcaaaatgtattttccttatgttctatatttttggaaaggaaaataattgaaatattatt

SEQ ID NO: 20811 - DNA, 256 bp, Zea mays
  unsure at all n locations
  Clone ID: cC-zmle18900032c02a1
ttcggtgggcggtgggttcggcaactggctatggctaggttaattaaatgagacaaaaccatgaatgcaatgcaatgtgtcaagtcacagtgtgtgtactatacattttggatttgggtgtcatccatattcgtccaaagactgaaacagtgaaaccactgtgtggtcttcgtgttcgtcggtacttttaggacatgtacagcgtgtcttgtcttttccctacactctctcgctgttgttgtcgtcatgtatcana

SEQ ID NO: 20812 - DNA, 254 bp, Zea mays
  Clone ID: cC-zmle18900032c02d1
ggatacatgacgacaacaacagcgagagagtgtagggaaaagacaagacacgctgtacatgtcctaaaagtaccgacgaacacgaagaccacacaggggtttcactgtttcagtctttggacgaatatggatgacacccaaatccaaaatgtatagtacacacactgtgacttgacacattgcattgcattcatggttttgtctcatttaattaacctagccatagccagttgccgaacccaccgcccaccgaa

SEQ ID NO: 20813 - DNA, 348 bp, Zea mays
  Clone ID: cC-zmle18900032c03a1
gccttacattattgtttttttgtttacccttcgagcggccgaagcactactttagacatatccatttggactggtccacaaagatacggcgggctcacaggacctggacgaccccgcatggccgaacctgagatggagtgtcctggccggctacttttatttagatggaagaactctgtgtgcacggacgagctgtttggtggtactaaaaaccaccatgccggggcccatctaaatatttacagcaggctggctgtgccgaccatggcgtgtctggctcactaaatgttcaccatgccttacaacaggcgaagaacattagtgcgggaaactatacctattactttt

SEQ ID NO: 20814 - DNA, 593 bp, Zea mays
  Clone ID: cC-zmle18900032c03d1
gctagctaaggagagtgtgatcaccaacagctagtgctagtcccccttccttccatccatccatggcatgcgtgagcaccttccagagctgccccattgccagaagagcaaagatcaacacgaggtccaggggctgcatcagtagcgtggcgaatgggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtgcacacccgtgctggtggccacagcagaccagaccctggaggacgtcgagtgccacttcgaggccgtgtcggggcttccggtcgtcgacagcggcctcaaatgcgctggtgtgatcgtcaagaacgaccgggctagagcctcttatgggtccaagacgaagatatcggaagtgatgacatcttcagctagtacactatcgtctgac

SEQ ID NO: 20815 - DNA, 324 bp, Zea mays
  unsure at all n locations
  Clone ID: cC-zmle18900032c05d1
gacccacgcgtccgcttgctgatatgctntggaagcatcactacatgcggctacattgtcatccatcttttcaaagtatcatatcaagatcctatctaccacgtgctattgaactccctcagcaagtatggaattccaacttcactgagataatgcatcttctatgatcctgattagaaaatggattgaagttttatgagcagcttggctggnaatattataaagtnccttctatctatatgtaaggtaccactattatagggacaggaagatagcaatctgacaagtaggtccactttgaattaaagaactcatgagctgagt

SEQ ID NO: 20816 - DNA, 442 bp, Zea mays
  Clone ID: cC-zmle18900032c07d1
ccacgcgtccgcccacgcgtccggcaccgagggcatgggaggcgggcccacgctccttgccatcctgtccctgccgccggactccatcaacgggtccttccgagtgacggagcaaggcgtggtcatcgagttctgcttcggggtggagcacctgagcttccagactctgcagcgcttcacggccgccacgctggagcacggcatgcacccgccggtctctcccaagcccgagaggcgctagctcatggacgagaaggcggtcgaggccacagatgagtaccgctcggtcgtcgtcaaagagccgcgcttcgtcgagtacttcagatcggctacaccggagaccgagtacgggaggatgaacatcggcagccggccagcctagtagaggcccggcggaggcatcacgaccctgcgcgccatcccctggatcttctcgaggact

SEQ ID NO: 20817 - DNA, 369 bp, Zea mays
  Clone ID: cC-zmle18900032c09d1
ccacgcgtccgcccatcgcgtccggagccctcgtcctccggcgccgccattgccgtttcgctggtgctcccctacctcaaaggcttgctcaacgggatcgcgctccgggagccctccccgaacgtctccgtcgtcgacctcgtggagctggtctccaagaagaccctcgccgaggtggtgtaccaggcgttccgcgacgccgaggcctacgtgctcacgggcttcctcgatgtctgcgtcgagccgctcgtgtccgtcgacttcaagagctccgacgtctgctccaccattgacgcctccctcaccatggtcatgggcgacgacatggtctaagtcatctcctggtacgacaacgagaggggctactcg

SEQ ID NO: 20818 - DNA, 460 bp, Zea mays
  Clone ID: cC-zmle18900032c10d1
cggaattcccgggtcgacccatcgcgtccgggccactgctcgggctcttcttgctgctaagttctagcaactttatctggcaaggatacaggcccatgctgttcctgttctctatgatgctgtacttgagatttaagttttccctcagtaagcccgttggtgtttcactctctatgagacactggcccctattcaagactggactggagctgctatcactacgaggggttcatatattcctcttggttaaattgttggagcaaatgtgcgcaagctttacctgtttatcgtgggcccgacagtgtcttctgagtagtatgcgtatgcagtatttatacgagtccttgatgatagagcaaaccaggctctaaatcttcctggatctgctcaaactggaaaatattctgttatttgagttgcagattagataacaaagaggccgagtatttttttaggagct

SEQ ID NO: 20819 - DNA, 341 bp, Zea mays
  Clone ID: cC-zmle18900032c11d1
ggaattcccgggtcgacccatcgcgtccggagacctcaactttgcaacgactagagtctgccgtgtccccttgcatctgatggtggagcaagagatagaaagagtccattgcggctgcaggggttgagcctgcggagtctaatcttgtctgttgtcatcttgttgtagggctcacgtctcatcatcaccatcctaaccacattaaagcttttcggttagctctcaatccatgtggattgtgagggattggatgtgtttgaatcccaaacaagtcaaactttttaagtatttttttcaatctcatccaatccatgtgtattgggaataaccgaacaaggcct

SEQ ID NO: 20820 - DNA, 445 bp, Zea mays
  Clone ID: cC-zmle18900032c12d1
cggaattcccgggtcgacccatcgcgtccgggaaactgtcttacttagcaactagataaggatgctgacaaggaattcatgtcctgctaggcttcccttcttatgtctattgaatgggcgttcctagttcatgtagatttctctagagtcgagtaccctgcagagttattagaaagccacttcacagggttgaaggctctggagaatgtatatggttctggagtaactgttaagcagggaacagaaatagttcagagagctgtcaccaaatcattccagtccctacatgaagcatacaatggaaaaattgtagggctggtaatatccacaaatgaagctccatcatccttaggatccataattgacgcaccatcttcactgcacatttcaagacagctagaagtagcaagcatgtctacagatatagcctccgtggtactcgttc

SEQ ID NO: 20821 - DNA, 305 bp, Zea mays
  Clone ID: cC-zmle18900032d02a1
gggggatgtaggtattagtattacgaagaagttttattcaggtcacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggt

SEQ ID NO: 20822 - DNA, 533 bp, Zea mays
  Clone ID: cC-zmle18900032d02d1
agcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctggataaaacttctttcgtaatactaatacct

SEQ ID NO: 20823 - DNA, 354 bp, Zea mays
  Clone ID: cC-zmle18900032d03a1
agaactcagccaaaatgagatgttacaaaatggaataacagtccagagcatgagacaaaaaaaattacaaaggtttctgtgagacttctacccaggctcccttagaatccaagaaaacatatcataataacagcgcaaacgctgcagtcaatcagcagagcacctagtgctttttgtagcagcaacccgatctttagcatctgccctaagctatcagctgaacccagattgacgccaacgggtctgcttctcacattggggtctttgttctccatcaacaatgtgaagacaatggtgatgttggttacaatgagaaatagaagaggccttgtaccaactaatactctggtgatg

SEQ ID NO: 20824 - DNA, 543 bp, Zea mays
  Clone ID: cC-zmle18900032d03d1
caacccaagcggacaattcaggttggtctgtggaaactctgatggaactcttagatttcactccacaggaaataaccaaggccatttcggcgaccgagagtaaccgtttcgtagcatctgtcgtcattgctttcctggtggttctgtcaaactggggccttgacattggtggtgccatcaccagagtattagttggtacaaggcctcttctatttctcattgtaaccaacatcaccattgtcttcacattgttgatggagaacaaagaccccaatgtgagaagcagacccgttggcgtcaatctgggttcagctgatagcttagggcagatgctagagatcgggttgctgctacagaaagcactaggtgctctgctgattgactgcagcgtttgcgctgctattatgatatgttttcttggattctgagggagcctgggtagaagtctcacagaaacctttgtaattgtttttgtctcatgctctggactggtattccattttgtaacatctcattttggctgagttctaaattactaaaact

SEQ ID NO: 20825 - DNA, 199 bp, Zea mays
  Clone ID: cC-zmle18900032d04a1
gcggacgcgtgggttttaattaaatttttgggtttgtatatatttttattttattatattttatccacccgggcggttaaaggaaaaagtatgttttttaattaaaaccaaccagctagctaaacactatagggaacaaaaaaagaaaggcgtaaataggagagaaagagcacgtggagaaaagtcgggaacaaaaaga

SEQ ID NO: 20826 - DNA, 376 bp, Zea mays
  unsure at all n locations
  Clone ID: cC-zmle18900032d05d1
gatcccatcgcgtccgcggacgcgtgggcagttctactccagaatggtaggttcccaaaaatcttcattgttcttctcagaggagaggaggcagcattttacttctatcgcattgcaactggtaaccccaaagatctgagcagcaagaaagattcagcgaacttatgcactgggacgagtcagaaggtcagagggacgtagacccagaagattatggtctgttcctttccattttcttcatcggccttcaattgaagcaaagctcggncctagcgtctaagaagtctgcgagaagatacatggattcaaaagaattgttagcttatctggcccacttcccgcactcctttgttcctttactcgtgtaatatactaa

SEQ ID NO: 20827 - DNA, 439 bp, Zea mays
  Clone ID: cC-zmle18900032d07d1
acccacgcgtccgagcttcgcccgttcgccgagcgagcgtcgtcaaccaaagactcgtttccttcttagagctcctgttcgttccttccttccctggaacccttcccccgtaagctcgccgctgcgctgagttcggatggcagttggtggcggcgagagagaggcgtcgccctcgccgtcgtcggtcgaagcgaggtcgaggaagacgagcggggcgcggcgccgcgcggccgttaggtgcagcgtcgttggcgaggccgggccgggcgccgccggcgggcgggaggaggacccctaccggacgctgagtctgcgccggggggccacccgcggcgaggtcaagaaagccttccgccgcctcgcgctcatgtaccatccggacgttcgcaaggagagggagagggagatggaatgcgacggcgacagcggcgtccagttc

SEQ ID NO: 20828 - DNA, 396 bp, Zea mays
  unsure at all n locations
  Clone ID: cC-zmle18900032d08d1
cttgagaactatggactaccattttcaagaactgaagagggaaagatataccaacgagccttaggagggcagagcttagattttggcaaaggaggacaagcctaccgttgagcctgcgctgctgacagaacaagacatgctatgctgcacacactatatggtcaagcaatgaagcacaacactcaatttttagaggaatactttgcttaggaccttctcatggacaatgaaagaaaaagtcagggaatcattgccttaaacatggaggatggaactcttcaccgtttccgagcttctaatacaattctagccacaggaggttatggcagggcatatttctcagcaacctcagcacacactngtactggagatggcaaagctatggttgcacgtgct

SEQ ID NO: 20829 - DNA, 463 bp, Zea mays
  Clone ID: cC-zmle18900032d09d1
cggaattcccgggtcgaccctcgcgtccggcgtcatctgcctcgtgcactccgagccctgcggcttcctgctccgccgttcggtcgccttgtcgtctgcggggtcgccgtcgccctgccggccgctgcttgggcccgcggtccgccgagcggcggatgcgtccggtccggtcggcgcggcctgcctcgacgtgccgctgccgctgccgctgcgcctgcgctcgctgcggtcgctgtcgttgcggtcggcgtgcacgggcgtcctccggtgcgccatggcggaggtcatgcccatggagtcgtactatgcggatggccccggcgggcgcatgtcggacgggttcctgtactagtacaggaagggggtggatgtgcggttcgtgagcgtctgccacggcagcttcctcacgccggccgagttcgaggagctcgccggcggcagcgtggtccccaacccgctgcgc

SEQ ID NO: 20830 - DNA, 422 bp, Zea mays
  Clone ID: cC-zmle18900032d10d1
cggaattcccgggtcgacccatcgcgtccgggatttaatccccttcaatccccctcaaaccactagtaaccgaacgaggcctgatggggcgggcgagtctttatattgaaagaaactacataaaatagcatgccgtctctgtcactggcaatggacggaggagcctagcgcaactcagcgcacaactgagtgtcttgatttttcttctgtttatcacggcattagtgccatgccgttttatgttacagagttgagagctcgcatgcatccgaaaatatgcgtctgagtttaaggttgggtcaaacttgtcgaattaggggttctgttataatatgttgagcatgaataaagatggatgctggagactctgtcgccatcgccgtccatcatgagagtcctgtaattcaacttatatctatcat

SEQ ID NO: 20831 - DNA, 346 bp, Zea mays
  unsure at all n locations
  Clone ID: cC-zmle18900032d11d1
gacccacgcgtccgggatttaatccccttcaatccccctctaaccactagtaaccaaacgaggcctgagggggcgggcgagtctttatatagaaagaaactacataaaatagcatgccgactctgtcactggcaaaggacggaggagcctagcgcaactcagcgcacaactgagagtcttgatttttcttctgttgatcacggcattagagccatgccggttnatgttacagtgttgagagctcgcaagcatccaaaaatatgcgtcagagtttaaggtagggtcaaacttgtcgaattagggagttctgttataatatgtcgagcatgaataaagatggatgctg

SEQ ID NO: 20832 - DNA, 551 bp, Zea mays
  unsure at all n locations
  Clone ID: cC-zmle18900032d12d1
ggaattcccgggtcgacccatcgcgtccggtaactaaattatatatcaatagaatatatatataattttaagtcaaatccaaaagttattttaattagcttgaaataaagtattttaaatacctgtttccaccattttaaaattaatcctactcattttctaattaacaaataaaatactatggaaatgattctttctatagatagatattcctttaatgacgcttatttctaataaaattgagtttttattaatgaaaaatattattttgagaaggttttaataatgattatataagttgccttttaaaatagntaaaaaaaattaaaattcatttatatattacatctttttcttttaaagcatatctgatattttgaagttgntttcaagtaaagaattaacatgaatttgaaaactctagatttaacagataccatgtatttaataaaagaggctntgcagataagtnntataattaattcaaactctatcatggnattataaataatacttatttnctattacaaatataaatagaaccaaatata

SEQ ID NO: 20833 - DNA, 467 bp, Zea mays
  Clone ID: cC-zmle18900032e01a1
ccgtgggtactttttactttaattagaaagaaaagctattagaaagaaaagcttctttttcgaaagattacccctgtctttgtttatgcttcggattggaacaaatgactctaattcgcccacgcctgcgaatcagtcgacattttgtacaaattttacgaacggaagctcttattttcatatatgggtattcctttcttaaactatgaatctattcttttggaaaaaataagtctcttcacttaaattttgaaacttggaagttattaccccagaaaaacctaatcctttgaatctttggtatccttcaaatcttcagtatccttcgagtcttcggtacgcttcgaatccttatggggaagtctataaattatacgacctttgctggaatcataacgacttatttcaattttgaccctatcccccatcagtattcgtatatgactagaccggtatctttcctgaaa

SEQ ID NO: 20834 - DNA, 556 bp, Zea mays
  Clone ID: cC-zmle18900032e01d1
agactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagttttatgttatatatggtaatggccccacctatagtacccaaattctatctcgaacttcctattttgaaaataaaaatagaaaaataggagaaaaatatatgacagaaaaaaaaaatagtagagaaaaaaaaaacccgagagaagcaaaagtcactttcgaaggtttagttacggaagccctacccaacggaatgttccgcgttcgcctagagaatgacacgatcatcctgggctatatttcaggaaagatccggtctagttctatacgaatactgatgggggatagggtcaaaattgaaataagttcgtatgattccagcaaaggtcgtataatctatagacttccccataaggattcgaagcgtaccg

SEQ ID NO: 20835 - DNA, 332 bp, Zea mays
  Clone ID: cC-zmle18900032e02a1
aactctgggggcaacgcacgggcacctacctagtatatatatatagggcggggccagcactggattacaagaagaagatcgagccacatagttacaggagaagagtggtcctctggaggtccacaaaaatatgtcgccaaggcaagggctcctttgaatctcccagccgcgacaagtggaggtaagcatcggtaccggatccttccatcgagatgatttgcaggtcgccgccaaaatacccaacgtaaagtcgggtgatcgggagcccgaaaccatacccagccatagttaccccttcagtattaaggttatttagctcaggaggattcttt

SEQ ID NO: 20836 - DNA, 584 bp, Zea mays
  Clone ID: cC-zmle18900032e02d1
cgctgatcccaccggctgatagagttggcggccgggggagtgagtcagggatggcgtcggagccggtggcgcgggcggtggcggaggaggtgggccgctggggcagcatgaagcagacgggggtgaccctgcggtacatgatggagttcggctcccgccccacccagcgaaacctgctcctctccgcgcagttcctgcacaaggagctccccatccgcttcgcacgccgcgcgctcgagctcgactcgctgcccttcggcctctccaacaagcccgccatcctcaaggtgcgggactggtacttggactcattccgggacatcagatacttccctgaagtgaggagccggaacgacgagctcgctttcacgcagatgatcaatatggtcaaggtgcggcataacaatgtggttccaaccatggccttgggagtgcagcagctgaagaaggagctgggccgctcaaggaaggttccattcgaagtcgatgagatcgacgagttccttgaccggttctacatgtcaaggaatggcattcgcatgctgatagggcagcatgtggctttgcatgaccctaaaccggag

SEQ ID NO: 20837 - DNA, 448 bp, Zea mays
  Clone ID: cC-zmle18900032e03a1
aggaaagccatacgacgcactttattgattatcaaacatgttacatcgtttaccagtctgaagaataacaccagagggttcatcgaccccaaatacagtttcctttcaagagaaagctactctgctagttcatgtgccacctgtgcgtttgtaaattggacacagcattctgggagcagtgcacggcatcctcgtgaaaaacgagaagaaaaaaaaggatatttcttcactgcctccgtctcctttcatctccggtatacgtatggctggacaagacacacatctatacagatcgcatcactggtaaacttgcacagagtaaatgattacacgtccagcttcttatgcggctacagctagaggtctttggctggtctttattcctttgatagcttcagcgtagtctggagccccaaaaactgcagaacctgcgacaatggcatttgcg

SEQ ID NO: 20838 - DNA, 560 bp, Zea mays
  Clone ID: cC-zmle18900032e03d1
cgcccccgaagcgtctcggttcgcatagcaaagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgctcaggaaggcattccatgtgagggcatcagctcgggttgacaagttctcaaagagtgacatcatcgtgtccccttcgattctgtctgcaaactttgcgaagcttggttatcaggtaaaagctgtggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatatcgttagggtccactgtgaacagacatcggccatccatttgcaccgaacagt

SEQ ID NO: 20839 - DNA, 435 bp, Zea mays
  Clone ID: cC-zmle18900032e04a1
gaataaatgatatgtacattcctattgagcccatccaatgatgaggcatgggtattttctacacatcttatagtacaagatgccatgatcgaagttcgtttctataaatacaaaggaaatgggatagcaagcgaagagaagctattccttcttggcgccctccacaggcttatcctctttgcctgctggctcctctcccttacgagcacgatcgtcttgctccttgcgctcagcgcttccaccagtcatatcgccagtactagcctcagcctcgttgctttcttcgacagctttcgcttcctttgcctcctgtgcttcgacggcttgtttgggcttctcatcctcatcaatatcttcatgatccttcggggacgcggtggccttgttctcaaccgattctgtctgctcgttctcatcgttgatgagttcttgctg

SEQ ID NO: 20840 - DNA, 582 bp, Zea mays
  Clone ID: cC-zmle18900032e04d1
cccacgcgtccggttccctttgcggaattgctcctgcctgtggcactcaagatcttccccaacatgcttcccagcacgtacgagggccagtcctccaaggacagcaaggcaaaggctcttcgggctacacgtaaggacgtcagcgacttcctgcgccaaacgttgaaggagaccggactacctgtgtcagcggagaatgcgcagacggctgaatttggcgagttcttccgaaaagtgagaaccacaggcgagaagcccagcccagaagagatcatcaaggtgtgcaagatcttcaaggacgatttgaccttggacaacttgtcccgaccacaattggtgtcgatctgccgctacatgaacatcacatcctttggcacagataacttccttcgttaccaagtccgtgtgcgcatgcgccagatcaaacgcgatgatcgatccattgcatatgaaggtgtcgagtcactctcggttcctgagctccaaacagcatgtgctagccgaggtcttcgcacgtacggtgtctctcccggccgattacgggacgaccttactagctggctcgatcttcgcttgaagcac

SEQ ID NO: 20841 - DNA, 410 bp, Zea mays
  unsure at all n locations
  Clone ID: cC-zmle18900032e05d1
ccacgcgtccgccttctgcttcgcccgtccccctccgtcgcgtcgactcccttgatggatttgctctgaggttctgcacgtcttatgatagtttctgttcttgaccttactaaggttgatcttcatgacgtggtgttcatgtccttgctttagttaggagccctgagggaatctgtttactgagaggattctcttctagtcttctcgtctggaagatcaccaactctttacaagagaattatagaatgatatgcctatgcttactcctgtcatcactatcatgtctgttggcactgagttttcatatggggtggctatggttcctgatgatggctgggaagtttatctgaacaattagtgggactggtatattgntgtagcagaaactgagagcttttctgagctgaagc

SEQ ID NO: 20842 - DNA, 415 bp, Zea mays
  Clone ID: cC-zmle18900032e06d1
cgggtcgtcccacgcgtccgagacgctggactgcagcgtcgagagcgccatgaggctgggtgtgctctagatgcatgctacacatgcatgcgctgcataggattcctgcgatgagttttgtcagagttgagttatgtctgaatataccgtatttgtgcttcgattgtaggcagagaagagttatgtctgaatataccgtattagagctgtaagatctagagatagttcgtcactttactacatcgaacggaggtatttatggaagatgtcgaggtcgtcatgtcttgttgatgccggcgctacacagagggagtagagatggtcatgatccaatgcaccatcacagagactaaggctggaaacgtgccgatccgagctcggctcgcccatttcacgagctggggagataggctcg

SEQ ID NO: 20843 - DNA, 409 bp, Zea mays
  unsure at all n locations
  Clone ID: cC-zmle18900032e09d1
tagtgactgagctgaccatgatctgagatggcatcctcaagctgctagtgacccatcttgagccgtcttcctctgcccccgagtcctaagtcttctatctcaagatgatgggagattactacagatacctagctgtgntcaagactggtgcatagtgaaaggacgccgctgagtacacgatggaggcatactaagctgcccaggacattgctctggctgagcttgctccaactcaccctattaagctaggactggcacttaacttctcagagttctactatgagattctgaactcacctgatcgcgcctgcagtcttgcaaagcaagcttttgacgtgagccatctcggaactggacaccctgagcgaggagtcctacatagacagcactttgatcatgcagctccttc

SEQ ID NO: 20844 - DNA, 174 bp, Zea mays
  Clone ID: cC-zmle18900032e11d1
gacccacgcgtcagcccacgcgtccagagagagagccagcccttttttttttattttttttttttttttttatttttttttttttaataaagtttttttttttaaaattgattttatttttttttttaataaatttacaatatttaataaattattttatgacattcgtttcag

SEQ ID NO: 20845 - DNA, 470 bp, Zea mays
  Clone ID: cC-zmle18900032f01a1
ggggtgggggttttttttttttgggtaatcatttttttttttttttttttttttttttttttaaaaaaaaaagggaaaaaatttttctgggggcccaataaaaaatgggggccaagaaagggaaccgggagcaccccaatggggggaaccacagcgcccttcaatgacccaaaaggggggccccaaacggggggaggggagatcaaaaggaaaaactctttttttttttttttgaacacccccccaacaaatttttttttgtggccccccccgggcccttttttatttttggtacacccccccccccacgcgcggaagaaaaaaaatcctatccggggggcggacaaccgtaggtgaaaacacacggtggggggggggcctcttgtgctataacccccccaaatagtagccgggggggggtatatacgggactcccgcagggggttcaaaaaaaaccgggggggggcctt

SEQ ID NO: 20846 - DNA, 373 bp, Zea mays
  Clone ID: cC-zmle18900032f01d1
gtcgatccacgcgttcggacgacttggatattgattcttgaagagatcttgcttcttttgtaccacaaagtctatgatgtggtgcaactgctgatcaagctgcggttgtagctcatgcctcaagcgctgcttgaactaccctgacctggacgaaatgttcactgccgctctagtctaccgttgtccttggtgtggccctggataagaacgccgtgccccagttttacgtggccttggcggaatccggtgaggccgcccacagctgatgctgctgcggccactgcaagtcaatccttgaactgctgatcacatctatcgattaccaaggacatattattatctattcaacttgtggtggtggttgaacaataaa

SEQ ID NO: 20847 - DNA, 434 bp, Zea mays
  Clone ID: cC-zmle18900032f02a1
ggtcctcggcggccggaccgtcctgaggcttcggcctggcggcgcgcggagggccctggacgccgtcgtcgtcgcgcgggcgtcgtctgaggcggagaccgccgaggcgggcggcggcggcggcggagcggaggaggagcggccgtacgaggagtacgaggtgacgatcgagaagccgtacgggctcaagttcaccaagggccgcgacggcggcacgtacgtggaggccatccagcccggcgccgccgccgacctgaccggccagttcgaggtgggcgacaaggtgctggccaccagctccgtcttcggggaggagatctggccggcggcggggtacggccagaccatgtactgcatccgccggaggatcgggcctctctacatgaagatggagaggaggtttgtaaagtgggacggcgcctgcgacctcaccg

SEQ ID NO: 20848 - DNA, 452 bp, Zea mays
  Clone ID: cC-zmle18900032f02d1
cggacgcgtgggcggacgcgggggcttctctttttcttttttttttttggctgaacctgaaaaaaaaatccaatccacagttctcaatacttgtctcgtgagtttgtccggtaacatattcaccttcttgatccttaacatatttggcatgtggcttacaagcacaattgcatatttcctttacatttggacagtactcatacagacatacacaatgtatctgcacggcaaatggtcaggtacgagggcaagctaagctaacaatcgcctcacttgtttccgagtcccaacaaggacttgatggcgttgatggcgttctcgttgatgaacgactcgtcgtagatcttcagcaagggctcgaactccttcgacttccttaggttcgcgagatccgggtcggtgcgaactgccttgaagtcttcataccctgacttgagcgcatcctccagcgc

SEQ ID NO: 20849 - DNA, 338 bp, Zea mays
  Clone ID: cC-zmle18900032f03a1
cttcttgggtattgggtttttttttttttttttattatatatatttatttaaaaacgaacccgggggggccaacaccggaacacaggggccggccccaggaaagcccacccacttcccccaaaaggggggcagatagcagagggggggcaaaagaaagacagggggaacccgggggaaaaaggaacgcccgggaaaaagcaggaaacagaacaaacgcaaaaaaaaaaagcaaagccgagggcaaaaaaaaaaggggcggacgcccaaaaagggggggagaccaaaaaaccgctgtcgagcgaggaaaccgcggcagacgagggaaaaaaggaaagcc

SEQ ID NO: 20850 - DNA, 152 bp, Zea mays
  Clone ID: cC-zmle18900032f03d1
gtttaaaaaaaaaataataaaaaaaaaaaataataaaaaatttaaaaaaaaaataaaataaaagggataaagggaacctaaaaaagtagggggggtcgtttttgagggggcggttttttttgggtgttggtttttcttttttggggggtctt

SEQ ID NO: 20851 - DNA, 397 bp, Zea mays
  Clone ID: cC-zmle18900032f04a1
ttttgagggaatgacagttgtcaactttattgcaaataggatctcttatatacaatggatgcagtgtctcccaaggggtgtgtcctttgggagaaaactgtccgataggggttgatcactttgtacacaatattttgtaacaaaatccaaccatggcttgcatgcatgtgtagaaattgtatatgatataattaatacaccttttcttgaatttcaatctttgcaaatcgaaaatgccttaattagccatttgtatttttaagacttatttccagcttattaatttattagaataattagatgaagtttgaatgtgagcgctatagctgcctatattatccgatatttgataatgccatgttgagcttcctaaccttggaaccgacgaccctgcgct

SEQ ID NO: 20852 - DNA, 578 bp, Zea mays
  Clone ID: cC-zmle18900032f04d1
cgcagtgaaggcacggcatcatgcatgtcggccttgaccacatcagtgtttggagtgccccagccagggtggtccacggggtattacatcattcataatgtccaacagttagtgaccgctctgacccaccagcatccggtggtgctgatgttctgggcggactggaaccacccaagcaaggacatgtactgggatctggccatcgctaaaaaggatgaggccgtattcatgccagctggactttgataagtttaaagatgtcgaggacgaagctcagagtgaaggctctgccgacggtcctcctggtcaaggagggcgaggagctatgcagggtcgtcggggcctaggtctaggagcgcaacatggcattatcagatatcggatgatgtaggcagctattgcgctcacattctaacttcatcaaagtatcctaatcaattaatatgctggaaataagtcttaaaaatacatatggctaattaatgcattgttcgtctactgagattgaaattcacgtaaaggtgtattttttatatcatatacaactactacacatgcatgcaagccatggttggatt

SEQ ID NO: 20853 - DNA, 466 bp, Zea mays
  unsure at all n locations
  Clone ID: cC-zmle18900032f05d1
agataaagaatcttgttctcctctagaacctgagagactccgttaatgaagataattttgcagctgagctttcacaatatagcgaaggccccaacgaaagaaatgaaagatatggagaaagaggacattacaagcatgaagaaaagtctctagatgaatcagagggatcactaaccattggcattattgattctgagttcatggattcaagtcgcccaatncaagataaagaatcatgtcctactggttctgcagctgaccaaagttcaaggactataccggctaaatatgaattaagttcagaagagtcagattccacaggcagncattaggagttagacagaggcaagaattatctggagttgaacaatcattctgtcacagattaggaaaggatttacaatggacatgccacgtctgtagatcaatatgttcggagaaatggggagacattagctgaccatcc

SEQ ID NO: 20854 - DNA, 210 bp, Zea mays
  Clone ID: cC-zmle18900032f06d1
cgggtcgatcccatcgcgtccgcggacgcgaggagcctgcgttatatgctaaaaaatatttaaaattttattataattaaaatataaaaaaaatttttatttagggctgacaacaaaaaaaatccaaaactataaaatcacatacttgcgacgtccatcctataatatcagggcccccaaattcatgtttccggccaactttcttcttct

SEQ ID NO: 20855 - DNA, 348 bp, Zea mays
  Clone ID: cC-zmle18900032f07d1
cgcgtccgccctcgcgtccgctgctgtctttatctggcactaagtctggagtttctagaggggggatggatgcttgatctttctaatgggttgtctgcactatagtatctttgttgttgttgttatatctgtaggaatatataaagtcagtactaggttccccctgagagttgcagagaattgtgctagccatatctgagtatataactggacttgagttattgtagcactactcgaatgttgaacagaataacctttgtgggttacttgctatatttgcatctgagtggagtaatattgagactgagattaatcgtctgtatcctggagtggaggagctcgagaccc

SEQ ID NO: 20856 - DNA, 392 bp, Zea mays
  Clone ID: cC-zmle18900032f08d1
cggacgcgtgggctggaattccacgaagctctccgagtcgaaaaggtcggctatcagaggattacttccaacggatcgaagctatcgatttcaccatcaaacaagacgacggggctctgccacagaacctctaccgagcagacatcgagcttgccggcgtttcgcgtacagggaagacgccactgtcgatatacctagctcaaaagggatacaaggaggcaaaagtcccaatcgagaagggagtggaccttccaaagtccctttttgagatcaaccaggacaaggttttaggactgacaataaacccagcgatccttcaagcgattagaaagaccagggccaagactctaggttttgaagggcgtcagagcaattacgctgagatggaccat

SEQ ID NO: 20857 - DNA, 395 bp, Zea mays
  Clone ID: cC-zmle18900032f09d1
ggaattcccgggtcgacccatcgcgtccgccctcgcgtccgcccacgcgtccgcccacgcgtccgggttcgttgtgggcatgcaatgcatgccctagtacgtgctggtccttaggtcagttatgatgtcctaggagctttctctgctgtccgccgttgatgccctgaccatctgctcatctgtctcggacaggctgcaactggatatccaggccttcgagactcaagaaccccatcctcctttggaggatggcatcgccggagacgtccagaaagtccctggcatgttcgtctagtacgggactgccatgtctgggctggtcggcaccggggactacttctgggcggccatgtacttcctggcgtccacgctcggcttcctcctggcgtacgccc

SEQ ID NO: 20858 - DNA, 265 bp, Zea mays
  unsure at all n locations
  Clone ID: cC-zmle18900032f10d1
ggtcgacccatcgcgtccgcccacgcgtncgccctcgcgtccgcccacgcgtccgagatagagtacatatttgtagtccccaaaatgcacataaagtcttgagcttgttagatgtgtgttatattggctttggctatggatgcagcaggcgtcgagaatttgtcaatttggctaagggtttggtaaaccttattcagattttgagctagaggaacgtcgnccctcgtccatatcttcatgttagtatgtacttttggaagattgc

SEQ ID NO: 20859 - DNA, 447 bp, Zea mays
  unsure at all n locations
  Clone ID: cC-zmle18900032f12d1
cggaattcccgggtcgacccatcgcgtccgcccacgcgtccgatccgaattcccaggcaggcaggtcggcgaggagggcaagaagaccgaagaccgagccgagcgggggctcgggacgggaacgggacaggaccccaaaatctcagatccttcctgcccgcccgcccgagcccgtcgacgcgtcgttcttgccggccgagccccacctncgccctctcctcctccaggggaatcggatacgccacaagctgcgcgaaggagctgagggtcttcggctacagctccctcatctggtaccccggcttcgacttcgacgacaaaatcctcggcttcatcaatggctacaagcgcacctttaatctcgctagcatagaccacagaggcacaccggagcatccggcgaggacctgcacgcttgaaaccgacgacgaggccatatgctgggga

SEQ ID NO: 20860 - DNA, 391 bp, Zea mays
  Clone ID: cC-zmle18900032g01a1
ttttttttttttttctgacgttctgtaaattttcttactgtgcttttgcaaaattagcatcatgtcataacaagatgtgcacaggctgaaaaaccggtaacatcgtaggcccagtttaacattatttatcagcacatgcttgcatatatcatctatataaatctaaggcctcggtttcatctttcctggtattttttggaccagaacatctctacctcttctgctgtccttcctgggattcttcctgctataatctcccacctgttccccacaagcctgtgcattctggaaacaagatcttcctctgcttccgtgaagtcaacaagatgctgtgcggtgctattagcttctgcaataattgtgaaaggatatagttgatcacgagagttag

SEQ ID NO: 20861 - DNA, 572 bp, Zea mays
  Clone ID: cC-zmle18900032g01d1
agctcatatgactttgttatttcaagagatctcacaccaacatattctaatcctccgtgctttattttctcttcgtcccaaaaagaatacaattctagcacagtgttatgtcatagtatcgtaaatttgattaattatagataaaaaagtaccaatatctatgataacaaataaatacgattagattattataagatgtgttttcataataaatttatttggagccataaatctaaatactattcactaaaaacgtgatcaaacatgaaccaatttaaccggcatgtaactcatagttgcattctttttgggacagagtgaatacatgaaaactaaaacagatggtaaacagtgaccatttaggatacactataactgacaaaaactgtggggacaaacaggacgccatgtgatttaccatctgaccagcctaatgaagtgcagaggatttagccccttcgaaatagggggaaattattcctaggaaaattgcaaattctcttggcgaacataggattggcaaaccataatatatttctatatgggttggttaatggtttttttttcttact

SEQ ID NO: 20862 - DNA, 348 bp, Zea mays
  Clone ID: cC-zmle18900032g02a1
gggcggggtattttctgtttctatttcttcctgccgctttccagttcacttacagtatttaaccccacacttcctgggctggctcaattacccgcgtacaatacggcccgtcggcccatccgacttacaactccacacaagcaccacacctttttttttcagctactggttcccattcggcaccatcttcaggcttcagacatcgatggcacaacctatcttcaattcagggtcgtgacatctgccccacttgaaagcttgcttgtccccaagcaggggtccaacactgtgtagagtctaaaataatgaaagtgaccaaaactctgcttggggtaactggaattttgc

SEQ ID NO: 20863 - DNA, 577 bp, Zea mays
  Clone ID: cC-zmle18900032g02d1
cccacgcgtccgatttatggcttagtatggtgacattgttgtccaaccagttgagatacaggagcagggcgatattagaaggcttcatcagctttgggtggacataatttagcagtaaatactatatcgttttcaacctttcatgattccgttgtttgggggtactatgggagggctgttctttattactcggtctagagcctgtttgggtggacagatctgaaaatcggtgttgagcagttggtgaggcagtgtccagttttccagcaaacacaaggagagcagcagtttccatgggtggttacttctttaactcattgtataggtatgcagtcttggtgttggcagtttctatgatcaaaggcagtttccaacgttaggtggctgcttggatacaacaacgggctgctgacagttctgtgatcaaagaacatttatcctgggctcaggcgctcagcgacactgcaaaattacagttacctcaagcaaagttttcgtcactttcattattctagactctacacagtgttggacccctgcttggggacaagcaagctttccagtggggcagatgtca

SEQ ID NO: 20864 - DNA, 443 bp, Zea mays
  Clone ID: cC-zmle18900032g03d1
cccacgcgtccgagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcaggtcatgtggtccgagctgaaaggccgagactcgaagacagttcgtgtgatgcgttcttaatcgactgagggctaaggaatgtgacgtactggtatatgtacattagttgaagcgga

SEQ ID NO: 20865 - DNA, 540 bp, Zea mays
  Clone ID: cC-zmle18900032g04a1
gcgcaaccaacaaccatgctagcattacggttccagagttcaaggcaaccacagacgttaagttaacatagcatcatttcgtcttggttcattcgctacagtatccactcatagtggcaacgaagacttgtaactacaggaaagacccactgcaccacataccctttccatgccaagtagatccgcgtcttcagtctccaccaacctggcgtttccaggagtcctccacaatgagctcgtctactccccagtcttcatagcttccatcaggtaagtaccgtctgatcgtgaagggtatcttgcgcgctctcagctccttcattgcaatctaaaattgtaaaaatacatatatatcattgagtacacagtataagaactaaaagtgatggtcaccattgaaaggtgattgctaagggtgaatctcattaactcaattagactacagtttatcatgccctctatttaattatataaagctatagaagtccttttctttaatgagtttaatctatagagaggtagaaagtccacatcgacatg

SEQ ID NO: 20866 - DNA, 586 bp, Zea mays
  Clone ID: cC-zmle18900032g04d1
cccacgcgtccgattttcgtctcctccccacagcagcccggcgaaaaccctagtaagcaaaccaccggagcagcggcgcttgcgcgggcggagccatggcggacgacgattacaacgaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggtgaaactgaccctcttgaggtaaatatttttttctgtatattttaaattggaactcttcagattaaaattagcctttttttcttcattctaactatctaataaaatttgaatagtcttttcagagtacacctttgctttctaaaatgaagattgacttctgaatgtcatgtgtgataaatagccatggacgtttctttttaattatgtacattggatct

SEQ ID NO: 20867 - DNA, 446 bp, Zea mays
  unsure at all n locations
  Clone ID: cC-zmle18900032g06d1
acccacgcgtccgctaatgactcctgtagagatgtatttggcctctgctgacgagttgggtgccgtacttacagcctccggagcgggagctctgttcggatgcattatcttggctttttacaccggtcctaaacagagttagatctacgccatcttgatcattggactcttacaaggcgtccttctctcttgctgcgggctctttccggacgtgttcttcatcctctctgtcgcgttctgttacatgtttttcgttccctttgagagagtgtgtcgggactctatatggctgagcaatgccccgcaagatatgcaagggtggattataggattgcaaaagatgatccagcaactggcgctaccgacagcttcggntctggcgggaccgctggcggatcatatatttgagccggcgatggcataagggggtagcctagatccgattt

SEQ ID NO: 20868 - DNA, 415 bp, Zea mays
  Clone ID: cC-zmle18900032g08d1
gacccacgcgcccgcccacgcatccagactagctctagaacgccagcgccgactcattggccaggagcacagctaagccctcaaagacgggggagcgctagtgtgcccaccacgcggcccgagcgggccaccgccaatggctttccccccgtgaaggctatgtacctgatgcagtacctcatccatggggatcggctcttttgttgggagcgagcagcagtactgcactgcatgccggcgatacaaatcccatcctctccctcctctactgcacctgcaccacagtagctagctagctatctttgctacggaggctctgtaatctggtccactagcgctccattcgaccccacccacagccatggctgccgagaccgcagcggccgtctctctgccctcctcctcctcctcccct

SEQ ID NO: 20869 - DNA, 249 bp, Zea mays
  Clone ID: cC-zmle18900032g09d1
gaacgactcggagttcttcgcgaccgtaggcgcgttcgagctcgtcccgcctctcgccattctagctatcggagtcctcactgggtatatccagctcttcccatgaccaccaagaagctgcatgctatttaactagctatctccacactgtcatatcatatgggaacatgcttttgcagttttgctctgcaatataggactgtatatatatatatatgtgcacatagcaatatttttgtatgttgggtc

SEQ ID NO: 20870 - DNA, 330 bp, Zea mays
  Clone ID: cC-zmle18900032g10d1
caggtcgacccatcgcgtccgcagacgcgtgggcgacgagcacctgtactacgacgtgctgctgtaccatactaatactagagcgctgatgctcccttgccttcttgcttagcaccagccactcccgctctttttgctcgtacgatcgactactcgatgggcgtccggccacagacggtcttcaaggtggatgagtccactccactgaaaagctcctctctttttttagggtactccctccatgccaaagctagcggacgtgtactaagtgtggttcggagcagcatgttgtattacttaccacccctctagaatagaagaacgcggtct

SEQ ID NO: 20871 - DNA, 429 bp, Zea mays
  Clone ID: cC-zmle18900032g11d1
ccctcgcgtccgcggacgcgtgggcgtgcctcatcctcgcgctgtgcatccttgccatctgggcctgcctggtcgagctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggtgctcaagaacggccgcctcgccatgttctccatgttcggattcttcgtccaggccatcgtcaccgggaatggcccgctcgagtacctcgctgaccacattgccgaccccgtcaacaacaacgcttgggcctacgccaccaacttcgtccccggcaagagagggatgcgccgcggagacctttaagagtccggatgcatgtgagcgcacgctg

SEQ ID NO: 20872 - DNA, 481 bp, Zea mays
  Clone ID: cC-zmle18900032g12d1
cggaattcccgggtcgacccatcgcgtccgcggacgcgtgggcgcttggggctctgagggtctctctcctccttgcccttgcagcctggcctggcgggcctccgttcgtgtgggtctccggcattgatgtttctgtctctgctttcgctcgtggcggcggtctggagtaggtaggcaggaggtagacacatattgctggcctctactaggagccctttctgttcgacgcactcgctatctctagctgagtggaggaggtggtgcatctaggcgtcgtccctggggtagccgtcgccgtcaacttcacccttgtgctgcaccacatccccgacgtgtccgagtgcacggcgatcctccgggaccggatcctgatgctggagaatggcctgtcgccctaagagctcacgctggaggagcaagtgtcctacacctacacggcccccttcgcgctgcggttcgcagagacgctggactactacac

SEQ ID NO: 20873 - DNA, 376 bp, Zea mays
  Clone ID: cC-zmle18900032h01a1
gtgtattattaatggctttctacaaacaatcaacaaaatgcacacagctatccagataagatatccggatatccgagaagatttatccgagaaaatatccagatattcgatatccgacgaatatcagacatattgtattcgaattcgatatccgaacaaaatattcgtattcgtatccgttatccgaaaaaagtccggatatccgaaaattccatctgaaccagtgttcaccatcttcgaatcctgatccgaacggatattttccgaaccatattacatccattatcagataaaaatatacaaggaggattgcatcgccgtacagcagatcgcttgacttaaaataaaccacttaagaaaccccagaatccagaag

SEQ ID NO: 20874 - DNA, 552 bp, Zea mays
  Clone ID: cC-zmle18900032h01d1
actttctctatcctttgcagatgatgggaaacgtgtcaaggtctgtgttcaaggctccatggggcaaggtgcatttgctggcatcccacttcaactggcaggaaccagaaaaattttggaattcatggactggggtgactatggggcgaagggcaccttcattaatattggagcagtaggtgctagagatgttgacaaagaagatgatatgtttgtcctcattgctccacaaaatgctgttggaaactgcataattgatgatatgagagctatgactgatgctgctggtgatagacctgtgattcttgtaaatcctcgcctaaaggatatgcctgcatcaagtggtgttatgcaaacaatgggaagggatattaggctgaagtatgctgcatcatttgagacatgctattcattccggcttctctactacgctggttcattctatcctattatgggagctttaaagatggcttatccaaataaatatgaaatttatcgagggttgacacttttcatggaaaaagagacctatattcttattgctggaattca

SEQ ID NO: 20875 - DNA, 425 bp, Zea mays
  Clone ID: cC-zmle18900032h02a1
tttttaggaaagccatacgacgcactttattgattatcaaacatgttacatcgtttaccagtctgaagaataacaccagagggttcatcgaccccaaatacagtttcctttcaagagagagctactctgctagttcatgtgccacctgtgcgtttgtaaattggacacagcattctgggagcagtgcacggcatcctcgtgaaaaatgagaagaaaaaaaaggatatttcttcactgcctccgtctcctttcatctccggtatacgtatagctggacaagacacacatctatacagatcgcatcactggtaaacttgcacagagtaaatgattacacgtccagctctttatgcggctacagctagaggtctttggctggtctttattcctttgatagcttcagcgtagtctggagccccaaaaac

SEQ ID NO: 20876 - DNA, 493 bp, Zea mays
  Clone ID: cC-zmle18900032h02d1
cccacgcgttcgtggacgcgtgggtgttgatgctctgcgtccagtgactgatcttccgttggatgtacatctgatgattgtggaacctgagcagcgagtccctgattttatcaaggcaggtgctgatattgctagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggccccaaaaatgcctacaaggttattgaagctggcgccaaagccattggcgcaggtactgcagtttttggggctccagac

SEQ ID NO: 20877 - DNA, 336 bp, Zea mays
  Clone ID: cC-zmle18900032h03a1
gcggttgctttcttttttttggttttttttttttttttttttaaaaaaagaagcccgggtttaggagttttttggtttcaaaacattttctggggggcccattttattttgggtcccgcaaatgccatgggatcaaccaacatggggggagacccccgtccgttcctgggccccaagactggccccaaacttggggggggggatagcaaaccggagaactttgttttttttttttttacacgccccacacaattcctttgtttgggcgcccgctcgggctcgtttttttttggtcaaccccccccccccgcttggtagacaataatcctttccctg

SEQ ID NO: 20878 - DNA, 515 bp, Zea mays
  Clone ID: cC-zmle18900032h03d1
cccacgcgtccgagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctttctgcatgtttggcgtcagtctttgtgctcatgtacgtacgtgtgtctacctgca

SEQ ID NO: 20879 - DNA, 476 bp, Zea mays
  Clone ID: cC-zmle18900032h04a1
agctataactagcaattatatttatctgaaccaaactgaccttaatgataacattcaacttatgatccttgaagatgcacactgagatgtcgcgaaacccaagtacgtacaggacatacaatttacattgttaccaatattattatgggaccaccgaccattcaacttaaagattcttgaagatgcacactcgtacatcacatgcagaatagcataagtacgtagtagctattgacaatcttattttgtggaaaccggccaatattatgagaccattcgcgaagaaactgtaaactggtagggcttggtttaaacgaacaagctgaaaacccatatcttcatcagactctttcttttttttaaccttttcttccttctttgcctcttcagcaggtgctgcgccaccgccagctacagttgctggagctcccatgtcaattgcaccacccacctgaggcacagaggataacctttcc

SEQ ID NO: 20880 - DNA, 518 bp, Zea mays
  Clone ID: cC-zmle18900032h04d1
agaactcaaagacaaggacataacagaagtgattgcagctggaagggaaaggttatcctctgtgccttcaggtggtggtgcaattgacatgggagctccagcagctgtagctggcggtggcgcagcacctgctgaagaggcaaagaaggaagaaaaggttgaagagaaggaagagtctgatgaagatatgggtttcagcttgttcgattaaaacagcactaccagtttacagtttcttcgcgaatggtctcataatattggccggtttccacaaaataagattgtcaatagctactacgtacttatgctattctgcatgtgatgtacgagtgtgcatcttcaagaatctttaaagtgaatgggccggtggtcccataataatattggtaacaatgtaaattgtatgtcctgtacgtactttggtatcgcgacatctcagtgtgcatcttcaaggatcataagttgaatgtatcattaaggtcaggttggttcagataatataattgctggttttagct

SEQ ID NO: 20881 - DNA, 253 bp, Zea mays
  Clone ID: cC-zmle18900032h05d1
agcattatggcactcgccacatgctggatttctggtaattcagatgaaggatgagttacgctgtaatggtttttctggcaacacatgtcctggatacctgaggtcagctacgatcaaccatggagggcacatcacttccactttttgaacttgccgccgccgaacatgccgagcccgtgcttgccatacttgaacttggccgggcccgtccttgaacttgccgaggaggccgagaccatgcttgtacttgccg

SEQ ID NO: 20882 - DNA, 502 bp, Zea mays
  unsure at all n locations
  Clone ID: cC-zmle18900032h07d1
cgatcttgtttcatagattctagaagagatcgagcttcttttgcaccacaaggtcgaggatgtcttgcaactgcggatcaagctgcggctgcggctcaagctgcaagagcggcaagatgtaccctgacctggaggagacgagcaccgccgcgcaagccaccgncgtcctcggcgaggccccggagaagaaagccgagcccgagttcgtcgaggccgcggcggagtccggcgaggccgcccacggctgcagctgcggaggcaactgcaagagcgacccctgcaactgctgatcacatcgatcgacgaccatggatatgattattatctatctagctagaggaggaggttgaacaataataagcgaggccgagctggctgccatacataagtattgagaggtgtgagtgagagagagagaaacagagntcttcagttagctatctctctctgcatgttaggcgtcagtctttgagctcatgtacgtacgtgtgtctacctgcat

SEQ ID NO: 20883 - DNA, 413 bp, Zea mays
  unsure at all n locations
  Clone ID: cC-zmle18900032h08d1
cggaanncccgggtcgacccatcgcgtccgaacttcagcgtacccatactatcaccgcctcattttcatcaatgggagctttcttcgtattctcgttagagtacctgtaccacaaataaaggactcaagggatcgcacttgtctctggaagctgacgtgaccaagatctgagggcactgaatgttgtgctataagccaagagttacccggcgccaattatatggaaccatgtttttgtactggcaacttagataacatttgacgaccgagaccgcactcatgggaaatttactcgagctaagaagttcgatctgcccccacttcttttttttctaggaccctttctgatcagcacttgtcagaacgtttacaggctatagcactgaaacgagatttaggaagtactacacccc

SEQ ID NO: 20884 - DNA, 351 bp, Zea mays
  Clone ID: cC-zmle18900032h09d1
ggaattcccgggtcgaccctcgcgtccgcgcacctactagatcggagtctacgtcgacgtctatgagttcggcgccgtcctcttagggatgccgcacttgttcttcctcggccgcaccggtcgcgtctggttcgtctccttgcgcgccatcggcgtcgtgattttcttgctggagtatggtcgcatcatctggttgcgtatccatgtccgcgaggtgcatgagcagccatcccgctgctctgttgagttccgcctgatgtaagagttgttagtcctgctgaatgcggatgcttaggatcgcggcgtggtcatctgcacctagtggctgccgttgggccccttgcctgtctt

SEQ ID NO: 20885 - DNA, 375 bp, Zea mays
  Clone ID: cC-zmle18900032h10d1
tccctcgcgtccgggtggctgatgatctcatgctgctgatgccttccgggccgtgagtctcggctatgctgtgcctgctgggcgcctgcaggatcctcggcaacacggacgtcggcgtgtgggtcgccggcgtcctgtaggagtctgtgcccacggtatccggcgcgtacgtgctgctgtcctacttctacgccgatatgggagtctggggcgcggaggcgtgggagcggcggtagttgcgggggatgggcgtctagtaagaagtcgggttctgctgggaggacgcgggcggagccaacgattccctgcacctgcacaagttctcgtcggacgtcacgtcgctcccgcagtgggttgtgatattccgtgtggccg

SEQ ID NO: 20886 - DNA, 365 bp, Zea mays
  Clone ID: cC-zmle18900032h11d1
ggaattcccgggtcgacccatcgcgtccggactagttctagatgcgtagtgatccttggctagcggccctttattaggggcgtcctgctcactgaggcggacttttggctgttcgtgtcttttattgggttcgatgaggtatacaatctaccgcagatcggacagcgaagcacataactctgcttaccattcgtgcttgatgtctgtcccgataacatcaacttcaggtctacgccgttctctccaagagcaacacgatgctggtgctggagtacccttacccgttctactacaccaaggacatataccagatccccggcctctgcagctccgccaacatggaacacaccaggaagcactactac

SEQ ID NO: 20887 - DNA, 451 bp, Zea mays
  Clone ID: cC-zmle18900073a01a1
aattcctctttgggttgggttaattttatatttccattactccccccccctttttccattacccacacccattttaaaaactccaaaccccacaaacccccaaacacaccacagaaaaaaaacacccacaccccaccccaaaaaacccaaccccaccaacccaacccaaacaacccccccccccccgccccccccccccccaaaaaaaaaaaacaacatcccccccccccccaaacccccacacaaatcaaacacccccccccacaaaaacccgctcgccacaaaaccaacaaaaaatggccccaaacaccaccccccacaaacacaaaaaaaaccattttcaccccacaagccccacacccccctgacccaaaaaacccctaccttgggatacccccccaaatccaccaaaacccccaaaggccccaaccaaacaaccaaaaccccccaa

SEQ ID NO: 20888 - DNA, 476 bp, Zea mays
  Clone ID: cC-zmle18900073a02a1
tttttattactattacaagggcacggaaaccgctggggccacggcaaaccagcgaaggccaagacgcctggaagcaattttttttttttacacaaggagcacaggcacggcagcttccggacgcggagaatcattggggagatgacgagctaccaccatactgccatgggtcgaactcgaccgaagtgacgtctgtctcgtcgtcgtcggtggtgctggagctgtctatggcagcccggtgctccgtgtatctgccgctgtactcacaaatttccaggtcaccccacggcgtggaggcgatcgcatccgtcatgttgaaccatcgcggagtgaactgctcgcccttggcctctcgagtccttttctcggctctctgctgctcctccagcctgctcttttttgagccagacttggacatgtcgcccttctcgagggcatatctatcgggcctcagccgggaatcagatgccaacagc

SEQ ID NO: 20889 - DNA, 393 bp, Zea mays
  Clone ID: cC-zmle18900073a03a1
cctaaacatgtctttattgttctgaatgggacagtgcactgcatcatcaatccatgcaggtgtaagagtacaggtacaggcaaccgatcctttggaggagtatcttacaagacatgtttcttcttgtttgtgatgttgaactgttcatcggacaggatgaggtcggtcagagccatggagtgttgtacagcggagtgacgacggtcttggtctgcaggtacttgtcgagcgcgtccatgcccatgtccttgccgaacccgctcatcttgtacccgccgaacggcgcgtccgggtcgaacgcgaagtaacagttgatccagatggcgccggcgcggatggaccgcgacacggtgtggcgacgtcgatgttcttggtcacgatgccggcggcagg

SEQ ID NO: 20890 - DNA, 396 bp, Zea mays
  Clone ID: cC-zmle18900073a04a1
cttaatcttccctttgggttggggttttttttctctcccaaaaaccaccacaatgggggggattaaccgtggcccctgcggggaaaccaagccaagatggtggcctcatccatcgacgggcggagtacatcccaatcgaaagccatggaagggaccacctacctttagtgtgacggggatcttgcccaccattcctgctccttgggggggctcccaaaaaaaaccgtaggtgccccccccggcgaggggaaccgacaaggcctcccctggcccgcggggggaccccccccggaaaaccttgaagggcccaaccccgctcggcaccctgttttttaaaacacaacttttggccgaaagccctaccttttctttcaaagagaagggacaccccccctt

SEQ ID NO: 20891 - DNA, 560 bp, Zea mays
  Clone ID: cC-zmle18900073a04d1
gggcctatggtctctaaccggacctaccgtgtgcacgtaccaccacgttctttgttctgtggatcatgcttggccggcggggggaggggtataactaccagccgaacggagaccgagttagccagcattatgaagggaccggcggcaagaagcagctcgtgtcctctaggctcaagaagagcagctgcaacaaagataaagccgacgccgcatatgacgactaccccaaccccacgtactgcaccaacaacaccagtggtagtaccagcgtaaccggcgctccctactgcgtcagcgtcggcgactgcggatgctgaggctgatactggaacagctctcgcttctgctgcggtgtctacggtgacagctatggcaacagctgtccctacggtaccggcggcaacgcaccatacaacaacgcttccgccggcttctgggctccccatgacggctccaggtcgccgttgtacatcaatacccaggcggtgcacatgtactgcatgccttgtgtgttcaacaacgataacagtaacgactacgacaagaggactaagagaggc

SEQ ID NO: 20892 - DNA, 437 bp, Zea mays
  Clone ID: cC-zmle18900073a05a1
acaaaaaccacacggggcatggtcagattgcatagtgaaaatgcggtgtgcgaggtccatttccttcaccagtcactcgaaagcgagagagctcatcggtaagctaacctatccacctgaatagctgatcgtcctgccacgtggtctcgagggcaacatctggcagcatcgcgcgtggcagtggtgtcagtccaccagcagtacatccctctgaagttcttccccaacaaccgctgctgtgccctattcgtcctctgcacctgcaggtgcatataccacggctgttctgctgggtgcatagaccgagaaagaacacggcctgttgtcatgcggccagtcagcagtgaagtactcagcgtcatgatcaagccgactaaatccaccgataaggcccatcgcagaatctaaaacaatcttgtactttccaggcttgaaac

SEQ ID NO: 20893 - DNA, 70 bp, Zea mays
  Clone ID: cC-zmle18900073a05d1
accgccccttcacccgctgcctcacctgatccactaacgaccactccctccacaactccttcatcaccta

SEQ ID NO: 20894 - DNA, 432 bp, Zea mays
  Clone ID: cC-zmle18900073a06a1
aacattgaaccgaccgactatggggaggggcaaaaaaataaccaccacaaaagtaccaaccaaccacaaataaagtttaagcggacacaccgcaccaactgacgataactctcggcagcaactgggccagccagcaactgcagcacactcaagactgacaacaaaccgcttagtccacctcctcgatcttggggccagggccgccgctgccggcaggggcgtcctcgtccatgccgccagcgccgcccatgtcttcacccgcgccctggtacatcttggcgatgatggggttgcagaggctctccagctccttcatcttgtcctcgaactcgtccgcctcggcgagctggttggcgtccagccagctgatggccgcgtcgatggcgtcctcgatcttcttcttgtcatcggccggcagcttggacgcaatct

SEQ ID NO: 20895 - DNA, 319 bp, Zea mays
  Clone ID: cC-zmle18900073a06d1
aaaaccaaaaaatataaaataaaaaaaaaaaaaaaaaaaaaaaaaaaatttttcttttttaaaaaaaaaaataaaccagcccgtgtaaaatttaaaaataaaacccccaacctcttttccccccccttttaaatacctatattttacctcccctttctttcttcttttatctttttttaattttaaccttaatattttctccatattccccccttttttacaaccctccatttttttaaaaaactcctttctctttcccacatttttatttcttttaatatcatctcccctttctcactattttattataaatattcta

SEQ ID NO: 20896 - DNA, 102 bp, Zea mays
  Clone ID: cC-zmle18900073a07a1
ataagggggggagggttttaaaaccatcaaatttaaacccctcccataattaaaaagctgtggcttgttcaaccccacacacttaggcggacactcgggacc

SEQ ID NO: 20897 - DNA, 466 bp, Zea mays
  Clone ID: cC-zmle18900073a08a1
gaaccataatttcatccggaacataggggagggttttgtctccgcaaaacttagcttaaacaaaagtgccacagaagcaacacatagcatctgtccataaagattaaggtaaccaactgtcttagcattgtccttatcgtaagatagaaacctatctaggacccgatcaaactgccatttcaaggacacagttgggaccttacacctcaggaggtgccaagaccggagggcgcggctcgtcctcgtccttcggggtgtggatggtcaccaggtccggaagaggagtgatcgggccaaccttgcccttcgggtcccagtcaagcatgatcttcaccttgataccgagaacaccatgtctgagaagaacgtgtctcacagccgagtcaatgtactcgttcactggctgaccagatgagatcatgtagccatccttgaacttcatggacttggctctttgggccctgag

SEQ ID NO: 20898 - DNA, 131 bp, Zea mays
  Clone ID: cC-zmle18900073a10a1
atttcttgtgcttcttgctattctttgtgtaaaatcagggtgtctgtctgggatggagcctccatggatgctcaaccttcgtcatgtaacaataatcagtgctactcttcattacataattttgatgctat

SEQ ID NO: 20899 - DNA, 335 bp, Zea mays
  Clone ID: cC-zmle18900073a10d1
ggcttcctgtatcaggcttgtatatctaccctgaattatatttttcaagccccgcccatttttgaagcgggggggtaattaccaaccagggtgttcacacgttcccagagataatggttcctctagttgtaacaccacatgaactggggcattaagtgactcttatccgccatgttgctgaaaaagtgttcgccaatgtgggcaagactatcgggtacaaagttgtaacaatgatttgacatccccagtgcatctctgttggttgattaaatatcggaccatgcttaattcttcttcttcggaacaaacaacctgactcagattacctttgggtt

SEQ ID NO: 20900 - DNA, 449 bp, Zea mays
  Clone ID: cC-zmle18900073a11a1
cgagagtgcacccgtacgtagggtttatagagaggcacaacggatatcaagttgttaccatcaaatcgacatcttaatgagcattttatcatcatcattacgcatataatttcccttatacatatatatgaagagctttcaaatcacctacctctttttcactatctggcccaatattattatttcctatatatatactcctcaactacaagagaacaactgcgctgcattcacgtcacaaaaagccaaggcaaagttgccattgtccgtcctttaggctcctccgctctaccaacaaaacgtcgccgtcgcctccaaaacaaacgatggcgaagcaacaagcctcctttcctcctggccctaccaccgccttctctctagctagcttgtagagctagctaataatagcaccggtacccctctatgggctgctgctgctggtggttcca

SEQ ID NO: 20901 - DNA, 587 bp, Zea mays
  Clone ID: cC-zmle18900073a11d1
ccgcgcacgcgtactcggacgcgtgggctcctctacagcccgcacctagttttctctcccgactccgatatgacggggcgggcctttaaggccgtaatccgtggcaaacatcgaaccaggtatggtgctagcttgcgtaagcaaatcaagaagatggaggtatttcatcactccaagtatttttgtgagttctgtgggaagtttgctgtgaacaggaaagtggttgggatttgtggatgcaaggactgtgggaaggtcaaggcctgtggtgcttacaccatgaacactgttagtgcggtcactgtcatgagcaccatccgtcccttgagggagcatactgaagcatgatcggtcgtttgtaagcatactgtggtccactatattggctgtgtagcctgtacagttctccagcatttttgggttatgctctaagatctttaaaggttgggtgcttaatattctacttgtttaccgttgtaaattcacaagttatatctgatcctattactattctgatgacctcaacattgcttctgggtttcaccctttggttggaaaaaaaaaaaaaaagggcggtctctttttta

SEQ ID NO: 20902 - DNA, 348 bp, Zea mays
  Clone ID: cC-zmle18900073a12a1
ggaacaaaaaacagggcataaacttatttgcccccaaccccaaaaaaaagtttccaaattaaaaaaacaaacttgcttaatttcaaaaaacttttttgccctggggggcatttttaaacatcacctttaaaccccactgaaaacctaatttgggcaaccaaaacattcagtttttttttaggagggccaaaatgtaaacttttttgacccaaatttgttccatttgtttacaaaaaaggggaaaaaatgggaaaaaaaaaaaccacttttttgcgctttgttagaaaccaccgaacgagccctttccctaccaaaaagtccaaattgggcacaggaactttttgtttt

SEQ ID NO: 20903 - DNA, 226 bp, Zea mays
  Clone ID: cC-zmle18900073b01a1
tttttttttttttttcttgacaaaaacaacaccaaggggtgggggttcattttcaaacccacaaacacaacccccaacggcagaaaccaacaacaaaccgacgtagtctgaaccaaggataaggacggcacgacctagcaatgcaacaacccacaacacaataacaagcgctttccccccaaataacttgaataccattcacctataccaacccaactacctggcc

SEQ ID NO: 20904 - DNA, 554 bp, Zea mays
  Clone ID: cC-zmle18900073b01d1
cttttaaggacccggtcaggaagggtaaccacatcctgtgatgtgtgtttgctcacgcccaaggctagccggggccaggggcaagatgtacagcgccgcaaggttttcagccaccccgacgtccagctgaggtgccgtggtacggtattgagcaggagtacaccctccttcagaaggacgtgagctggccccttggctggcctgttggtggataccctggtccccatggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgttcgttgggatctctgccggcgacgagatatgggtcgcccgctacattcttcgagaggatcaccgagatggccggaatcgtcctctccctcgacccgaagccgatcaagggcgactggaacggcgccggcgcccacaccaactacagcaccaattctattagggaggccggtggata

SEQ ID NO: 20905 - DNA, 620 bp, Zea mays
  Clone ID: cC-zmle18900073b02d1
tattgaccgtggcctcagggagagtcgagctgttgacatgttgtccttttgtgtcgttgctgggaagcatgtcgggtctgggcgtgtgtaccttcacatcttggataacggagggaatctcattgatgcagctaatatcgctgcattggcagctttatctactttccggaggcctgaatgcacggttggtggggacgatggtcagcaagttacagtgcatgatcctgaggttagggatccacttcctcttacgatacaccatatgcccatagctgtaacatttgcatatcttggtgaaggtaacatcgtggttcttgatcccacatacaaggaagaagcagtaatgggagggaggatgactgctatagttaactcacatggggatgtttgtgccattcagaaagctggtggagagggtgtcatgtcaagtgttatcatgcagtgtttaagaattgcttccgtaaaggctgctgatataacaagcaaaataaagaaagccgtagactcatacaccaccgagaaagccctatagaaagtaaaacgtttgccaacctcggttcctcagaaaataatgtcactaatgtaactatggacggcataggtgatggtgaattgaaaaa

SEQ ID NO: 20906 - DNA, 398 bp, Zea mays
  Clone ID: cC-zmle18900073b03a1
atgacgggagcgaccccaagggacagggtttattttgtaatccaacaaacagaacctacgggcgcataagcccatgataaacccagctgctctgacgcatacataaggacggcaagaaccggcaacgaaaaaactcacggaataatgacaagctcacgcccaccaccaccgatggataccaaggacacataccaaccgaactacgtggccaaaaattccagccatgcaggcgaaagcatccaaggcccaagaaacaagaccatccaaaatcctgccgcaaggtgcgctccgtacaacaaccctatctggtcacaagaccgggcacacatccgttcggtaacccaaaaagacgctagcccaaggtgcataccgtgtgggcaaaggcctcacgcaggggg

SEQ ID NO: 20907 - DNA, 518 bp, Zea mays
  unsure at all n locations
  Clone ID: cC-zmle18900073b03d1
cagagcctttcatagtcattttcacactcccnngctgctatgatcctaattctgaactcagcgcacccattgactagggctatgttccaatattttttaatccttaaccccccacctcctaattgttgtactgaaaacctttccttctttgggactatactgacattctccagtttcggttcaacaaacaacagtaaatgtgcacattgcattaccgatctgaattattactcaaaatctcggatgatcacactttcaaaatcaataaatgcataaacataagttactttacatttactccaattaactataaatggattctttctgatctatattccaaacttattaaacattacaccagctttgaagtattgcccatcttcattgttatacacttctcttcatatgtatcacataaatgactgaaactatttgtactgacttctcttctaatattatgaacaccctctaaaaacactttgcccacactctgttctctctttttcaactttttacca

SEQ ID NO: 20908 - DNA, 231 bp, Zea mays
  Clone ID: cC-zmle18900073b04a1
catggcacaaacgacccaacggggtggggttttttttgcaatacaacaaacaaaaaatttacgggtatcatccaaacataaagtccgttaatttggaccatggaaaccaagggcacgacccaacagagcaactacccacaagtgaatgacaagcttttacaccacacctcctgtgaaaataaaggcgtgtaacaaaccgaaagaccataccaaaaaaaaaaaaaactattt

SEQ ID NO: 20909 - DNA, 226 bp, Zea mays
  Clone ID: cC-zmle18900073b05a1
tttttttttttttttttaaaccaaaacaaccccaaggggcgggggttcatttgcaattacacaaacagcacctccaatcgcagaaacacaccataaacccccctagtccaaaccatggaaaccaagggcacgaccaatcactgtaatcaaccacaaaataaccaccagctcaatcacacctaataatttgaaaaacaaggagctaaactaacccatctaccttgcc

SEQ ID NO: 20910 - DNA, 446 bp, Zea mays
  Clone ID: cC-zmle18900073b06a1
atataaacacacgtaaattcacattattcaaaacatttcttgattcaaaaaaaaagagataaattttaaaaaaaagatttttgcccacccccacccttattgaaggcctgatttgatcttgatacaaaaaccccggggaccaacacagttcctacgtccgggcaaatattggtagcttaaagccttaaatcaaggcctgcccggcacacattatacaaaaaccaggctgggagaacagatgaaacaccaacccccacaatgtgctgctgtttcggctgaggcagcctgcgacggatcaattgtgggcgtgctttttggcgtccttcttttcgggatgctcggggaaggggaacccggcggagcccacgggggggacgggggccaccttctttttgacccggggggcgggcttgttcttcggggcctttttggccttgtgctttttg

SEQ ID NO: 20911 - DNA, 382 bp, Zea mays
  Clone ID: cC-zmle18900073b06d1
gcgtgggaatgattaataaatagcccttaataaaagacaacctatacatttaccgctatgacactgatatcacggggagcgggtgcaacaaaaacaaccagagaatacgcacctatcatcagcaattgattagaaaacatgacatcatacacctttatgacagacctaaaaatatccatacctgatcaaatattatatctaaccggtaaacagactcatcataggacagatacaaatccattctagcatgaacctcatgcattactaactgtctctcccaatatatgagcaaaaacaagacgtaataaaaaaggatcgactcagaaagtgccgatcgttataggatctacacattgacgagcacttgccatccactgcatat

SEQ ID NO: 20912 - DNA, 259 bp, Zea mays
  Clone ID: cC-zmle18900073b07a1
accaaaacaaccaaaaaggggattgggtttcttacaattaaccaaaaataacccctggcggcagaaacccaaaacaacgacccctactccaacccatttaaaacatgggtaagcctaaaccgcagatgaactcacaaaatacagccgagcccgagcgccctttctaccaaaaacacacaggggctacaacaaaccctacacgaacgaaaaaataccctctggaccagggaaaacatcccaagcccaaacaaaataacta

SEQ ID NO: 20913 - DNA, 487 bp, Zea mays
  Clone ID: cC-zmle18900073b07d1
cccacgcgtccgtgattcttgaagagatcgagcttcttttgcatttctttgtcgaggatgtcttgcaactgcggggggggcttcttctgcggctcaagctgcaagtgccgcaagaagtaccctgacctggaggagacgagcaccgtcgcgcaagccaccgtcgtcctcggcgtggcccccgagaagaaggccgcccccgaattcgtcaaggccccggcggagtccggtaaggccgcccacggctgcagctgcggtggcaactgcaagtgcgacccctgcaactgctgatcacattcatcgacgaccatggatatgattattatctatctagctcgtggtggtggttgaacaataataagccaggccgagctggctgccatacataggtattgtgtggtgtgtgttacaaagaaagaaacatagttcttcaatttgctatctctctctgcatgtttggcgtcagcctttgtgctcatgtacgtacgtg

SEQ ID NO: 20914 - DNA, 230 bp, Zea mays
  Clone ID: cC-zmle18900073b08a1
accaaaacaaccacaaagggggggggttcattttcaataacccaaacaaacccaccacccgcagaaacacacaaaatccacccttcatccaaactatttaaaacatgggcatgaccaagccctgccatcaaccacaaaataaccccgtgcttgagcacacccaacaacatataacaacatggtgctacaacaatcactccacctatcgaaaaaaaaccttttataacagg

SEQ ID NO: 20915 - DNA, 473 bp, Zea mays
  unsure at all n locations
  Clone ID: cC-zmle18900073b08d1
ccggcagggcgtccctggtctgtgaccggccataaaatcctatctttttcgagaaatggcggcggcagcggggcngggggttatcctccaccgcatccgcctctccccctccccttcgctcgccctcgccgacgctgggacaggtgcatcccacccgcacgcgctggggcggtggctcgcgcggaccatgtcctcccacgacgcgcacctcacccgcgacgaagtcatcgaccggatcctcgacgtcatcaagagccaccccaagatcgacccctccaaggtgaccccggaggcgcacttcgagaaggatctcgggctcgacagcctgtacaccgtcgaggtgggcatggccatctaggaggacttcaagctccacatcccagacatggaggctgacaagaacgactcactccctctggccattgagaacgtcgccaaccaccccatggttggctgagcctctgcttccccca

SEQ ID NO: 20916 - DNA, 359 bp, Zea mays
  Clone ID: cC-zmle18900073b09a1
acctaaataaccaatatgggggggggttatttttttataaccataaaattccatcccctttcatatttaacaaactgcggcttattcaacactccatttaaaagctggtttgataaattcattaccttcacgaacaaaatagcgccctttcttaccagccttaacacaaggttctaaatccacccgattagatcctgccccaggggcatttacacaaggatggcctgaagttccatccccagattgtaatacggaattatttccaaaaattccgcggcgaccgggcatataccaaacatgaacacccccaaaagcacaaggactaacacccagcttgggaaacccctcctaactgaaaa

SEQ ID NO: 20917 - DNA, 347 bp, Zea mays
  Clone ID: cC-zmle18900073b09d1
ccgcggacgcgtgtgaaaaaagaaaaaaaacaacaataaaaaaaatatataaattataaaaagcttaaaaaaataatcagggagggggattttataaaacaaaagattaaaacaatgcctctcttgtatgattaccttttatttaactatccttgcgcttttttaatatgttctatatggaaaaacccttccttatgccagctttactataataatgattccattgttggtaaatacgaagatttattagattctttgacatgcaacgattacctattataatgatcagttattataatagggatttgcaatcttgttcatttttagactcttttctcatttttttt

SEQ ID NO: 20918 - DNA, 524 bp, Zea mays
  Clone ID: cC-zmle18900073b10a1
ttttcatttgctttcatttatgaaatgtgataatcctggaggcgtacaataagcattggttgccaagttaatgactccacaattacaataaaaaaatattcaacaagaaagcaaaagtggctccgtacaacataatagtacgaacaggtaaccaaaaaatgacagtgaagccatttataaataaagaaaatagtttttcataactgactcatcgatgatagcgtagttaacttcaaggggctcacatgggccaagcagtgccagattacaggtcaactatcttcacaagcttaggatagattatgcgagtgtcccttgcagaattgctctcaacaagagcaacttgaaccaagtccttcacgtccctgcttgataaaaacttgcccaagttgtgaagaatacattttaaatcatccatcttgagatatcctgctctatttatgtcaaagtacctaaaggcctgcaacaggtccttgtcgaccacctcatcttttgctggcttaaacctcttactaactaccttt

SEQ ID NO: 20919 - DNA, 372 bp, Zea mays
  Clone ID: cC-zmle18900073b10d1
ttttatgttatcacaaacaatgcttccatatagagatgggtgtgcatgtacaaaatcacaagaaaaacgaatacatctactttatagcaagagagattattgagtccacggtgaatgaagcatgcaataaattacatgatgattggggagattaagctattacaagattgatgttgtgacgctagcagctaacgtagcatctatgcagcagcctcactttacaactacaaatcacacaggagcatggggtccttgagcagactggcctcactcatttcacctcgaggatctcttccaaggcggaattgttggtaaacaccccggcgtaattcaaccttgtgaaccgcaccaccaccgggtaacgggtgttag

SEQ ID NO: 20920 - DNA, 469 bp, Zea mays
  Clone ID: cC-zmle18900073b11d1
cgtccgggagacttattaccaagatatcgagtccttgctatcaacatattatattattattgtcaaagtgcaaggagatggcagggtggatgctgtctttgctaacatcgacgagctgctgggttctatcctggagaagaaaaatgaaatggtgtccagcacatgagcaaggaacttctccaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatttgctgctgaacatgtttttgttgctgtcttgtgaacatacatgtcttgttggttctcaactggaggaatgggggtaacctgctgtttcatttccttgaaaaaaaatactt

SEQ ID NO: 20921 - DNA, 285 bp, Zea mays
  Clone ID: cC-zmle18900073b12a1
aaatataaaaaaaaaaaaaaaataaaacaaaaaataaacaaaaaaaaaacaaacaaaaaaaaaaaaaactaaacccaaaaaaaaaacaaaaaaaaaaaaaagaaaaaaaaaaaaaaccaaaacctaaaaaaaaaaaaataaaaaaaaaaaaacataaataaacaacaaaaaaataaaaaatattaaaaaaaaaaaaaggggaggagaaaaaaaaataaaaatccaaaaaaatacattaatcaaaaaaaacaaaaaattaaaaaaaaaaaaaattaaatatacccc

SEQ ID NO: 20922 - DNA, 64 bp, Zea mays
  Clone ID: cC-zmle18900073b12d1
tccgcccacgcgtactctgacgcgtggataacattcccacccagtatttccttttccctacaac

SEQ ID NO: 20923 - DNA, 359 bp, Zea mays
  Clone ID: cC-zmle18900073c01a1
acgaaatcttttgaggggggtcggggttaaaattttttaccaatgccatatacaaaaagttccgttaataatataaataattgtacatttgtacccataaaattatgcattccactatggataccaaaagagcacatatttttcttctttttgatctccacatgttttttcagtatcaggactgatcatatatgtatatagggttataatactaccatggaagttggtatctggatgcttgcatcaatggattagccaattatgcccacccgtccaaggacccgggggtctacccctgaatttcggacccgtacctgcaagcatacctatttttcctataaagagtcttattccaggtt

SEQ ID NO: 20924 - DNA, 597 bp, Zea mays
  Clone ID: cC-zmle18900073c01d1
gcagccgcatccacaagcctgcctctctcgtcccctggcggcgatcgcggtttgatggcggaatctacggcgaggacggggaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggcgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaaaggtggacgcctcatcaccaaccagggaaggcgtgatctggaccaagtggctggaagggtcgctgttgaagcgtgagcagcgtcatctttggtttcaatggtgtcatgtttgatggttgaaaaagctgcgctctatttgctcttttgggttaagattttcgagttcagaggactttaaggt

SEQ ID NO: 20925 - DNA, 155 bp, Zea mays
  Clone ID: cC-zmle18900073c02a1
gaacaaaaacaacccaaagggagaggggtttttttgtactaccacaaacacaaacactggccgcagaaaaccatgataaaaacagttggtccgaccccatcaaaacatggtcaccctcaagcatccccagaactcacagaataatgttcaactca

SEQ ID NO: 20926 - DNA, 211 bp, Zea mays
  Clone ID: cC-zmle18900073c03a1
aacaaaaacaacccaaaggggcaggggttgttttgtaatcccacacacagaaccaatgggggcggaaacccatgataaaaccactttatctgacccaaggaaaacaagggaaggaccaagcaatccaataactcacagaataatgcggagctcacgcaccgcaacgactatgaataccaagctcctatgttaacccaaagagcaggtaaaa

SEQ ID NO: 20927 - DNA, 584 bp, Zea mays
  unsure at all n locations
  Clone ID: cC-zmle18900073c03d1
cgttcgttagaagtacatctgcatctgcaagagaaggctgtgggggttttgatgatggagagccacccgctnggggccgggacagacacagatccggcccccggacctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgcctttaccgctggttacatcgagcaagtcctcccaggggccattggcagttctcttggccttctctcttggggaaaggacattgaaccaccatggggccgcaaggaattcttgaagttcattatttcgatcaactccatctgtggcattctttgcattttgctttgctattggactctactacgtcactggaaaggagagctttcttgtcacaccactttttggtttccacggatgccctgctagctatcttgtggccctgaagcaactcttaccaaaccttgaccttcctatgtgctttttct

SEQ ID NO: 20928 - DNA, 149 bp, Zea mays
  unsure at all n locations
  Clone ID: cC-zmle18900073c04a1
aaacccaaacaacaacaagggttttggttacattttcttttacaaaaacacacctcctactctcacaaattcataatctaaacccctcgtccgttttttgtttatnatggngaggattaatccttttactctctacctaataataccca

SEQ ID NO: 20929 - DNA, 124 bp, Zea mays
  Clone ID: cC-zmle18900073c04d1
ttacctttccgacaagcctttcatcacctttttggaagcacacatcatttccggcggggccgtgttaattttttaatacgggaaggaccccttctctactggactcatgatcatttttgccacc

SEQ ID NO: 20930 - DNA, 393 bp, Zea mays
  Clone ID: cC-zmle18900073c05a1
aacaaccccaagaacaaaaacggggagggagaaaattgctattacaccatctgggataaccgtttggataggtccacacatagccccttataaggtagtccatatatgtatagtacaaacattttgtatttttgtaaacactagaaaaggcgcctactggactatcaataattcactacgttttttcaagccatgactgactatgggctttggcatatcaataataccatcgcattacattaccatgcgaggcaaaagttacattacatggggcaagctcacgcatcatcgtctccttgaacattgttgacacgctaacactaatcaatccattcactatatatatcaataggctcactgagggccttaacagttgcgctgtagatttcctga

SEQ ID NO: 20931 - DNA, 284 bp, Zea mays
  Clone ID: cC-zmle18900073c06a1
ctcctatttattttttttattttttttacccgcccacccaaaacggggaggggggccatttctttcataaaacaaaacaaacccaaagtcggaccggggaaacaactaccatcgacccccaaacctagctgatggaagcatgggaacgctggaaccccggaggaaacacagcctaaccactgccacagagcgaccctgcaaacaaaaggacagttgggacccaaccaccaccacacgaaagaatataaacccttgggacaagggaaagcaccagcgaagataaa

SEQ ID NO: 20932 - DNA, 439 bp, Zea mays
  Clone ID: cC-zmle18900073c07d1
ggcgggcgatcatatgggcggtgttgtgcctacaatacaggtttaactatatgcaaccagaatataatctggggggggggatatttatagatacaatcgtttttccctcattcaacgctgaaagcggcttttgtttggaggctgagctttggatcaattggatgacactatgcagcttttggtacctggagtaccgttcattagctttttatcaagtcccgttcatttcttgtgcacattgctggagattgggagatcgacatcaagactgtacgcatcttaaacccgatcagtctattctttgccgtattaaaataagcagtagcaggtacacctgggttgggtgtgtgcctgtgctctctgccaggagggggttctttgaagtttgaagttcatgtgatttgtgttttaatgcatttcgttttcatggacgggttgt

SEQ ID NO: 20933 - DNA, 538 bp, Zea mays
  Clone ID: cC-zmle18900073c08a1
acttaaatatccattatggggccggggtttttttttaaacaccttccctaaaaaaccaaaggtcttaaaaccgaaaaaacaaacacccaaaaaattaaaacacccgcctcaaattttaataaacccatttaaataaaaaaaaatattgaacgcccccatgaaaaccctgtaacagaaaaatttcccaaaaaactcaataaaaaaacccccacaaatatatttgcatttaaacctcctgccaaaaaacctgggcaaataaaaatctcaaaaaccccaacccccactaaaaagggaattaagggggtttgtgttccccctggaactaaaagaacacatatttcttttggcctggcaaaccccccaaaaattattcacgcccccctatttagtgatcccctttttccaagggaaagttaaattaccaaaccttggaaaaatattacggccccaccccaacaaaatcttggacaaataaaatctaactttgaaacccatttcttagcaaacccccctttaaccactcccaaaaatacctcaa

SEQ ID NO: 20934 - DNA, 216 bp, Zea mays
  Clone ID: cC-zmle18900073c09a1
aacaaaaacaaacaaaaaggggatggggacatttgcaataacccaaacagacccaccaaccgcaaaaacccacaataaaaacattcacaccaacccaaacaaaacaggggcaagcacaagcaaaaccaaaactcacaaaacaaagcacagctcacgcacaccaaatacgacgaaaaaacaccaactaaaacaacccctacaggggggaaaacacac

SEQ ID NO: 20935 - DNA, 530 bp, Zea mays
  Clone ID: cC-zmle18900073c09d1
cgcgttaatccctaacagaacccagtaaaatattgctaacccttttttttacaaggacccacgacgcctgctggggggcgccttctttgccctatccaccaacgtcgccggaatcaacctccggctttgccagaaattcaaacccagatgccgatcctcataaacacgacacgcttcgggcatacgcactcaagtgcaaattctacaacgcgctagatcacaacaacgacgcgcatccgctaagacacttagttagcatgtacggacacaactactaaaacgctggaatcgtacacaagcgattcaagaactaataaaagagtctgcagcttgacagctacacctatccgaaagggctgtacaaaactctatgcattaaccgaatactggacattaactgttatgaacatactaccaatcagataatgtcagcctacaaatgcttctgcacgcttaacgatgaccaacgtatgcacaccttcgcctttgcgcatgcatagactaaaaaaattagggaagatgacattttg

SEQ ID NO: 20936 - DNA, 453 bp, Zea mays
  Clone ID: cC-zmle18900073c10d1
cacgcattcgtccacgcgtccgttagaaaagagaccacatgttcttttataggctgttggacgaagcaaaggtcggggttacctaaggttcttattgccattgcattgagcctgaatggttcaagttttgcttcacaacaatgaatgaagaagacatttcctgtcttggtggaaagactgaggagggtcacatatagcttcaaatccaaacgttgaaacgctataatactatattttttggaacccctgcggtatcgaaataaccatatctcaccatgtgctctatattgcattgcagggggcactcacgaaaaggttggacaatctatttattttagaccatagatattcacgggcttcttgctatacagctgcataacaattgctggaagcccctatgctggtggaaggataagtgggggaatttgggacttgtccattactccatgctgg

SEQ ID NO: 20937 - DNA, 519 bp, Zea mays
  Clone ID: cC-zmle18900073c12a1
caaaaaaattcattttattttgggggaggggttatttaatatgccaacaagatatccaacacacatggagtactccggcagtaagaatagcaactctacaatcggtggcggtacgcgcgccgcatttcgtgttctgccaaaaaagacgccacataaaaggaacatgaaaatgcagttagaccacatgcacatttcgatacactccatctgaataatttacagagctacaaatggtgaaaatcaagcttttgctggccatgtcgcttgagatgacataatgatgcccacaatgacaccgaacagtcccagagcgctgccgaagatctcaatcaccaaaatctttacgaagagtgatgagttctgagcatcagacagtgcgcagctgcttccaattatccccacgcataccccgcaaacaagattagcaaagccaacgataaggccagatgcaaagattgcatagccagctcgaagagactccggatcatacatttgagatgttggcacactttcaagctt

SEQ ID NO: 20938 - DNA, 480 bp, Zea mays
  Clone ID: cC-zmle18900073d01a1
ttttttttttttttttttttttttttttttttttagggagatggtttttttttttttttttttttgggcaactccaaccttccataatcaaaaaatctacccctccttaaaggtctgacacaaggggacccgaaaaaggaaaaaattcacgcccttgtcatgaagaaaaacctccaaaaaaacaacttgggatgggaatatttggtttttttgaaaaaaacccaaagctctccccaaacttggccccacaaagctgttggctcgaagcctccccaggaaaaccctaaaaggcttaagctggtggaaacaaaaaggcttttactttaaaaattggggggaccccacaaaaattgttttttcctcacacgggtccaaaaattggaaaggcccccataaaattttattcaccctcattattgcccccccctttcaaattcccccacaaattgggggcccagaataaggggacaagctttttgt

SEQ ID NO: 20939 - DNA, 588 bp, Zea mays
  unsure at all n locations
  Clone ID: cC-zmle18900073d01d1
aagactatacttatgataataactgacacccacacaaatttaatctttaaaaatatctctgcatgtaacgtaggaaaggtgttanataaagtaagacgaaccttctcctctctttctcacactatgtctagctgagtgacttatcttaaaaatctacgtctcttctatgacgtcgcttctatcatctcccatggcggcttcttcttcttctggcagacggagatacgacgtttttccaagcttcagtggggatgatgttcgcaagacgttcctcagccatcttctcaaggctctcgacggcaaatcaatcaatacattcatctatcatggaatccatagaagccccacaatcgcccctgagcttatatcggccactagagaagctatgatctcaatcgtcatcttctctaagaactatgcttcttcaacgtggtgcttaaatgaatttgggtgaaatccacaagggcttttaatgatttacgccaaatggtgattccagctttcactacctttatccttcgaagttaaaaaacagaccggccaatttggaagggtctttaaaagacatgcaggtcaacaaggacaaac

SEQ ID NO: 20940 - DNA, 526 bp, Zea mays
  unsure at all n locations
  Clone ID: cC-zmle18900073d02d1
tacaaacatgagtgcttttgctgcccttggaaatgggggtgtcgttttttatatgggtctcccttctattgccgggcagtggttccatttgggcaacatttcaagccttgggtcatggaactttagccgtggagctggagttaataacttaagcttaccttctggctcctatgggaggagcaattcaactggtacaattggtgaacctttttctgcatcaggcaatgcatatgaagtgaacaacccagatacatatgggaacaactctatttatggtggaacatcctggaggttcccttcatctgaagttgacgtgccttctttcagtcatgatcttggaaatgttgatccgaatatgaaatcagacatatcaccaaattacatgggaaattattctgttagcaacaatcagccaagcagaggtatcacttcatagtgggagtattactacacattcatatatgacttgngatagatgaagcacccattcagtcaggcagccacgtgcgtgcatggcactttgaat

SEQ ID NO: 20941 - DNA, 229 bp, Zea mays
  Clone ID: cC-zmle18900073d03a1
gacataaacaacccaaaggggggggggtttattttctatgacacaaacaacacacccactgggatcatcacatgacaaaaacaccctgtttgaaccatgtaaaacaaagcaacgaccacgcacagaaataacccacaagtcagaaacatgctcaatccccccaccgaatctgaatacgctacacctattctaaaccaacgagcatgtcaaaaaaacccatcacgctggg

SEQ ID NO: 20942 - DNA, 549 bp, Zea mays
  Clone ID: cC-zmle18900073d03d1
tcagtgtgtctgctgcaacacccctctgtttcagtcatctatcatttttgatagtggtactgggtggccattgtattgtggaccaattggtgaaaatgtcaagagcaagctcgatatgtcaatcattttttatgccccggaccgaggtgctctgtgcaccctgtgatgctcatctggtgcatgtcttcgatgacgggccaccaccaacagggaagagatactgtatcaacagtgcatctctgaaattgaagccccaatagttgctggatactttagcaagaagtcaactataacgctggtccgccctatgtaaacttcgggtttctgtatataaactactcaagttgtagcatatatattattctctttgttatgtaatatatatgcgtccacaaaccgatgaaacaagcagccgttacttcactctggtattctggtctagaactaaggtatctgttggttgacgaattgtaacgcaaatgacaacggtaatggcttgcacttgagtgacagttgacaatggtaataaatttaaatagaatttttatt

SEQ ID NO: 20943 - DNA, 472 bp, Zea mays
  Clone ID: cC-zmle18900073d04a1
agacaaaaacaacagcaatgggcattcttagatatgctataacacaaacagtgctttgattctcagaattacacaatataaaattattgtctgaattatgtaaacgatagcgacgacaaatccctttcatcaactacaaaagaaccacctgcttcatgacaacaaagaatttataaaagctgctgctgaattaatctctcttccttctcaaaaaagagctatatctatggggcctaggcaggacccaatcatactttctttttcactccagtgccgaagtgatggcacatctacttggccttgccatttgcggcggcaggggtcgacgggttcagctcatcccaggcctcgatccaggtgaccatggcgtcaccgagcttgacaaagtaggggtcaatcgtgcccagcttttccttcacttgtccagagaggtagatgtagcactttggacggtgtcgcaatccttggggat

SEQ ID NO: 20944 - DNA, 319 bp, Zea mays
  Clone ID: cC-zmle18900073d05d1
gccgagcttgctgcaactgctgcacaacctcttcctgatgacgatgtttatctttttgagtagaaaggatcatgactgtgtgactggagcaggatttgtgccttgcacgatttaagttgttctagggtggactctctcttgagttatcattgtctggatcaatcttttctccctggacttgttgcaacttttgagtgtggaaatggattggaatagtcgccatgaatttgctggctactttatacatgtctttgttcataaaccttgttttaagatgaagttgtggcctacaataaacttctacttatctatatatatg

SEQ ID NO: 20945 - DNA, 205 bp, Zea mays
  Clone ID: cC-zmle18900073d06d1
aaacaaggataaatcaaccataacactcataacctttacgattttattcaaacggacatacgcacatggaggcggggaactccaaaaataggaatttcacactaacctccactacctgtaaaccctatctcgcataaaccatatcatattatccacaatacaacattacactaacacacttcccatgcttagtctctatatatct

SEQ ID NO: 20946 - DNA, 237 bp, Zea mays
  Clone ID: cC-zmle18900073d09a1
aacttaaacaaccaaaaaggggacgggttcattttcaataacccacacaaccccaccgttggtacaaacccaaaacaaaacaatccagactgacccacacaaaaaagcgtcaggaccactcacaacacacaatcacaaaacaatccacagcacacaccctccaaacacggcggaaaaaaaccgactacaacaaccccaccacctaggaaaacacaccgatcaagaccgcgccagcct

SEQ ID NO: 20947 - DNA, 276 bp, Zea mays
  Clone ID: cC-zmle18900073d10a1
ctatctaactgttttttatgggcgtggggttatttttttttgttacaagcataaccaaaaaagtttttttaagtccccagcttattgcacaaaaaccaacagaaaccgggggcgtgcccacgccatacccaaagaccgagaccccggccaaccaggccaccccaaacaatcattagggacccccgccggcccaaacgggccgggaagccgcacaccccgcagattaattgaccctggggagggaactttccctgcgatcgtggaccatcccggggc

SEQ ID NO: 20948 - DNA, 255 bp, Zea mays
  Clone ID: cC-zmle18900073d11a1
caacggagaccatggggtggggaaaccgggaaaaaaaagagccggtcatttttccctgatataacttaatccgggattgtaggcaatggggcaagaagacttgtccaagaaatctgatataccttcagcggaatgaccgcatagcctaactgaaagcagcttcacccttggcccgacgccatcatgtttcatcactcaagagaacaaagcgatccgtttgatctacttgccaccggcttattcgcggacgcgtgg

SEQ ID NO: 20949 - DNA, 515 bp, Zea mays
  Clone ID: cC-zmle18900073d12a1
tttttttttttttttttttttttttttttttttttttggtgttggtttttttttttttttttttttttttttttttttttttttttttttttttttttttaaaccaagggaaaaaaaagttccgggcaaaaaaaaaaaaaaaatattttggggtaaaaagcaaaaggcggcccctccaaaaaaaaaaacccgggcaacccttaaggtttttttaaaaaacccaggcatttatttttcaaaaaaaaaaaaagggggggggggggggaaaaaaaaagtattcctaacccccccctttaaaggaaaactgggggggggaaaacccttttttttaacggggcccacaaaggggtcaaaaaatttttgaaaagggcccccccccggaaaaaccccctgaaaaaaaaaacccgggatgggaaaaaagggaaaccccccccttttaatccccttgagactggaacaaattaatttctttttggcttttccaaaaccacaagggaaaaaaaggccccccccgg

SEQ ID NO: 20950 - DNA, 461 bp, Zea mays
  Clone ID: cC-zmle18900073d12d1
cggacgcttggtctgacgcgtggatagaaatcggagctgtttgtttatatttgttgtcgcagcctccaagtgggggtgggagcacttgtataaagttctagggctcgccttcttacaacacacacacacacaaaaaaaatgatacttgccgacagttgatgattgaggacatgtgggcagggatcaagtgggccggatgaagcgggcgagaaatggggtcgagggacaggcacgttccggtcgtgccgtgttggagattcctagccgcggcggcaaccggtcaccaatgtgctctcgttgtccttggactctactactcctgctacaaatggtgacgcctttattttatcttgtggagtggatgtaaatggacgccaccacaataaatcagagttctaaattaattttagtttaaaaaaaacataacataatacaatttttaattttatataataatgggc

SEQ ID NO: 20951 - DNA, 382 bp, Zea mays
  unsure at all n locations
  Clone ID: cC-zmle18900073e01a1
aaataaaatttaaaaccccnaccaaaaaacactttttaaatatatttaaaaaaaaanggcaaaaaatgttaaaacagggaaaaaaaagggggggtatttaaagaaataaaaattgtaaaaggggggaaaaaaaaaggcaaactgaaaaagcatgcaagcaaaaaaacccacccaacggttaaaaaaaaaaggggggttaaaaaaaaacccaaaggggtccaggaaaatttaaaaggggcaaaaaaaaaaaaaaacggggccgttgttaataaccttaaaaaggaagggggggcccttatccctgcccaaaggacaaaaacccgttgggtggggacaaaatttaaaaacttgaccaaattggaaaggtggaggggggggcccc

SEQ ID NO: 20952 - DNA, 194 bp, Zea mays
  Clone ID: cC-zmle18900073e02a1
acaaaaacaatggggaggggtattttttaaaatgcaatcacacacacaaaaacattggtcgcataaaaccacgataacatgacctgcaccttcccaatcaaaagaaggttaggcaaaatcaccagctaccatcacagattcatggggagatctcgccccaaatcacacttggatacccaacatctacagtaacc

SEQ ID NO: 20953 - DNA, 319 bp, Zea mays
  Clone ID: cC-zmle18900073e03a1
acttaaacaacggggaggggtttttttataattcctatcccacaaacaccaaatataagcgcataaaaccaaacccaaagcatggggtttaacaaattaaaacgaacgaaacaaccaatcccttaaaatacccacaaaataatgaccatcccaatcaccactaagactttgaaaactttacacccatcctaatctataaaccggcccaaaaataccccctccaaattgggtaacaacccaacccaaccaatccatacctgcaccaccggggccaaagggggcgctcaaatacataacctttccacaatgcagggaacgg

SEQ ID NO: 20954 - DNA, 312 bp, Zea mays
  Clone ID: cC-zmle18900073e04a1
cccctcgcccttttttttttttttttgttttaagacgaaaacaaaaacaacggggaggggtatttttatattttcaataccccccacaaatatgttgatattgataatgacacaatttagaaatacagactaaaaaaattaaatcaacgataaaacaaagcatttaattcaaatacaaaaaaacgacctggctcctcacatccaataaattaaaaaaactgccgcaaatataactcccttggcggagaaaaaaaaaactatatgtattgcgacaacacctgagccaattaaacattcattccacctccacag

SEQ ID NO: 20955 - DNA, 562 bp, Zea mays
  Clone ID: cC-zmle18900073e04d1
cgcccccgcacgacgcacgcatagccgcagagatccgtcacactgctatctttgatatctgaactgtaagatggcatcagcggggcttgtccgtgatgaaaatgtgtacatggccaacctccccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctccttcatctagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccatggtcttctatcttaagatgaagggtgactactacaaataccttgctgagtacaagactggagcttagagaaaggacgctgcttagtacaccatggtggcatacaaggctgcccaagacatt

SEQ ID NO: 20956 - DNA, 439 bp, Zea mays
  Clone ID: cC-zmle18900073e05a1
gcggggatcctcatagagcggacgccctctccctttttttttctttatttttttttaacacaaaaaccacacgggggatggggggattgtatattgacaatgcggcctccaaggtccatttccttcaccagtaactcgaaagcgagagagcttatcggtaagctaacctatccacccgaatagttgatcgtcctgccacgtgggctcgagggcaccatccggcaccatagatcgtggtagtggtgtcagtccacccacaggtcaaaaaatagaagttttttctgggtaaacgtccgagccccaaaaatgttctctgtacctgcaggtgcataaacgacggggggtctcttggatgcatacaccgaaaaagaacacggcctgttgttatgcggcctttcagcagtgaactcctcagcgcctgcgcaagcccactaaaccc

SEQ ID NO: 20957 - DNA, 427 bp, Zea mays
  Clone ID: cC-zmle18900073e05d1
cgcgtgcttgagttctacctagagtgcatcacctcactgttttgtttcatgttcacgccagcgtttactctccgggagcattgttgtattatagggaacgccacggtgcctacccccaacgccgctgtgaatgatctctacatggcataccttgcttggggccggacgctagcgagatctatgcttggacctgctctatggagaagcttttatccccttatcttttggtaagatacttcatgttgaggccttgaagcttataattgcttacgtttacattctatggaaaggcttcacccttccaagtattgtaataagctattcactttatgtactatcatgactagtaatacttacagatctttttatgatttaatactttctactttaaaatgtaaaatatattttgtaaaaaaaaaaaaacaag

SEQ ID NO: 20958 - DNA, 361 bp, Zea mays
  Clone ID: cC-zmle18900073e06a1
acatagaaccgaccgactatggggggggggttatatataatctccatatataccccaaccaacctctaattaatttaaaacttgatttcactcttactcaactgacgatatactttggaagaaatagggctattcatcatctgccctttattgaaggcttgtatcaatcttgttacaaaaactcctaggacttagacccttgctcctccctggcaaaaatggggtgcttaaaacttcaaaataaggcctgcccggcttacattttaccaaaacaaagctgggagatcatggggttgaaaaacctctacaacttctttatgttgtccttgaaccagttcgccttggttaaatggtgggcgtc

SEQ ID NO: 20959 - DNA, 403 bp, Zea mays
  Clone ID: cC-zmle18900073e08a1
ggatcctatacagcggacgccctttccttttttctttttttttttttttccaaaacaccacccccaacacggggcggggttttatttctttaaaactaaactcccacaaaacttccaaaaaacaaacacatatcttttgtccataaagattaaagtaaccaactggcataacattgtccttaacgtaagaaagaaacctatttaggaccccatcaaactgtcatttaaaggacacacttaagaccttacacctcatgaggaaaaaaaacccaagggcccggttcgtcctcgtccttcggggtgtggatggtcaccactctcccgaacaagattgaacgggccaaccttgcccttccgttcccagacaagcatgatccttcaccttaataccgaaaacaccatg

SEQ ID NO: 20960 - DNA, 269 bp, Zea mays
  Clone ID: cC-zmle18900073e09a1
accaaacggaaaaaaccacagggggaggggcttgctagagaccaattctgcatcacaccaacagtattcttataattcttcttttattccgtttcatcacattgacggattgtgcgcttgtgcccactcgcacttgctcgccagaataccctcaccggctgggcccaccataacgtggtatgtaagccccggttcgaacctggaccggcggaagctccatacgaacacctggatgtttaaaccccaacggacctctgggtctatcctgt

SEQ ID NO: 20961 - DNA, 293 bp, Zea mays
  Clone ID: cC-zmle18900073e10a1
agaactactaacaaaccaaccggggtgggggtctttacaattgctttgcacatccaaaccaccacaatggaagaatactagcattgaaaaatacacaaaaatcaaatgaaaaagggggcatttttacatgccgctaccagtcatagaccactgacactgtttgtacatacataataaaatgtataaaatcccgcttatcgaaactgcgctgagtacctcaaagacctaacttgactcgcacaacatcacaagatataagcactaatcctaaagtatacagcctcagcggccga

SEQ ID NO: 20962 - DNA, 163 bp, Zea mays
  Clone ID: cC-zmle18900073e10d1
gactcttgggctaaagttcatactatatggctgcgtgtagttataactaagccgacttttcctccctggatgggttatttcaaacatgttaatgccatcctacacaataatatatttaaaaaatatttccataatggtaaaaatcatacatactcatcttaat

SEQ ID NO: 20963 - DNA, 264 bp, Zea mays
  Clone ID: cC-zmle18900073e11a1
aataaccaaaccaaaccaaccggggaggggatttttacagtttcaattacaacaacaccccaaacaatagaaaaattccaaaataaaacccttaccacaaactcatacaaagccaggtcaacactccgtataattgacaagcagaaaacactcctcaccatttaacccatatggagcccaaatatacaacagcccatcatatcctccaatttacaaacaaacaacgttttctacctttactgactgcacagcaacaggagggag

SEQ ID NO: 20964 - DNA, 514 bp, Zea mays
  Clone ID: cC-zmle18900073e11d1
cgggtaatccgtctccggtgccggacagctggaagctgatttttttctttgccacgggcatcgtgcttgggagcgggggttctttgatgactgtcattttcttctggcctatgcacaagaccgacttcttctctgacaaatttcgtgtgaggtcgatcagggacagtgagcatgagatgatgtccgtgctgtaccttcaagtgagtatcgtgagccaggctttgatcttcgtcacccggtcccggagctggtccttcgtggagcgccctggcctgctcctggtcaccgcgttcctgctctcccaacttgatccgacctttctcgctgtctacgccaactggggcttttgcagcatcatgggtatcggctggtgctgggccggcgtggtctggcttctacagcatctggttctacttccctctggacctgaacaagtttcttaatcccctttgtgcttcacgtcttggcatggaacaaccttcctgtagaacaagaccgcctttaccaccaataa

SEQ ID NO: 20965 - DNA, 379 bp, Zea mays
  unsure at all n locations
  Clone ID: cC-zmle18900073e12a1
gggttgggtttattttaattttttattttttttttttcttaattattatttatttaaaaaaaaacatttgaaaaaacnaaaaaaaaacccgaaaaaacaaaaacaaaaccaaaaaacaaaaaaaaaccccaaaaaaaaaaaaaaaaaaaaaaaagggaaaaaaaaaaaaaaaggggaaaacaggaaaaaaaagatatccccccaaaaaaacaaaaaaaaaaaaaaacgaaaaaaaaaaagtaaaaaccagggaaaaaaaaaaaaaaagggaagacaaaaaaaagggaaaaaacaaaaaaaaagttttaaaaaagaaaaaaacttttcaaaaagaaaaaaaaaaaaacccaaaaaacacaaaaaaagcccccccccccaa

SEQ ID NO: 20966 - DNA, 253 bp, Zea mays
  Clone ID: cC-zmle18900073e12d1
cgcccacgcgttcgtccacgcgttcgcccacgcgatcggtttatatggacatctgcgtgcactgtacatcgggggtgttgtgctttgttgtgagaatgtaacacctgcaggattcagaacgtgtgctcattgcttatgatatatgtctcgtgttcacgttttatcaacaaaatgtcccgagcagagctcgatgcatctcaaccaacctgtcacatttttaaaccgaagagtgtgtgaaattacacgtgaaaat

SEQ ID NO: 20967 - DNA, 437 bp, Zea mays
  Clone ID: cC-zmle18900073f01a1
ggtccaaggcattgggaaggggtgttatttacaaagctgcacatacaaactgtcaccacgaaacttctatgcacacggtattcacaatatttacatgttataaactgatactgtttccaagaaagctcaccaaaacggacaccacccgacatagttttggcacaaattttctggtgaagccgcttggagtatgagcttttgaacctgaaccttcactgagagaccaggttgggcattccgggcatcttctgaagccaaatgctcactgccatgttggatagagctacctgctccagccaaagctgacccaaaagagaagtcacgccctgttaggttgttactcattcgtgccatcacaggtacagcacgctcatttaaaacctcattggcatcaccgagttgattgacagcctgtatcaattgcctctcacgtgctc

SEQ ID NO: 20968 - DNA, 298 bp, Zea mays
  Clone ID: cC-zmle18900073f01d1
cgaccacgcccccggcatggacgaggacgcccctgccggcagcggcggcccatgtccctttatcgaggaggtggactaagcggttgggtgtcggtcttgactgtgctgcagttgctggctggcccacttgctgccgagagttatcgtcagttggtgcggtgtgtccgcttaaactttatttgtggttggttggtacttttgtggtggttatttttttggacctcgtgatagtcggtcggttcaatgttatcgcggctactggcaaaccttaagtgatacggtattcttcttttcaaaa

SEQ ID NO: 20969 - DNA, 292 bp, Zea mays
  Clone ID: cC-zmle18900073f02a1
ttttgttttcaattattcctcgacgacggaggggtggggtacattatggtacaaaccgaaaaccagagtgcgctcacatgcattcggacacctaaaggtcaccggcggcgcctccctcacttgccggggacgaagatggaggcgtaggcccaagcgttgttgttgacggggtcggcaatgtggtcagcgaggttctcgagcgggcccttaccggtgacgagggcctggacaaacaatccgaacatggagaacatggcgaggcggccgttcttgagctccttcagacgcgtgg

SEQ ID NO: 20970 - DNA, 540 bp, Zea mays
  Clone ID: cC-zmle18900073f02d1
ccccgagcggccggtccagcacttgcacgctcagctccagcaatgtctgctatcaccatggcgatctcctccacgggggtggcggggtcccctttcaaggtgggctccttccgcgaggcccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccacatcttcagcgagggcgggctggactacctcggcaaccccagcctgatccacgcgcagagcatcctcgccatctgggcctgccaggccgtgctcatgggt

SEQ ID NO: 20971 - DNA, 251 bp, Zea mays
  Clone ID: cC-zmle18900073f03a1
cacccacagaacggaaacaggggggagggggatttttagatatgcaaacccacacacagaaacaatgggggcatagggccacgataaaggacaccggcccgacacaatgaaaagaagggcaaacagaaggagtgcaataacacacagaagaatggtgaggtcacgcacctcaacgaagatggaaacccagcggccatagcaaccgctagaggcggtaaaaaaaaaaaaccggaagtgcgacaaacggcaag

SEQ ID NO: 20972 - DNA, 433 bp, Zea mays
  Clone ID: cC-zmle18900073f03d1
ccccgactgaacgttgtatatgccctaacctgtatatgacttttatttggtgtgtaccgctcagtgccgagacaaggggtaccttgtatacaataccgattgataatgacatcatccccgacagccttaaacggtaccatcacacggtcgatgacgctatcatccgatcggtacagaacgatatttgtcatagtgttggctgttgcctacctgctgctacatgtcatgtttttattggtctatgtcatctcgatgtctaaagttttaaaaattcaaaaaaaactagaaattctaaaaaacatttatgaattatgtaacttttatttctagatattacatattttttatgttttatgacttatgtcaatcttatttacgaattataaaccatgtaacttgtattcgttttcatgaattatataatctttattaa

SEQ ID NO: 20973 - DNA, 424 bp, Zea mays
  Clone ID: cC-zmle18900073f04a1
gatcaacaaaaatcaactaacggggtgggggatttttacagttccacaccgccaaaagtttacttttttggtccttaagcacgatcaatacaggcacactctatgatttgaaaagcccagccatattaagtttttacaaactatccattgaactcacagtgcgaatccatccaaacttatgaagacagtggtggctgtggacccactataccttcctcagaagtcactgtcaaattaacagtggggctcagcttagcgcaaatttccttggcacccaggacaggggcagacatgaatttgctcatgaagtcctaaatgacaggggctgttttgtcgacagcaacaaactcctggtgggtcaacatgagaacaaagcgtggtgcacacttccaaaaagccaaaccaacaatttcaggaccatttt

SEQ ID NO: 20974 - DNA, 343 bp, Zea mays
  Clone ID: cC-zmle18900073f05a1
aacagaaacccacccacaacggggaggggggaaattttaaactaccaataaagcaaccaacccaccacaaataaagatataatccaacaccaccgtaccaactgaccaaaactatcgggaggaactgtgacatccaccaactgcatcacactcaagaccgaaaacaaaccgatcaatccacctcctaaaccttggggccagggccgcccttgccggcagggacaaacatctacatgccgccagcgccgcccatgtcttcacccccgccctgatacatcttggcgatgaagggggtggaaaagctcttcagctccttcattttgaccttgaactacaccacctt

SEQ ID NO: 20975 - DNA, 71 bp, Zea mays
  Clone ID: cC-zmle18900073f05d1
cgaaaaaaaaaattttaaaaaaaaaacataaaaaaaaaaaaatttttataatattagcccaccacacaaaa

SEQ ID NO: 20976 - DNA, 338 bp, Zea mays
  unsure at all n locations
  Clone ID: cC-zmle18900073f06a1
cacgccctcgccctttttttttttctcttttttatacataccatcctattttanggggtgggggaattttaaattcccccaacaaaccactcccaatttcacatatttcaaaacatcttacgcacccacaaaacagacaacaatcttaaaaaaaaaatttctccccccatccccccttatttaacgccctaaatgtctcttatacaaaaaccccatggacccacactaatcctactttcttccaaatatcgcctgctaaaaaccttaaaccaatgccctccccccccacactttaaaaaaaactctctccccaaacagaagaaaccaccccccccaaa

SEQ ID NO: 20977 - DNA, 600 bp, Zea mays
  Clone ID: cC-zmle18900073f06d1
cgcccccgattaaagaatagtgcagaatctgaaaatatgaactggattttggctatttctaagccctgtccgaagtgcaaaggaccaggagagaaaaaccagggatgcatgcatatgacatgcacccctccttgtaaattcgaattttgctggttatgtctgggcgcatggtcacatcatggagagagaacaggtggcttttatgcttgcaatcgttatgaatcagcaaagaaagagggagtttatgatgagactgaatcaaggagggaaagagctaaaaactctctggagagatatatgcattactatgagcgctgggcatccaatcagacatcgaggcagaaggcccaagcacatctgctaaaagcggaaaaggatcagcttgcaaatctaacatacatttacgggataccagagacccaacttaagttcataattgaagcttggtcacagattatagaatgcaggcgagtgctgaaatggacatatgcttatggctactatctggatgataaggtcaagagtgatttttttgagtttctgcaaggtgaggctgagtctggtttggaacgtctgcatcaatgtgctgagaaagacttg

SEQ ID NO: 20978 - DNA, 415 bp, Zea mays
  unsure at all n locations
  Clone ID: cC-zmle18900073f07a1
gcggacgccctccccttttcttttttttttttttaccatacacncacccagaacataggggnggggtttgtttacgcaaaacttaccttacaccaaaagtgccacagaggcaacacatatcatctggtcataaagatttaggtgaccaactgggttatcattggccttatcgtaagatagaaacctatctaggacccgatcaaactgccatttcaaggacacagttgggaccttacacctcaggaggtgccaagaccggagggcgcggatcgtcctcgtccttcggggtgtggatggtcaccatgtccggaagaggagtgatcgggccaaccttgcccttcgggtcccagtcaagcatgatctttaccttgataccgagaacaccatgtctgagaagaaacgtgtttcacagccg

SEQ ID NO: 20979 - DNA, 249 bp, Zea mays
  Clone ID: cC-zmle18900073f08a1
ttgtttttaaaacaataatcccaggattggggggggggtccaccataaacacggtgcatacacataacacacaccagccctagtataatcctatggacatccacaaaataccagtcctcttatcgcaaatagagcgagatagaaaaaaaaatacatcaactgagggcgattacccagcataaaaatagaataccctgggccagatgcagctattaccgagatgactatataaataccaggcgtgtccca

SEQ ID NO: 20980 - DNA, 151 bp, Zea mays
  Clone ID: cC-zmle18900073f09a1
agtaaaattacggaatctaacggggaggggttctttatagatgctcaaccttacacatgcaacaataatcagaactactcttaataacataatctcgacgctacaagacacgcgggttgacccgataatttacaaacaatcactgtacact

SEQ ID NO: 20981 - DNA, 162 bp, Zea mays
  Clone ID: cC-zmle18900073f10a1
ccataaataacactaataacatttaaataaccacaaccaaaaaccccaaacatatttaaagctttaaaaaacacctttttactatctgcccaaatatattccaaaataacccctcaacacaaaaaaaaatctctcattcaccacaaaaaccaacaaattcca

SEQ ID NO: 20982 - DNA, 105 bp, Zea mays
  Clone ID: cC-zmle18900073f10d1
cggacacaatcactgcgaggtcacactggcgctgcgcactgttatcttctatcgccggcaccaaaggcttagggccgggaggtggactactgctcggaggaggtc

SEQ ID NO: 20983 - DNA, 377 bp, Zea mays
  Clone ID: cC-zmle18900073f11a1
ggggggggacaaagcaaaaagatttgttgatgtctcatagctttacacaggtcccccttattacatggtttttggaaaacaagttgatggctacaaaagttacagatcttagccacacccatggcccatgcatgagcatcccaagatctcatgcctttccatccaagatcaaagacgtggggggactacataccttgtttttttttttttcccccatccacacccatatttttacctagttaaccagccatgccttcatgttcgtggggcaagcagcatgctccattgtttacaagacaagctccagttccttttaagtatgggtgagcagttttttgaagatccggccatgctcttgcaagcccaaatctgggttt

SEQ ID NO: 20984 - DNA, 432 bp, Zea mays
  Clone ID: cC-zmle18900073f11d1
ccgagagtgtgatcaccaacagctagtgctagtcccccttccttttttcttgtcatggcatgcgtcagcaccttccggggggggcccattgtcataagagcaaagatcaacaccaggtccaggggctgcagccagttcgtggcgaatgtgtcaccaccaccagccttccattttcagtgcagggcgtctactttcgcggtggacaccaacctccggctcgagctggacgagaaccccgaggcgatcatttcgggggcgtggcccgggaactgctccctccttagctacgacgaccttcgcgcctacctctagtcgtaggagacggcggcccaggcatacggtcagcgcggcgtgtcgctccttatcgagaccatgttcacacccgtgctggtggccacagcagaccaaaccctgtaggaccgttagtgccac

SEQ ID NO: 20985 - DNA, 510 bp, Zea mays
  Clone ID: cC-zmle18900073f12d1
acccgtgcggagaccaacatgcaacatataaagtggccttcactaccttttttttttccacaacggcgaccaatacatggggggggcttatgctccatgcactttctgcatctgcatctaactccacaataactcctcaatgcatcacaagctgctataaattctcttcagtccccataccttacatcaatgatagccttcgcctgtgaaaacccagctcttcaactctataggatccaacaagcaatcaccgcaagcaacagacctgtaccacccttgcttcaacaatcgccagccctatatatggagccatcatcggtccaaaccatcacggcacaccagctgcagtaactcgtgctccctgtgaataaccacacaaccttggcaaaccttttttcctattcttagtaacaacaatttattccattcaaccaactggttacatagaaccgtgctgcttacttgcactaacaactactaccattcagtcagttacctactgcccacttt

SEQ ID NO: 20986 - DNA, 442 bp, Zea mays
  Clone ID: cC-zmle18900073g01a1
ttttgtttgtggaagtgattacttcattactgggctgggtatacaatgtcataggaaagctttccttggtatctcccatgcattcgtcgtgattgtgcgtactgaaatgcatctatttcatgaaaccggccttgccgtcaccatcggcgtcaaccttagggttgagcttgtccatcaacgaaggcttgtgttgacctatttcttgttggcctcatgttcagattctagttttcgcgcttcctcttcggatgcttgggagtgggggatggcctttgagcggtcctcggtaagggccttgggcaagctgccatcctcgttgagacggcgctccatgtggcccttgtcggaaccgtccacgacgtgtccactggggtctttcgtacctgtagcaccgcggttgccgctgcgtgcagggtccctgaaatcctggctatccatcttg

SEQ ID NO: 20987 - DNA, 399 bp, Zea mays
  Clone ID: cC-zmle18900073g01d1
cggggattttttgtgtgactctgataaaagacatgtaactgatcttttcttttatacttataccatttgaaccgtgcttttagaaaaaaaaaaaaaaaaaaaaaaaaacaaaaaaaaaaaaaaaaaaaaaaaaaaaaaaaaaaaaaaaaaaaaaaaaaaaaaaaaaaaaaaaagggcccccccctaaaaaaaaaaccaaactaacaaccccctctcatcccacttaaaaaccctccaaaattctccccaaaattaaattaacctgtccctctttttaacaaactacccaactttaaaaaacctttgccctttccccaactaaactccccatgaaaaaaaacccccttcccccaccttataataaacttaaaagacccccccctatccccctccccaaaa

SEQ ID NO: 20988 - DNA, 398 bp, Zea mays
  Clone ID: cC-zmle18900073g02a1
ggggttggttttttttggagcaaagataatattttggtttggacaatgtaaacggatgggaaaacagcatggggaactccccaccaaacacccatttgtctgcaatcactgggaaacaaatgtttttatttttaaatcaagcaggcaactactcaaatacccttttccaacattgcccggacccgtgttgggaggccctacagcctgatgaacccctcggcgtcagcttgggtgtaaatctccccgttctcaaaccaggagatatcttccctgtacaggctgtaggggcttttccgggacccgacctttacggaacccttgtacagctttagggttactgaaccaagggtcgtcgcgggaaccttttccatgaaggcattaaaggactgccggggcgg

SEQ ID NO: 20989 - DNA, 455 bp, Zea mays
  Clone ID: cC-zmle18900073g03d1
cgccccgggactctgtgccacgatcacctaaccacaatggcctttctcctttttagctcaccggcgctcctccctgggggcatgggcaagcctcacatctcctgcgcgcaaacaccgcaccctgcatttgcccataaccagccgccgttcagcgagctgccggaaccacagaaacagcggcactccgtgcaagcgcagccacagcaagcggcggcggcggctaggcccaaacacgcgggcgtagcggactccactgactggatagcctcttcgtagacgctgcggtccggaatcggtgcggcgctggcgtgggccgtcttcctgtccgtcgacgacgagtctgaacagcgtaagacacgctctgaggttgctcatcagcaggccaacaccaaggacgtggagcaggagcactaggtcgtgctgcccaacggcatccggtactaccagatgctcgt

SEQ ID NO: 20990 - DNA, 270 bp, Zea mays
  Clone ID: cC-zmle18900073g04a1
ttttttttattatttacgaaacatgggagggatttttaatgacatcacacaaaaaaatggcgcataagccatgattacgcagtgacggacacaacaaaagggcaggcaccagcattacagtactcacagaaaatgccgactcacgcacccaacgacgatggaaacccaattttcaataaccgcagaggcggtaaaacatcagctgggcttgcgcaaacatgcaagctcaagaatgtgacaattcacaaacatggccaatagtgggcctgt

SEQ ID NO: 20991 - DNA, 553 bp, Zea mays
  Clone ID: cC-zmle18900073g04d1
ccccgcccacgcgtccgcggacgcgtgggctcaaggacctcatgtttcagcttatgtcttctagcaggatttttctgggtggaaggagggttatgcagatagcgctggggccttcgcctgctgatgaagctaaaacaggcctccacaaactttccaagttcctttcaaggcaactctggtctgttattcaccaatcttccaagggatgatgttgagaggatgtttcgagaattcgaggagcatgattttgcaaggacaggaagtactgctatcgatacggttgagcttaaggaaggccctctggaacagttcacacatgagatggagccatttctacgcaagcaaggacttccagttcgcttgaacaaaggtgttgtacagttggttgcagaccatgtagtttgtgaggaaggaaagcccctttcgccaaaagcagcgcaaactctgcggctgcttgggatacaaaaggcgacattccgtctataccttgtgtgtcgctggtcgggcgatgactttgaagcttacaaagaatgcttgatgcacctaggagctg

SEQ ID NO: 20992 - DNA, 233 bp, Zea mays
  Clone ID: cC-zmle18900073g05a1
attatacaaaaacaaccgggagggggatttttaaaaatgcactcccacaaacagaaccatcagccgcagaagcccacgattaagacacacggtctgacacaatgaaaaaaaggggaggaaaaagcaccgccaaaacccacagaataacccccaacttaagcacaacaaataatatgaaaaaccaggtgctcaagtaaccgatacagggggcaaaaaaaaccaaacatgacggg

SEQ ID NO: 20993 - DNA, 523 bp, Zea mays
  Clone ID: cC-zmle18900073g05d1
ccccgcttatccactctcaggatgaggaggtcctaactgatgccctttggtttctatcatacctatctgatgggactagggacgaggtccaatctgttattgaatctggcgcgttccctcgccttgtggaacttctgatgcatccttcagcctctgtactgatttcaagctctgcgcacggtgggtaacatcgtaactggggacgacatgcagactcagtgtgtcattgacaatcaagcacttccatgccttttgaacctactgaccaccaaccacaagaaaagcatcaagaaagaagcatgctggacaatctcaaacatcacagctggtaacagggaacagattcaggccgtgattaatgcaaacataattgcacctctggtgcaacttctgcaaactgctgaatttgacatcaagaaagaagcagcctgtgcaatttcaaatgccacttttggtggcacacatgatcagatcaagtaccttgttgcccagggttgcattaagccactctgtgatctgcttg

SEQ ID NO: 20994 - DNA, 152 bp, Zea mays
  Clone ID: cC-zmle18900073g06a1
acaaaaacaatcgggaaggggattttttgaaatgcaataccccaaacagaaacaatagccgcaaaagcccacgataacaacacctacaccgacccaatcaaaacaggggcacgcaaaagcatcaccaacactcacaaaataacgaccaactc

SEQ ID NO: 20995 - DNA, 216 bp, Zea mays
  Clone ID: cC-zmle18900073g06d1
cccgcggacgcgtgggtgtaaaaccagctcgcacctaacctctgtttctgttgtgttggcgagaaataacagcgtgggggatttgttgtactactactaattgattggtgaagaaagttaatgggaatgaaatctctactacaagctgcttattataatattttttttttctatcttttatttatttataataaaattattcattaaaaatatatg

SEQ ID NO: 20996 - DNA, 317 bp, Zea mays
  Clone ID: cC-zmle18900073g07a1
actcaaacaacccgggaggggatttttaaatatgcaataccccaaacagccacattggccgcaaaaacccatgataacgaaacacacaccgacacaaactcaaaagggtcaggctaccgcaacaccagtactgacaaaacaatgccgagctcgcgcaccataaatacgacgaaaactcacgaactcccacaacccccacaggggggcaaacattcctactttgccggcgacagcgtgcacggctcaagggaagagacaatccacaacgatggccaacagcctgggcctgtccgaaaatcctatctaatgcacaagtc

SEQ ID NO: 20997 - DNA, 421 bp, Zea mays
  Clone ID: cC-zmle18900073g07d1
ggtcaaccagatggccgttgctgtgcctacaatacagggtttactatatgcaaccagaatataatctgcggggggggatattcatagatacaattgttttcaccttcattcaacgctgaaagcggttttggtctggaggctgagctttgcatcattggatgacactatgcagctttggcacctggagtaccgctcattagtttttcatcaagtcccgttcatttcttgtgcacattgctggagattgggagatcgacatcaagactgtacgcatcataaaccgatcagtctattctttgcagcagaaaataagcagcagcatgttcacctgggttgtctttgtgcctgtggtcttctgccaggagggtgttcttttaagtttgaagtacatgtgatttgtgtcttaatgcagtctcggctt

SEQ ID NO: 20998 - DNA, 375 bp, Zea mays
  Clone ID: cC-zmle18900073g08a1
cttaatcaaaaagggagggggtttttttatatgcaataccccacacagccccaatatgcgaacaaaaccacaataaagccattcccacagacacaaaccaaacagggtgatgctcacgcaaaccccaaaatcacagaacaatgcatagctcatgcccactatataattagaaaaaacaacttttaacccaacccccacagaccgggaaaccttcccactaatcctgtggctacccccacagctcaacaatagttaacttgacaaacaaatggccaatagtcggctctgctaaaaaatcttaccaacacgcacagccagagtccaaacttgcaggttgtaaaaagactccatccccgtgtgcaaaacgttttccca

SEQ ID NO: 20999 - DNA, 502 bp, Zea mays
  Clone ID: cC-zmle18900073g09d1
caactcgacagagagaggggaggaggctctctaccctttgtttttcctagcacccctcagccccggagggggggccctgctctgcgcaatccacccatggccgacgaatcatgccgtcccttgccaaaattctgttgattgggatgtttatgatccatcttttgcagacggattcactgtcatattcaacaaagccagagatgagaagaatggtgggaacggacaagacactgagtcacctttcaaggacaccaggactgagagggtggaaacttatgctgcaaagccaagcactaaaaaatgttttttgttgtgtgacagtcagccctacgcaatcctgaggaagacaactgcatgcgctttgaaaatactgttcctttaattttctatacatactatccataagacaatgtaggggtacccaggcctctccgggctccaggatgggctatctcttaaaactcttgcgtgcttgtatgtatggtgtgagagaattcttaaa

SEQ ID NO: 21000 - DNA, 297 bp, Zea mays
  Clone ID: cC-zmle18900073g10a1
aattggggtggggatttttttatgggaactggggccaccagaaaaagcattggaacaaaaccgggtggaccaaatattaaaaaacaccaagtcccaaggggggctctcccaaataaccagaactcccttaacaaaggagagatcttgcaatcctttttcttccaataatcacaaaacgagaccaccccccaaggggggaaccaaccccaggctcaaaaagaacggagcccacgcctcccgggacacgtgggcgaacccccgggcgaaacgctggggccacccggaaattccggaccg

SEQ ID NO: 21001 - DNA, 430 bp, Zea mays
  Clone ID: cC-zmle18900073g10d1
gcccacgcgtccgcgggcgcttggggtcaaggactaggatttgttttagcacctacaggccgcctgtgacggggggacccactacctatgccacccctgcgccctctgccaggagggtcgcgagctgcgccgcagggcttcccacccttgattcaacaatgggcactccgtctttgtcatgatgccgcccatggagcataccatggggcgtggcatgtgagctattccaccaccttccctaccctacttttatctgtgcttcccgtggtttatcatctgctgctgttggccttgatgcgtgatgtgtcgcttgttcgtcagtaaatacgagtttgtgatatgaggtccttctgggaactttggattgtttgcttcttatcgactgcactttgcattctgaaccttaaccttcaattcttctttatctttt

SEQ ID NO: 21002 - DNA, 539 bp, Zea mays
  Clone ID: cC-zmle18900073g11a1
ggccccccttttttttttttttttttttttatgtgcagaataaaaacactgggggggagtcacagtaagaataatcaaaggttcaaaggatttacaaagggaatacatgtttctagtctagataccatgcagttcgtctgtgacaccaaagaaaccataaattacaaggtggccgcttttaacatggggaccaaggaaccaggcttctgggaagcgcagattcacaaaagataaaacaccgtgcatcaagcgatacaaacacacagaaagcctacttcgctgttctagagtgcttgataagccagtcgatgacgacgtctatgttcacagaatccttacacgagatcatgtagcaacaaacctcccggtcctttatcaattccagtccaagttgatcaaccaaggcctgcttcgaaagcgcttctgacttgtcaatattgttgccaaggacaagcaagggaattccagccaaagactgttttgtcagcagatcatgcaactcacttttcgcgattgggacactatcttggtcagcaacg

SEQ ID NO: 21003 - DNA, 191 bp, Zea mays
  unsure at all n locations
  Clone ID: cC-zmle18900073g12a1
aacaacaaccaaccagcatcgggggtttggtctgtttacacaggaaccttttgaccgaaagttcctttttcgaatcaagatgtaaagaaagaaagaaagaaaaggggggaacaaaaatgaacgcatacgcgcgctccggtgatcggcgagtcgagccaaatgcgacccggagctcgggggggggggngggg

SEQ ID NO: 21004 - DNA, 197 bp, Zea mays
  Clone ID: cC-zmle18900073h01a1
tttttatattttttttttttttttttttttggggatggtttttttttttccaaccgttcctccaacccttcgcccaaacttttttttaaatttattttaaaaacaaacacaataaaaacaaaacataaaaaaaaataataaaatcaaaaaaaaaaaatagaaaataataatctatcatccaaacttaaataaataaa

SEQ ID NO: 21005 - DNA, 570 bp, Zea mays
  Clone ID: cC-zmle18900073h01d1
gacccacgcgcccgcccacgcgtccgcggacgcgtgggcgccgctacagcccgtttcctcgtttcctctcccgtctccgagatgacggggcgaagggagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggctgggatttggggatgcaaggactgcgggaaggtcaaggccggtggtgcttacaccatgaacactgctagtgcggtcactgtcaggagcacgatccgtcgcttgagggagcagactgaagcatgatcggtcgcttgtcaggcatactggggtccactatattggctgtgtagccgagacagtactccagcatttttgggttatgctctaggatctctaaaggttgggtgctaagatttctacttgtttaccgatgtgaatatcacaagtgatatgtgatcctattactatcatgatgacgtcaaatttgcttctggattctaccctgtggtttgc

SEQ ID NO: 21006 - DNA, 550 bp, Zea mays
  Clone ID: cC-zmle18900073h02d1
gcccccgcggacgcatgggcggacgcgtgggctcagggtcttcgttgtcaactttccgttcagcgtcgacagcgcccagggggcggggcttttctagcaggccggctccgtccagatggtcgaggttatctatgacaaattgacgggaagaagccgtggattcgggtttgtgaccatgtcttcggtcgaagaggttgaggtggctgttgaccaatttaatggctatgtgcttgatggaagaagtttgagggtgaactctgggccgccaccacccagagatcggtcatcaccgtcaccgcaaagacccaggggtgatgccaacagggtctacgtgggtaacctttcctggggagttgacaattcagctctcgcaaacctgttcagtgagcaaggtgaggtactggaagcaaggatcatctatgacagggagagtggaaggtcaagggggtttgggttttgtcacgtacggttcccgcgaagaggttgagaatgcaatatctaatctcgatggcgctgacttggacggcagacagattcgtgttacggtagc

SEQ ID NO: 21007 - DNA, 555 bp, Zea mays
  unsure at all n locations
  Clone ID: cC-zmle18900073h03a1
tttttttaatttttttttttaattttttttttgtttgggttttttttttttttttttttttttttttttttttttttattttttttttttaaaaaaaaaaaaaaaaangaatgaaaagaataaaaaaaaatggggaaaaaaaaaaaaaaaaacaaaaaaattttaaaaaaaaaaaaaaaaaaaaaaaaaaaaaaaaaaaaaaaaaaaaaataaaaaaaaaaaaaaaaaaaaaaaaaaaaaaaaaaaaaaaaaaagaaaaaaaaaaaaatggcaaaaaaaatttaaaaacaaaaaaaaacaattggccacaattaaaaaaaaaaaaaattccatcataaataaggctattaaaaaaaatatttaaaaaccctttttttaacaaaaaaaacgtttaaaaaaaaaccatccataaaagggttcaaaaaaaaattatcaaaaaaaaaaaaacattttaaaaaaaaaaaaaaaaaaagtcaaaaaaatatatactttaaaaaaaataaataatcccaatatttaaaaaataaaaaacaactaattttaaaataacctagc

SEQ ID NO: 21008 - DNA, 561 bp, Zea mays
  Clone ID: cC-zmle18900073h03d1
ccggattaagattgttgccatcgatctcgctgacaggccagcgtggtacttggagaaggtttatccagaaaacaaggggccttgtgtagagcacgacaaccaggtgaaaggagagagcttggatttggttaagtacattgacagcaacttcgaaggtccatccgtgctccccgaggatcatgcaaagcagcagttcgctgaggagctgctcggatacactgacgcattcaacaaagcattttactcatgtttagtcgacagggaagatgtgtctgaggaagccgttgctgccttggacaaaatagaagacgccctggggaaattcaacgatggcccgttcttccttggtcagttcagtctggtggacgttgcgtatgtaccgttcatcgagaggtttcagatactctattccaatataaagaactatgacgtcacaaagggcagacccaaccttcagaaattcatcgaggaagtgaacaagatcgatgcgtacacacagactaaactggacccgcagtttttgcttgagcaaacaaagaagcggcttgggattgcttaaag

SEQ ID NO: 21009 - DNA, 287 bp, Zea mays
  Clone ID: cC-zmle18900073h04a1
tcgcgtcggctgcttctttttgcggcgcttggcggacgcctcggggccggcgaccacggtggtgagggacgaggggctggaggacgacgaggactgcgtggggatgcggagcacgccgtcgaccgtggtcgcgatcgccggtaccgtgccggtgccggtggcggcgatgatggcgggctccgactgctgcagcagccaccggatggtctcgccgtcggacttgtgccctagctcccgcgtcagctggaagatcctggccgcgcacgccgcgggcatgcggatccgcc

SEQ ID NO: 21010 - DNA, 393 bp, Zea mays
  Clone ID: cC-zmle18900073h04d1
gcccccgagataccttcaggcctccagctcgtaagggggcttcagtttctaagtgctttccttaggccccagctaagctgggagcgggctcgtacatgctcctgcttgcttatccatgaaataatgcctggacagtctgtagatgttgcgaaaacatggtgcccccctggggttgccgcgtgtgtagtaagtatctctcagtcgtagtgtggttgaagcatctgaactcttgagcggtttgcctgtgatggcatatgggtcaaactacaactggagtgtgatatctagtttatatggtccagcgctcttgttgactgcgggtggtggtttgccccggataatttactgattatgtctgctccaaataaaaataattaatataaataacattat

SEQ ID NO: 21011 - DNA, 426 bp, Zea mays
  Clone ID: cC-zmle18900073h05a1
ttttgatttaattactgtgctcacttaatcaaatgagggggcgtttcgtacagagggctaaatgaggaaactttagatcatcctccaactatttctccgtattggatgctttaacatctacacgtttccacatttccaatgcctttgatttacagtgaaattctcactggttctatattcagcaaacataaataatatgtactttcttgcccatcacaactatgaccatgtctcgatgttaagtctaccagccctttctagatccctgagccatttcgatgcatccgcttgcttgacaccaccttctttacaaataacctcctctagcgcagctgtaacatcggcaggcattttcgtcgaagagcctgcaatgtagatcactgcatcggacagtaataagttccacagtcttgaactctgttcctt

SEQ ID NO: 21012 - DNA, 515 bp, Zea mays
  unsure at all n locations
  Clone ID: cC-zmle18900073h05d1
cgcccacgcgtccgcggacgcgtgggtttatgagagggatctttccgttttatttcagttcagagtggtcatttgcgcagttgcatttaccagaagtcactcgttacatactancctttggtgcccagaatactgtgatgatggttggcctggatggcagcttcttacaggtgcagctttgaccaagcgaatggagggcagatgttgcagagggaacatttccggtttctcaagtccgacagcccacctttcaggactgcagccgcttgacctgcagcacgaggatcatccatcccaccatgtaaatgtcgaaggtccactgtacatatcgccttctcgccggcgaagttataggcagccggaataaggagagctggctgttgttggatcgcagcctacaggattccaacgttcggatcggcgccccgtccaaattgcaggcatttctttgccgttccctcttctatctttaaacgagaacacacacccattgctggttcagaacatgacataaa

SEQ ID NO: 21013 - DNA, 256 bp, Zea mays
  Clone ID: cC-zmle18900073h06a1
actgtgcttacttaattaagggagggtggttttttttacattagggcagcccgaagaaactccacaccaaagggcaaaaaaagctgagacagggacgctcccacacccacccggtgccacagaaacgaagccccttttttaccggggcttaccccccggggggagaaacaaaacacggaccacacccgctccataccgtccattaaaagagggagcacggcccgagctttataataccccccctttcaagattcct

SEQ ID NO: 21014 - DNA, 614 bp, Zea mays
  Clone ID: cC-zmle18900073h06d1
gcccccggttgttttttttttttttttttttgctcatattcagaatattcaaattttatgtattaagtaaaaacactcgaggggtcaggatcgttgacaacactagaactagaaagctttatatacgcgcgagactgagaaaatgaccaaagaggagaaaggagccataaaccaggagctaggtgcggagctacagtcagcactgaggcattagctttcatattccgatatcactgcatctgctgtgccgtcacctggattcggttgcggcccctcaagtctggttaagacgtcaggtgctccagcagcatctctgataatcaatatttcttcatccaagtaagagatcatgaataagcgttgaaatgatccactaagtggcaatttaagcccctctgaaacagcatcccttatagggctaggaagttgttgtagagctcctgcagtttggccaagcaagccctttaactgttcaggcaatgattcttcattgattctgggaatctctataaggccctcaacatattcctctttcatcctgatggggccctcaacagacaattgagtagtcagtaaaaacttgctttgttcgtgtttacaaacttgaggtttga

SEQ ID NO: 21015 - DNA, 431 bp, Zea mays
  Clone ID: cC-zmle18900073h07a1
agcaacggtgcatccggatggggtcagttaaaacctcagagcaaacatccgccaagcaaactccgatacctacaccaccctttttcgcctatatccttttactttgggcacatgtcaatctacagcacacacatcaatgcaatgcaatgcaaatgcacggcccgaaccagtcacccccaacaaaccaggtttcatccaggggccgtgccttccagccggcagaaaaccgcgcctccaccactccgctcacttcacgttaggcttcggcgagtagcggaacggagacgcgcggggcccgtcagagaggctcctcacgggaggcggctgcccatgccgcccaaacgggctctgcgtcttgaagccgccgttcatgctgctcctcccgttcatgctgctcgagtgcgccaaccgctcggcctgcatcggctgga

SEQ ID NO: 21016 - DNA, 451 bp, Zea mays
  Clone ID: cC-zmle18900073h07d1
tgcggtgcagaacccactgggggaaaccacaaacactggccattcgatgcccatgactgccgtgcccactaacgggcgggtttgtttgaggtcaccgccggctcacgccctgtcgagcacactaaccgggtttcaaggcgcccccaaagcaactgtgcagtatagaatccgtcgcgtatcgttcgcactgagtcaaacttgaggatggagagagcaaaacgacctgatcctccttgcaccatctgcaaaggcacatggagaataaactgccgaaactgctttggtcgaggaagaacaaaccatgcccatgtggccatgcttcccaacggcaaatggccacaatggagtcaaatctctttgtggtagtggactggattactgcctatccgtgccatggaactggttgagaatccataacccatgggctttcaccttcactgtccaaagaaaa

SEQ ID NO: 21017 - DNA, 392 bp, Zea mays
  Clone ID: cC-zmle18900073h08a1
aaacccccatccaaaaaatttattatttcaaaaccctagagtcccaaaaaggcctgcttccaaattaggacttaaaaaggctgccaattcgggaggttaaaaaacccccaccccttggcgaagtttacaggatttgaggcaaaaatgttccaaaaccccaaccctaggagccctggcgggatgggttattaaggaaaaagggcccaagggaaaaccatgtttgggggattcaaaatcttttgggccccccaagagggtaaaccatggatgtagctaaaccagggatcgatctcatcagttcttgggggcataaacccaattgcttggaaatgggggttgaataaattggcaaaacacccattggtcaaggctgctgctaaaaatgggttttt

SEQ ID NO: 21018 - DNA, 447 bp, Zea mays
  Clone ID: cC-zmle18900073h08d1
tgcgagggctgacaccccgtgggattacatcgaaaaatgcgtttttctggatgttaacgaacctaatggctcgggggggcgtcattctagatataatactagtgactccccatacttcatagttcataacagaggcatccatcgcttgatgtttcacaaataacttcacgtaccactaaactaaagacttttacgtgcatgatggtcattcatcatactttgagcaatctgccaaacatgaacacttttcaccacttttgtagcaaatagccacgttaaatgatgcactgtacaaaatccacattcaacagaactggttttaggcccaaattgaccgctaagcaatctctaaccacaacattatcatgatggcagtccacaaggcactctaccattctgcgtcactgatccttgcctgcgtcatacaagtctatcttctgtgccggc

SEQ ID NO: 21019 - DNA, 350 bp, Zea mays
  Clone ID: cC-zmle18900073h09a1
gggtgggtctttttttaaattttttttttttaaaatacctaatttttaaaacaaaaccccgggacacccccgaaaatcacaacaccaccctaaaagagaaccaaatccccccaaaaaaaaacctaaaaaaaataggccaaaaaaaagaaaaaacccgcccacgcaaaaaaaattaacccctacaaaaaaaacaaaaccacccaaccggaaaaaaaaaaaataaaacccggggggccaaaaaaaaaaccccacccaaaaaaaatgcgcggggccaaatgaccctcttacaacaaaaaaaacccccaccgacacggaaaaaaaaaaaaccacaaccccccgggaaaaggcca

SEQ ID NO: 21020 - DNA, 401 bp, Zea mays
  Clone ID: cC-zmle18900073h10a1
acgatacaagtacacgggcaactgggctgagaaaccaccaaacagagagtagtaaaacacgtaccgcgtgggggcgagatcaagaaaactactaacctaaccacagacggagcacaacagaacggtgggcacaggggggggagccctgtttattggaaacaaattggcatcgacgacgccctcctcggaaacgaaaaaggcaaaaaaaaaaaaaaggtgctcacttggcgctggcgagctgggtgcggatgagcttagctgcggagaccatgttggtcagggcgggcttgacctccgtgtacttgcgggtcttgaggccgcagtcggggttcacccagaggatgttggtgtccagcacggccagcatcttgtcgatgcggtcggcgatctctttggccgac

SEQ ID NO: 21021 - DNA, 478 bp, Zea mays
  Clone ID: cC-zmle18900073h10d1
ccgttcgggaatatcaagcagagactggcttcttctgcataattttactagactgctggctgtttgggtgactggggggggcatttatgttccaaataaactggtggcacctggcaagcaattcaaatgtcatttctcaagggattcctaagcaggacatttatggtatttaatcatttggtcttcatggtcactgtatggaacgccgatatcgcttcaatgccactgcaagcaagcatcaaggatgcctgaggaagttcttctatgcctgccaaatctgatgactggattatgctctgttcgtttaatccacattggaggccggaaccattccaacttatgaagctaatacaaattttgcgaactatttcaatccggaaccaatccattaaagcatttatgaagaaccgaacgggcacttaggcattaccgacccctctaacaggatgcattatataccttgcttaagcaattatta

SEQ ID NO: 21022 - DNA, 396 bp, Zea mays
  unsure at all n locations
  Clone ID: cC-zmle18900073h11a1
ttttntttattttttctattaaaaacactgggggggggtaaattttaaattttttttcgtccccatccctcattttaaaaaaaaactgggttaccagggggcccatttttttaaaaagccccccaaaaaaaattttggggaaaaatttaccggcccccgggggggggatctaaccacccgggccttggggaaaacaaaataattttgcacagggggggaaaaaggaaaccccccccctcccaaaaaaacccccctggggggcaaaacctaacggatccccaaattgtgcccacgagggggcgggcacaaccctcaaagtttatgaagagggcaaacaccaacggggcggggggccccaaggcccaaagaccccccccgcgaaagaaagggaaaaca

SEQ ID NO: 21023 - DNA, 405 bp, Zea mays
  Clone ID: cC-zmle18900073h12a1
ggaaacattatgagcccaggctttaatttcaaacaacaaacttattcatgatttgccatagttctgggtagtacccacacacaacacaaccggtccatttttaaaccaaccctggcccgaacaggagattcttcgacaacctccatatggggagggcaccaaacgacgcaggcccattgggagtttaaacgacccatgacttactgaccaccacggagacggagcacaagggggggggggctctccttttggatgttgtactctgctagggtgccgccatcctccagctgtttgccggcgaagatcaaaccctgctggtccggggggatgccctccttgtcctggatcttcgccttcacattggcgatggtgcccgagctctcaacctccagggttatggttttt

SEQ ID NO: 21024 - DNA, 365 bp, Zea mays
  Clone ID: cC-zmle18900073h12d1
cactcggaacgctcatagggggggataattgaatattcttactttctaccactcacattgtcaaatgtcagcatctgttgaaccctttcaacaatgtactgataactctgtgcttgtggcgactatgtaatagctgatggaacccttcacattttttgcttaaagtgaccaccttttgactctcccttgagaggcttgacattacgcaagagacacataggcataccgatgacctcgatgccataactacataccttggcataatgatcttaccgcgataggactcaacaactccaccaacaatggttactgtcttaatttaatggcaagcgcccattgttttggctcataacccttcccaaaac

SEQ ID NO: 21025 - DNA, 318 bp, Zea mays
  Clone ID: cC-zmle18900074a01a1
gggtatggtttaattttatttttttttttaccccacaaacctataccttaacctttattattactaaatttttttaaaaaaaaacgaattaaaactaaacaaaaacatagcaaaacctaatgaaaggagggaaaatcttatacaatcaaaaaacaaaaaaaaaaaaaaaacaaaaacaaaaaatgaaaagcctgggaaacaaaaagaaacaaaaaaaaaaaaaaaaatgccctgcgctcaacaaaacatttaaaaaacgaaaaacataaagggacaactaaaataaaaaaaaaaacaacccccacacaaaaggagttt

SEQ ID NO: 21026 - DNA, 480 bp, Zea mays
  Clone ID: cC-zmle18900074a02a1
cttggatcctctacagcggacgcccttcccttttttttttttctcttttttttttttttttttttttttttttgggtttggtttttttttttttttcctttctttcccctctctttttaaaaaaacggaaacccccttttatacaactcaaatttaacaagccccgaaccctgaaaacttcccccttaagtccttaacccccacaaccaaaaaatacctgtaggcctcaaaaaaactataccacaaaaaacccccccctaaaaaaagaaaaaaggggaaaccaaaaaccccgttaaaataaaaagtaatacagtttatttttttaaccccctcgggcgggaaagaacccacaaaaaccgtacccaaaactattaccggaatcaaaaacctaaacccaacccccaagggggaacccttgttcccattggggggaaaaaaaatcccaagcctttccccccgggccaaaaaaaaccccccctt

SEQ ID NO: 21027 - DNA, 395 bp, Zea mays
  Clone ID: cC-zmle18900074a02d1
acgcgtccggtccaaatgagtcaggcagtaaacaagaagcttgttttcttatggccactggcggaaatgctgaggagattcttcactgccgatggtagcaaggcttccacgctgtggcttgtgctgaggctattgatcccggtaatagtattggttgcagttcgtgtgggttacttcatgcacagcagtgttgaagagatagactgcatcaactgttagttgagcagggtatctgagctcaccttctgtcctttttcaggtgagtgtttatcgttgtatagatctgatgagtactacacgtatttgttggatgtgtgggtagaggacttgagggcgaagtattcacgtgtactgtactgttaaatttgacttgtctaatagttgcttccactgtc

SEQ ID NO: 21028 - DNA, 490 bp, Zea mays
  Clone ID: cC-zmle18900074a03a1
ttttacttccattcaaatatatttttattgatatggcgggaccgggttctagtcccgtggagaattaacagttaacactagtgtatatacaaacctacttcaaaaatattccggccaaaatgcttatccctaacaatagcgagcgctaatccaccttcccaccttcctacctggaacttgtacaatagcacgatctaacaccagagagatctagaggagatgccgatcatctccacacggtttcatttgcgtcggtgaagatggcattgtgatgctcgatcagacactggataacctcaatggagctgtagtctggtggtgaagcatcgtctaaggggatctgggatgaagcatcctcgtcatcctcatctaaaaggtaataaacaaagtagaatttacacacctaacaggtcccatgtggcagcatttgatgttgtatccacaatttttggaggcggtttcagggtaaacttgaggtggttacgcaaat

SEQ ID NO: 21029 - DNA, 267 bp, Zea mays
  Clone ID: cC-zmle18900074a04a1
ggggttgggttttatttattttacttttttctcccttttccttttttttttttttttttaaaaaaaaaaaaaaacccccccccatactgaccggcgaggagaaaccacacaaaatctttttcttattccaacccccctaaaaatattgccggcccccccccccccctgagaaaagccaaacaactttgtcctttcctacccaaataaccatggcaaccccccccccggtactttccctaaaaattggggatcccacagtggaaattt

SEQ ID NO: 21030 - DNA, 262 bp, Zea mays
  Clone ID: cC-zmle18900074a05a1
gccattgggggcggggatagggagcattggtcttccattcaaagatcagttcacacacacgcacagagacagagagagagagagtggagctttattttgtttcggtctacacgatggtactcagccactgtaacaggtcagtcacggtactcagccatgaacgcctcatggaaagccttgaagcgggtgatcaccgcggggattttgtctttctgcggcaggatcgtgcatctgacgtgccatgttccaggaacttgggcca

SEQ ID NO: 21031 - DNA, 497 bp, Zea mays
  Clone ID: cC-zmle18900074a06a1
agcgccaggcgcttggatcctgtagagcggccggcctttccttttttttttaattatatttagaaatccatttctattccaagcgggaaggatatagctccacactaaagcatcatcatgtacattgagtctatggctgtaacagctagctagtaatagtcaccggcaattagtacagtagcgaacatataagcactgctgcacgagctacaagcggtggtgggcgcagggggcactgccgtcgtcgaagttctggtagtagctatgcaggtcatacccgaacctcaccgcggttcgcctgggccgcgctgcgcgtcttctccaagagcgactcaacctcgacagcagccgcttgaccgccgcagctggccggcggccgccgctcctggcgtggacgagcctgccgcccaagccgctgcccccggtgtacgggcctagcagaggacaccggcgcatgatgcgtcactcaggcggttctcacaggtcacggacgctct

SEQ ID NO: 21032 - DNA, 264 bp, Zea mays
  Clone ID: cC-zmle18900074a07a1
acactgaaaagccatgtatctgcatatgggggtgggtgtgaacaaacaacggaaaacaaaccgccacactagcttgcacgcaaaattctacaattcagaaaccaccgataaaccacgaacatatcataggcttatcatgagctactgataataccactatagcttgcaatacatcttttagcaaaggcaaactctgacccacatctgctggccccccaaatacacgtaactgcctatcagagacttgctcatgccctccacaat

SEQ ID NO: 21033 - DNA, 313 bp, Zea mays
  Clone ID: cC-zmle18900074a09a1
tttcttttcatttttttttattttttatttgtctttttttttggggttggtttttcattttttacattgggaataaaaaccaaaacttcattatagaaatcccatttttttgggccatcccccaaaaaaaaaagggcctcctccaaccgcctttttccacatttgaaaaaagaggggggataagaggaaaattcccaattttaacgaacactctagtaggcctaaaaatgaattatcaaccccccaggaggggatcctcaacctgggaagatgaacctggcaaactccaccactgccccgtttagccagcgcc

SEQ ID NO: 21034 - DNA, 450 bp, Zea mays
  Clone ID: cC-zmle18900074a10a1
tttttctcttttttttcttttttttacaatcttttttgtttggtttaaaataactccaacaataaacccccccccttcaatcaaaaaaaacacccccaacaacaccccagccctaaccatcaacaccaccatcgacaataccaaccagccaaacgaaaactaccacaaaccatgcctgatcaacaacaccaacaaactcccaaacctaaacgtcaaatgcaaccagcctcacttgaactactatctaaccccgttcctactcttcctctacatctccgattgcatcgaatatctcgacaagaactacctcatacccatcaaaaacaacaataatcccgccatgatggacatcatcatcgacgtggagctcgccacccgcctcctccacaaggaattcatatggcccgtctaatcctaccatgaactcattaacgcaaaccatctttacca

SEQ ID NO: 21035 - DNA, 345 bp, Zea mays
  Clone ID: cC-zmle18900074a11a1
gggggtggtgttttttttttttttctcttttttcctgggcccaaaaacctcaaacaaatcgacggaatgccccgcaacccttgaaagggagccttaccctaaaaccccccccccccggggtttaatttttcctaaaaaaaaaacccctttttttaccccttccaaaaaattccctggaacctgcaacaacccttgttcactggggttccccataccaaaacctaaaagttataaaaaatccccaaaaccggccggggcccccaaatgtaaccccgttttttaacccaaaaaacctttaaataccgggggaacccaaaacgggcccaaggaacacctcgttaaaaa

SEQ ID NO: 21036 - DNA, 378 bp, Zea mays
  Clone ID: cC-zmle18900074a12a1
ttttactttacatactctttttattattattacttggggattggctgcaaacgacaacacacacgagacaagacgcgtacagaacggacattcacgaactcaaatgcaacgcaacccgaccaaccggccggaaattagattaaagcagactgagcatcatataaatcacgctgcgacggcgagcagcgcggcgaaacggtcggccaggctgcggacggtgctgggggacaccgcggagtcgccgccgaggtaccaggtctggatcatcccggcgacgttgccgttctccaccgcgatcctggcgtggcccttgccctccgtggggaaggcgatctcctgcgcgggtcccggggaggcggaggccggtgcctggaagtg

SEQ ID NO: 21037 - DNA, 403 bp, Zea mays
  Clone ID: cC-zmle18900074b01a1
ggggaaaaaaaaaaaaaaatttttttttaaaaaaaaaaaacaaaaaatgttcagcaacaaattatttttgaaccccctacaacctaaaaaagaactggcgttttcttttccgtcccggtaaaaatggggaaaaaaaaaatcttttctttgaccccattcccatgggaaaatttccctttcgggaaaaggggttacattattttgaccggtcccccttggcttaaaaaatattcccccggaaaaattccttttatgaaagggggcttgcattaaatgaaccttggggatttggactggacccaaataattttaccctgggcaagggggggacaccactttatttttttttttcaagaaaaaaaccaaaaatttttttttctttaaaaaaaaacctcccctgggg

SEQ ID NO: 21038 - DNA, 523 bp, Zea mays
  Clone ID: cC-zmle18900074b01d1
gaaccacccgtccgcccacgcgtccgcgccttcgtcaaccagacgctcaagaaaatgtttttttttttggacgggtacccaagaagctgtgcgggggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaacatcgacgagctgctgggttctatcctggagaagaaatatgaaatggtgtccagcacatgagcaaggtaaaaatgattgggtgcagtgcaaatccgacaagttcatgtaatgc

SEQ ID NO: 21039 - DNA, 405 bp, Zea mays
  Clone ID: cC-zmle18900074b02a1
ggggtgggatatataaagtcctttattttcggataaatcataaaacgttctacaaattatgaaaatataaatgcggggctgggagctcatgaacactggtgctccaaattatttacaagccccgttactattatatgataataactggggggctccccaatgctagcgacaataacttgcgatcggattcccggacatcttacgttttaaaagcagccgcagcattcctccagcacgcagtaacagcagagagcatccaaacatcctttgaggaacccaaaggagctaccctggtttccctggtgggggttgggttgatgctctccatgccgcggcgggtaataaggacccttctggtccttgaaataaccctggtacccccgtggaagctgctgtggtgggggg

SEQ ID NO: 21040 - DNA, 617 bp, Zea mays
  Clone ID: cC-zmle18900074b02d1
cacccgtccggcgagaagactaagaagggggaaatcgagagatgagctaccattgagttcctcccgaggaaccctaccctcctgggggagatccttgatctcaggcgcacccttacccaccgccaccagatgtgtacccgcctccccctcggggccatggacatccaccaccaccccatggcgtgtacccgccgccgccgcagggtccttaccccccaccacagcagcctccaccggggtaccagggctacttcaacgaccagcagcgtccttactacccgccgccgcatggagagcatcaacacaaccaccaccagggaaaccagggtagctcctctgggttcctcaaaggatgtttggctgctctctgctgctgctgcgtgctggaggaatgctgcggctgcttctgagacgtgagatgtccgggaatccgatcgcaagttatcgtcgctagcattcgggagcaccccagttattatcatattatagtaactgtgcttgtaaataatctggagcagcagtgttcatgagctcccagccccgcatttatattctcatacattgtagaacgttctatgatttatccgaaaataaaggactctatataatgggattct

SEQ ID NO: 21041 - DNA, 378 bp, Zea mays
  Clone ID: cC-zmle18900074b03a1
aagaaataacccctttttagattagggggtgggatttgagtcaacagcactaggttaccacatcggccgtctagcaataggatacaagcatgacaaaattaatgtgactacagagtacagactattggctacacaatacgcttgtttttttttttacatacatgcctagaaacatcctgggttagcagcagggccctggaactgacatgtggcaggcaagaaatcatacaccagcaggggatttcaatgacgaggcatcgtccgctgatacagccacatggacatggccgccagatgactcgcgaaaaaatagcaaagctatacaccgatcgatcggctatgtctgcgtcctaatgctccgagggtccatgaacttgc

SEQ ID NO: 21042 - DNA, 361 bp, Zea mays
  Clone ID: cC-zmle18900074b03d1
acgcgttctcccacgcgttctcccacacgtccgcccactttattttattagggaaaagaactctgggggggcggggttttacaatgggtaccccaatggtacctcatggctcattagcatcatctatgtcctctgataactcagttcaataaagcagctctctaacatctgcaggatgctgttagtcagctggatgtgcaaaccaaatcgtgcatcacggatggttcataccgattggcacgaagtgcgcaacatagacaagttttttcaaatacgattgaacagcaatggtggtagcgaggactcaaaggaactgtataacgcataaacttcgtgcaagttcatggaccctcgtagcatt

SEQ ID NO: 21043 - DNA, 418 bp, Zea mays
  Clone ID: cC-zmle18900074b04a1
ttttcgtttaaatttgtcaaattatatggagtagatgggtttgctctgatctagctgatctgcagctgaagtgaaaaggtgtatagctgataagaaatgaagcatgaatgggttatagagaattatattttatgtaaatctattacatagccttgtggatattggtaccaccttatttttcttgttggcctgttcaaccacatgaaacacgctttgctactttttttttactaaccagagatccatgtccatgcatgtgtaggttattggcctttatgttggggttgcgacagtgggaatcttcatcatctggtacacgcatggcagtttcctgggaattgacctggctagtgatggccatacccttgtgtcggactcccagctctcaaactgggggcagtgctcctcatgggagggc

SEQ ID NO: 21044 - DNA, 339 bp, Zea mays
  Clone ID: cC-zmle18900074b05a1
ttggatcctgtagagcggccgcggagtgggcgagcgccagtttctttcagcacgcgccgatgcggcggcggagggagagcagcggcgtggccctggccgtcgtcgtcgtgccgtcgtcggcgtcgtcgtcgtagatgacccagcgctgcgcgaggccgagccgcgtcttgcggcgcacggtgaggagcggcttcccgctggcgtgcatgagcacgacgccggcgcggcgccagcgccgggtggagccggcgtagcactcgacgcggaaggccatgttgccgctggcgtcgtagacagtgaagccgtgtgagttgaagagcagcgacttgcgccacaccg

SEQ ID NO: 21045 - DNA, 310 bp, Zea mays
  Clone ID: cC-zmle18900074b07a1
aaataaaatcaaaatctatagatggtgcggaaaagaggagttattccctgaatgttcctaaaagtaatgcatgcatctcacaattctgtcaagacaacctgttcgtccctggcttgaccactctcagcttgcttgctggggatgaccactggaggcgaccactggtctgggactacaagaaagtaggcccacatggctttcctaaaccccttcttggattgctttggtgaaattactgttggcgacacattctttggtccacctaatatccctgaagctttcacccatgtctttagggggtttgtcccca

SEQ ID NO: 21046 - DNA, 207 bp, Zea mays
  Clone ID: cC-zmle18900074b08a1
gcttggatcctatagagcggacgccgcgccggccaccacggtttctcactacggacgccgggcccgccgagaccgggcggggggtcaaaaccatcactctcgccgccgcgttgtgcgccacgctcggcggctcgctccgccatagctgggtgagtgaagggtccgaggttgcccacgatttggcgcgctgggagcgcggacgcttgg

SEQ ID NO: 21047 - DNA, 406 bp, Zea mays
  Clone ID: cC-zmle18900074b09a1
ttttgattaacatcaagaatccattatacaggaatgcggtacagataaaaatgtgccacgcttgaactcttaaaaatatgccacccttgaaccccctacagcgagtctaacatactctaatcacaactctatgagacctttgatgcagtaggtgcccacaaggaaccagacagtcatcgcagcggcgaaagcaagaaggccggtcaggaaggtcgtgccgccaaggaaggtaccgatggaaagcacaactgctaatggcaataaggtcttcaccaccaatgccgtgctcacccagcggcctggtaggaacatgacaggagccaagctgaccacattccattcgtcgtggccggaataaaacagcctgttcagattgtttgcgacaaaggagtggccggtgcacgtg

SEQ ID NO: 21048 - DNA, 313 bp, Zea mays
  Clone ID: cC-zmle18900074b10a1
atcggtaggggctggcctttgggattcgagaacgagtctttccacgggttgcaagaaatcaccaagaagggaggggtgttttaaattgcgattccccatcttttaacttccttcctggacaatccaaaacagaactttatcctccttagttaatgaccacgtgagtcccgctttccattcccgttcctttgatccttgcaagcaagcttctcctttattttaatttgaggtggagggtttgagcttcagaaagagggggatggattcgaactgaaatcagtcgagacgccggggcgagtcgattatttccaac

SEQ ID NO: 21049 - DNA, 332 bp, Zea mays
  Clone ID: cC-zmle18900074b11a1
ataaaacaaaaaccatttagggcaagtgacttataattggcaaaccatagtaccaactaatagaaatactcaaaatctctaaaatgttgccgtcacctggaactcattaccagtaacataacattggcaactcttgacaaagatggcaactgttataaagacgagctcctcctgcagagagggcagacaatgccttttatacctcttccccatccttatgtattggctgcccttgcgtacatctgctggcttgaatggaccgagaccatccgaatgaggccacgcgccatcaagtccttgatggccctccgagcagggaagccgtgatcctt

SEQ ID NO: 21050 - DNA, 285 bp, Zea mays
  Clone ID: cC-zmle18900074b12a1
aaaaggggggggtgacaacacatatttggttgcacttaattgcccctcctttattcggcattcacggatatagatacaaccagttgcgttcgagcttccagctccaaaatactcttgctaacagttctggcagctgaaacaaaacacctgaaatttaacgatccatgacataattttacaaattttcccatgaccgagtcatctatgaataacttgccctcaccaacaaaaaaaaattggccctgcctacagataaatacaggaaaatggccccgaggccaatct

SEQ ID NO: 21051 - DNA, 515 bp, Zea mays
  Clone ID: cC-zmle18900074c02a1
gaacagcctgatatatatattaggtaggggtcgatcgaatctctgtgctagctgtacgtacgtactacggatatatagattcaatacagacacgacacgcgtaccaggcgccgccgaagtcgaaagagccggggcggcggatggggaccaagccgagcacgtccgtgtagaagcgcagcgacgcctccaccgaccggcacacgatgctgatgtggttcagcgacgccagcggcagcacgccgccgccgcagcttgccgcccccatcgtcgtcgtgctcttcaccatcctcctgcagcgctgttaattccgatccgcgctatctatctggtcgatcctgctgacaacctatagctagctgctgctgctatcaactggtatcagagagcagggcgtgggtaaccaaacaacaaccaatatcggtggagatagctgagcgagtgccacagcaatgcaagcactagatggatggtcccgttgcaacaacaagcaacacctacgcacgatacgaatagtt

SEQ ID NO: 21052 - DNA, 530 bp, Zea mays
  Clone ID: cC-zmle18900074c02d1
gagaccaaactattcgtatggtgcgtatgtgttgcttgctgtttcatctgaccatccatctagtgcttgcatggcgggcgcactctctcagctatctccaccgctattggttgttgtttggttacccacgccctgctcttttgataccagttgatagcagcagcagctagctataggttgtcagcaggatcgaccagatagatagcgcggatcggaattaacagcgctgcaggaggatggtgaagagcacgacgacgatgggggcggcgagctgcggcggcggcgtgctgccgctggcgtcgctgaaccacatcagcatcgtgtgccggtcggtggaggcgtcgctgcgcttctacacggacgtgctcggcttcgtacccatccgccgccccggctctttcgactttcgcggcgcctggtacgcgtgtcccgtctgtattgaatctatatatccgtagtacgtacgtacaagctagcacagagaattcatcgagttatataataatatatatattaggcctgttcaacct

SEQ ID NO: 21053 - DNA, 444 bp, Zea mays
  Clone ID: cC-zmle18900074c03a1
tttttacttaatataatctaattcatcgcgacccaatgggggcgcgctttccttgcaccgagtgtattcacatttagacttttttgtagtagtacatgaaagtgtaaacgccactgctatagcccaatacaaaactgctatgtttacattgtgtttgacaactattgagatatgcatacaacaaacagcataaacaagaagccaagccaagccaagcaaagttcgctatcagctcttgcgcaggtttctgcttgcttgagcagcaagtgccatcgacctcgcgtcgatgtcattcatcatgtagtccctttcagctcggcgccgctgctgcctttcccgtttggccctcttgggtgccagccttgcttccctctccacataggccagcctgaacctttccgctatcggtatttcagggggagcatttggattgggaggagcaac

SEQ ID NO: 21054 - DNA, 336 bp, Zea mays
  Clone ID: cC-zmle18900074c04a1
ctgggatcctctagagggccgccctttctttttttttttttttttttttttttttttttttttttttttttgggggtgggtttttttttttttttccttttttctccttttttttacgggggaaaaaaaaaatttccccccgcccggggaacccccccgggaaaaacaaatctttggttttgcctatgacccccccctttatgtccaaaccggggaactttattgccttgcccacactgcccataaaattttccctcgaagaaaacgaccaataacactggggcaaaaaaaaaaacctttggcccaaaaaaaaaaaaacaatagaagcgggggggg

SEQ ID NO: 21055 - DNA, 418 bp, Zea mays
  Clone ID: cC-zmle18900074c05a1
ccaaagcacattattcttcttcacagttgtatatgtatatccgcatgtggactctgttggtgtttgcgagctcgcatgtgactcattttccgggacatagccttacaccctgatgttttggttccaccttcaaaatcagatacacagaactagactcatctccctaacataatattattcatacgagtttatttgcactgtgacatgctgacaacgatcgacgatgtcatgcaagggaaatcacatcctgttgaaaataattggagcgccatgctgaggatgcagcagaaggacggtgtacggcgcatgcgtgtaggaaggggacaggcggaactggaagcgctggaggatcatgctgagggccatcttggcctcgagcagcgcgaagttctggccgatgcagatcctcgggccccag

SEQ ID NO: 21056 - DNA, 396 bp, Zea mays
  Clone ID: cC-zmle18900074c06a1
caaaaacgatgtcgtggatataacaaagatggcagatgtcatgccataaatcatgtcaatatatgtgcatactgaaccaataacagaaaacacaattgaaaaaacaaaatcatcagaacactttgcttctgctataaacatgcttcttatgcttctttgtagcctatacgtagttcctccatatgcttttatgattcctattcctacagctggcagaactgaatttgaagcagcagaacttattatctggagtcaatcatttttatgaccagttcgccaatgcagtgccaatgcacccttagaataacgtggtggtaacaggtaacttccactcagctcaatatcaagtttttctgctgcataatcatcctcagcacagaatcactttttcactac

SEQ ID NO: 21057 - DNA, 456 bp, Zea mays
  Clone ID: cC-zmle18900074c09a1
tttttgtttcagatactggattcactttcagaaatcggtccacatacaaacagagagcatacaacttgagacatgtacggtaaggttcgcttattatccttgtaacaacatcctacagccaagcaaggccaacatcaaagctttatttctctcaagttttgctcattatgcattggactgtatatatcctctaaccggaagacatgactacagctccaaccctatcgcgagggatgagacgcagctccgaaccatgtttcagaaacacgttgcctgcactttgctgggggttgatgccaattccatcgttggtgatgatggcgctggtctggggcgggaccttgaactcctgcgcggcgtacttgagcaccgcggtaaagggcgccgcctcgggcacgctgaacactttgaaagggagcttggggtcggaggtgaggatcatcttgaaagatacct

SEQ ID NO: 21058 - DNA, 360 bp, Zea mays
  Clone ID: cC-zmle18900074c10a1
gacagtaaatacagatgcacacgcaactatttattaacttatacgacatatagacagcactttgagtaactttaatacataattgactctatcagcacttcttttagtacaaaaatttacactgctcaagccctggagttacattagcaacgacacaggcacgaagtttaaacagattggcattgtcaagcggttgcattcatacttcttcacttgcactgctactgttgcttttccgaatgttgtacttgcacagggggcatgttgcattgatgtgaagccacttatcgatgcaggtgcagtggaaatggtgcccacaagggagtgggcgcacctctgcaccatcatcataagcagata

SEQ ID NO: 21059 - DNA, 257 bp, Zea mays
  Clone ID: cC-zmle18900074c11a1
ggaggcgtcctctgttggggtacctgtggagttctggatatcctttccggtagcaaccaattacagatttacaattgatctagcaaagggctcccctctttggcaagaataaacaagcctccatcgcctttcgagatccttaagtctttgtccaggtaggtagtcaagagccaggatcgagctctgttgttgccaggaattggtaccttgaggggtggctgcccacaaatggacccagcaatgctagcaaatgcttg

SEQ ID NO: 21060 - DNA, 288 bp, Zea mays
  Clone ID: cC-zmle18900074d02a1
aggattgcgtttttttttatttacctccccacccacaccctatttcctctaatttccattaatttcacacctttgacaaacaccaactcattaaagtcagccaacaacacccccccgcaaaaaaaaaaatcaagaactcacaccccccaccaccaatataaacccaaaaatttggacaacaaccaaaaaaaaaaaaaccttaacgccctgcctaaaaaaaacccccaaaattaacccctcccttccctccccaaccaaattcataaccgaaggctgggggaaaaaata

SEQ ID NO: 21061 - DNA, 452 bp, Zea mays
  Clone ID: cC-zmle18900074d03a1
tttttacttatatataatctaattcatcgcgacccaatgggggcgggctttccttgcaccgagtgtattcacatttagacttttttgtagtagtacatgaaagtgtaaacgccactgctatagcccaatacaaaactgctatgtttacattgtgtttgacaactattgagatatgcatacaacaaacagcataaacaagaagccaagccaagccaagcaaagttcgctatcagctcttgcgcaggtttctgcttgcttgagcagcaagtgccatcgacctcgcgtcgatgtcattcatcatgtagtccctttcagctcggcgccgctgctgcctttcccgtttggccctcttgggtgccagccttgcttccctctccacataggccagcctgaacctttccgctatcggtattataaggggagcatttggattgggaggaacaacaggtctt

SEQ ID NO: 21062 - DNA, 520 bp, Zea mays
  unsure at all n locations
  Clone ID: cC-zmle18900074d03d1
cccacgcgtccgatataagattgctgctgcaaatcttgaggtcttcttttaagcacttggtgaactccgcttatgctggagagttgaagaacttctgctgaagaagaaatcaatcactcttggtgactccctggagattcattctcagaaggtagataaactaaaggttttagcagattccctggcatgttcatcctccaaagcagaacagcgtattttggagcacaggcgccagaaagaagatgctctcaactttcgtgtgaaaaaagagaatgaagtcagtgtttctgaaaaggaattgcttgatgagattactgaattggaaaagcaaagagatgagcttgaggcacagctgaagaaggttaatatatcactaaatgctgctgctggacggctcaaacaaactagggaagagagggaccaatttgacgaagcaaacaatcaaatcatatntagcttgaaaaaaaggaggatgacctctaaaaaccattgccttatgtaatgtggaatccaatgttgt

SEQ ID NO: 21063 - DNA, 362 bp, Zea mays
  Clone ID: cC-zmle18900074d04a1
ccaaacaaaaaacttggttattgaactataactcataagaaatctaaaagagggcaccaccaatgatgggttgttggtagaatgctgctgggtttgtcaaagcaagttggttgaatggcagcaattgttgcagttgtaagagggtgccagcgttaggcgcagcgtgctggtagaacggcaacaactggggttgtgtcaagaaggtagcagggctcacaccaactagctggctgaatggtagtagttgttgctgctgtaaataagcaggagagttcaatgctgtcagttggttgaatggaaaaaattgctgggggtaggcagcaaatagctggctgaatggtacttggtgttgttgcaaataa

SEQ ID NO: 21064 - DNA, 438 bp, Zea mays
  Clone ID: cC-zmle18900074d05a1
aattggccaacgatatttgagtttgactgctcctgggaacgactggaggtgtctacaaagaggatcttggagttcaaacagagtacaaagctcatcatcacatacccagaacacacaatctggtaatataatcctcatatacgataaaggctactcttcgcctacagatcactctaatgacagctcgaattcaatgcacactgctctacatgaactatgaaattgccatgcatactagtgacttattagtgcaggtgtcttgccaatgcgctacgccgtgataaaacaccgttggcatccctcagactccttgtccttctgtactcaatctctgcgtctgagcaagaatggccaggaggagatttcttccttacctctatcggatttagagatatttcatccgttgtccttctgaaaggatgaccatctttcgcaata

SEQ ID NO: 21065 - DNA, 303 bp, Zea mays
  Clone ID: cC-zmle18900074d06a1
ggaaaaaaaaagcacttatcatttctcctcggctggcaacaaattattttccccttacaaaatgaccgagcaaaacaattttttaaacgtacatcgccaacgtgcaactgaactcccgtaacgtacacaaggtctacggactacgagaacaaaaaaaatgtgacatcttgcgttattttctgtttcccgggggttgcaaatcaacaaaggcaggaaggggacggcacaccattacacgggtcaccttctacaggctttacggggtggcaggtgggggtgaaacacagatgactacttattttt

SEQ ID NO: 21066 - DNA, 441 bp, Zea mays
  Clone ID: cC-zmle18900074d07a1
cctcttctcttttttttttcttttctttttctttccttgtggttgtgttttttttttttcccctctctcccccccccctctttcctttttttcctcaccccctttttctttcccaaaaaaaaaaccctccccccccttaaaaaaaaaaaaaaaccccccccctatttttccccctctctaaaaaaaccccccccccataaccctcctaacacccctctttcccccccccccaaaaaaaaaccccccccctttctacccccgaaaaacccaacaccatcccttaaaccacccaactttcccctataggaggcgcaaaaaaacccctcccaacccaaataaaaaccctcccccccttaaaaataaatttcccccccccaatcccccacaaaattcatccccaaaaaaaaaattttaaacccccgcctccccaaaaagggggcc

SEQ ID NO: 21067 - DNA, 291 bp, Zea mays
  Clone ID: cC-zmle18900074d08a1
catggagagaaatgttactgacaaatgggtttggatagttggaaaggaactacagagcgagcacatattatgccctattgtaatagaaaatgacaaggagaagaaaacacattcatcttaacataaaaaatgtttattagtcaaaatgagagcaggactcgacagactagtactacaaaatcatgagagtgcattcccggccattatcgtaaacggaattaccggaactgcaacacagagatgggtgcagaaggaagcaatatctgcaacagttgcgacagtggtctgtga

SEQ ID NO: 21068 - DNA, 399 bp, Zea mays
  Clone ID: cC-zmle18900074d09a1
ttttgatttagaatgtcatatcattatagaattttaacggaatactgtatctgtatctttgccgacaccctcttttgctgctatatactacaaaagagctaagatacataggatcgtgggaatgtacagtacaaggaagtgttgcatttttactgtagagattgctgaagaccccacacaaataggccttcttgtgctctcatttgggtggcagtagaagagattttaggttttacaggctcgtcatcatccatcaccgttgctccagcccccatacttctcttaggagcgtgtatcttgtattctccatggaaactcctctcccagcactgaagtgtgccaaaccgttcgacggagaaggtggggcgctcctgtcgattagggatgcgaggggagaat

SEQ ID NO: 21069 - DNA, 295 bp, Zea mays
  Clone ID: cC-zmle18900074d11a1
acaaaacccaaagcatcactggggagagtggcgataacaaagtgaaggcacacacgaacataaaaatccaacaccgccacttggcagacctcaaaaaaaaaaaaaatcattgcttacaatagtctccaactggcatgccaaacgtaatggtaagcggctaagtaactccatgtgtccatgaactcaaagccggatgcacatccaccaggctaacatttgacaattgacttccccagactttttttactacgttacgcatcggaagacatgactggctggggaaacatgcaggcct

SEQ ID NO: 21070 - DNA, 484 bp, Zea mays
  Clone ID: cC-zmle18900074e01a1
ttttttttcttttttttttatttttttatcttggaaaggaaaatttttaatattaaaaattaaaccatcacttttataacatttaatcataaaaataaaaaaaaaacacaaaaaaaaaaaaactaaaaaaaaaaaaaaaaaaaaaaaaaaaaaaaaaaaaaaaaaaaaaaaaataaaaaaaaacaaaactaaaaaaaaaaaaaaaaaaaaaaaaaagaaaaaaaaaaaaaaaaaaaaaaaacaaaaaatcccactaaataaaaaaaaaaagaaataaaaaaaaaaaaaaacctctaatgggagaaaaaaaaaaaataaaatattataaaaaaaaaaaaaaaaaacttttacaaaaaaataaaaacaaagacaaaaaaaaaaaaaacacaaataaatttcaaccccaaaaataatttaaaaaaaaaacaaaaaaaacaaaacaagatcctccaaattaaaaacaaaacaaacataaacaacacgt

SEQ ID NO: 21071 - DNA, 608 bp, Zea mays
  Clone ID: cC-zmle18900074e01d1
ccgtccggctcccccgacgccggcaaggccaggaactggctccttttttttttcgacggcgacggttccaccacatgggggggggtcccgcgcaacgccgacaggaagctgagcttcacgccgtccacgccgcagccgaccctgccgacgaagcgccgcaagggcatcccgcaccgcgccccgttcggcagcctcatcgtcgagtactagaatctccttctcccccagccatcgctgtccacgtccgttgcttctgcattggcagttggcactacacgcgcgcggtagagtggaagtactcttcaaacgacggaatggaatcgcacagtgagccagtgaatccagattacaggcaagccaataggttggccaccacttgggtggcctggcccgcctttctttgccacggcacttcggttggtgggtgcttatcgaggtggatgccatttgctcgctggcttcgctttccagaaaggggagggaggaaaaaggaaggtggatggattggatcggacatcggaggaagaataaaaaccgccttttatcactgttcacgaaaatatggttctttctggctgagaaaacatgtaaattttaggtcttgctct

SEQ ID NO: 21072 - DNA, 83 bp, Zea mays
  Clone ID: cC-zmle18900074e02a1
ggggggggttttttttttttcacaaataataaacccatgggtgacaaaacaacaaaactgcccacccctcccgggacccgtgg

SEQ ID NO: 21073 - DNA, 155 bp, Zea mays
  Clone ID: cC-zmle18900074e02d1
tgaaccccccctgtaatcggcccattaaactcgtcggttttggtgttttaccctcagcttgaccgttacatttgccagccccctaacacccgctcctttccctttttcccttcctttttcgcccgttctccggctttccccgtctaagctttaaa

SEQ ID NO: 21074 - DNA, 432 bp, Zea mays
  Clone ID: cC-zmle18900074e03a1
ttttgattctacaggatatcccatgagtaagaaggggaggggggcgactacatgttctagctgtgcaatccatcatacacgtgcactacattagaataaattacgtgtccactttccaggaacccacggtatctgcaaacgccccataggatcattgtgatttcttcgtctcgacagttgcagcccatgtgacggggtgtttgttgaacataggccacggtgggatgacgaccagagcgagggccacggtggagatgccgaagatggcaaacgtgagttggagggactgcgctacgaacccgatgatgaaggacacaagggtgatggcgaccagggcgatttttgagatgttttcgaccgatttttggccctcaaagtcaattcggcctttgaacagatcctggaaagagttcgacatggcgttctcgaata

SEQ ID NO: 21075 - DNA, 499 bp, Zea mays
  Clone ID: cC-zmle18900074e03d1
cggcatctgccttggtactcgacctccacgctgtcgacacttttttttcacgcctctatcgctctgacgggggggggggaacgccatgtcgaactctttccaccatctgttcgaaggccgaattgactttgagggccaaaaatcgttctaaaacatctcaaaaatcgccctggtcgccatcacccttgtgtccttcatcatcgggttcgtagcgcagtccctccaactcacgtttgccatcttcggcatctccaccgtggcccttgctctggtcgtcatcccaccgtggcctatgttcaacaaacaccccgtcacatgggctgcaactgtcgagacgaagaaatcacaatgatcctatggggcgtttgcagataccgtgggttcctggaaagtggacacgtaatttattctaatgtagtgcacgtgtatgatggattgcacagctagaacatgtcagtcgcctgcctgaaattcttacttatgggatatcctgtgcatt

SEQ ID NO: 21076 - DNA, 207 bp, Zea mays
  Clone ID: cC-zmle18900074e04a1
cttcccttccttttttttctttttttttttaaaaaaaaaaaaaaatccccccccataaggaccggggaggaaaaaccacacaaaatcttgttcatattccaacccccctaaaaaaaatgccggcccccccccccccctgaaaaaacccaaacaacttttcctttcctacccaaataacaatggccaccccccccccggtactttccc

SEQ ID NO: 21077 - DNA, 407 bp, Zea mays
  Clone ID: cC-zmle18900074e05a1
ttttgatcaaaattttcctcaattgccattaagggcgggaacagagtacattgttcttccattcagagatcaggtcacacacacgcacagagacagagagagagagagtggagctttattttgtttcggtctacacgatggtactcagccactgtaacagttcagtcacggtactcagccatgaacgcctcatggaaagccttgaagcgggtgatcaccgcggggattttgtcttcctgcggcaggatcgtgcatctgacgtgccatgttccaggaacttggccaaatccagatccaggaaccacaacaattccagttgattcaaggagacggagcgcatagaatgcatcatgtgctttcttggcagctttagcagcctcaattgccttatggggcagatggatctg

SEQ ID NO: 21078 - DNA, 438 bp, Zea mays
  Clone ID: cC-zmle18900074e06a1
attccagcgggaggggtatatctcacactaaagcatcatcatgcacattgagtctatggctgtaacagctagctagtaatagtcaccggcaattagtacagtagcgaacatataagcactgctgcacgagctacaagcggtggtgggcgcagggggcactgccgtcgtcgaacttctggtagtagctatgcaggtcatacccgaacctcaccgcggttcgcctcggccgcgctgcgcgtcttctccaagagcgactcaacctctacagcagccgcttgaccgccgcagctggccagcggccaccgctcctggcgtggacgagcctcccgcccaagccgctgcccccggtgtacgggcctagcagagacaccgccgccatgatcgttcactcagtccttttcacaggtcacggacgctctttgcactaaccaactagct

SEQ ID NO: 21079 - DNA, 297 bp, Zea mays
  Clone ID: cC-zmle18900074e07a1
tttatctttataaatctcaaccaatatattgagtatgggtaggaaacacatgccggtatgagggcaccattatcgagtacatctcatatgtaatctaaaagatggcacctccaacgatgggttgatgcctcgacaagacatgattcatcaaaaagaaccgattgtatggcatgaattgttgctgctgtaggaaggcagagaccaatgtgttagccactgccaatggattaagtgactgtagtcgctgttgtaagtacccaccagagttcaacatacttacttgatttaatggaaaca

SEQ ID NO: 21080 - DNA, 365 bp, Zea mays
  Clone ID: cC-zmle18900074e09a1
gttcagaaaggagaaagcatgttaatgggtccggactccattggaacatgggaattgggaaggaaagaacagcagacgagtacacatggatggaatccatcgaccgatcagcacaagtcctgatccatccagctatatgaacagcggcaagaggaggaggaagaagaagaagaagaaacatctcaacgatcatctagtgaccttaattattacttatcaagcatcggcggcgagatcatcagctggtgaagaggaagctggcccactgatccacggctgcctcaagccaccgcctgggctcgtccatgagctcggggctgaggcgcaccatgaggacgccgaactccatctggctgagcgcaccg

SEQ ID NO: 21081 - DNA, 347 bp, Zea mays
  Clone ID: cC-zmle18900074e10a1
ccctaggctcctataccatcagaccgcccgctgacatcgtggtttttattttttgcaaggagtccaaggcgttgggggagggctagaagaactcaaacaagaagctcaccgcgtggttcaagaaatacccacccaacagcgcccctgtcctattcatcaacgccaccattgaaaagaccaagcggcggttcgagaactacagtaagttctgcctgctctgcggcgccgacagcctgccgtaccatatcgggagctttgaccatgtgaactggggcgagttcttacaccccgggcctgctcttgctctacatcgtcagaaagaatcggatgggtcggaaggagctacc

SEQ ID NO: 21082 - DNA, 298 bp, Zea mays
  Clone ID: cC-zmle18900074e11a1
aaaacaaaaacttttttggggagggttttttttttttttctaccctttctccacccaaaaaaaatactcaaaatctctaaaatgccccccccacctttaactcattaccattaacataacactcccccactcttgacaaaaatatcacactaaaataaagaccacctcctcctccatataggacaaacaatgcattttatacctctcccccatccttatgtatttattgccctgaaatacatctgctttctaaaaaggaccaaaaccatcctaattaagccacgcaccctcaagttct

SEQ ID NO: 21083 - DNA, 306 bp, Zea mays
  Clone ID: cC-zmle18900074e12a1
ggggatgggtttttttctacaactcacactatacattactctttcttaaaaaaaaaaaacgaactcaaatcccacacaacccgaccaaccggtctttttttaaacaaaaacacactcctcataatctcctattactgctgacacgggtagcagtagaggggaaacaaatttcccaatctttttacggagctgggcgacaccacggagtctccttctacgtaccatatatacaacataccggcgacgctcccgaaatccaccgcatcctggcccagcccttgccctccgtaaagaaggccatctcct

SEQ ID NO: 21084 - DNA, 306 bp, Zea mays
  Clone ID: cC-zmle18900074f01a1
aacgtacctgaatgaaaggggtggggcacatgaatgcatataaacgagaatattacaaactaaatagtgctacgcgatagcgaatttaacacctagcggtgaggcgttgtacaattgtgtacgcaaacactagttattaatatacgactgcgcgcaataattacgcttctcgaatctaacgcaaacattacgaacaacaaattatacacatgaaatacaattagcctaatcacaacttatcagttaattaattaaattctgaattaatcccccacgcgtccgcccacgcgtccgcccacgcgttcg

SEQ ID NO: 21085 - DNA, 341 bp, Zea mays
  Clone ID: cC-zmle18900074f01d1
cgtccgcggacgcgtgggcggacgcgtgggcggacgcgtgggggttttatttcataatttaattaattaactgatggggggggattaggctaattgtatttcatgtgcataatttgttgttcgtgatgtttgcgttagattcgagaagcgtaattattgcgcgcagtcgtatattaataactagtgtttgcgtacacaattgtacaacgcctcaccgctaggtgttaaattcgctatcgcgtagcactatttagtttgtaatattctcgcttatatgcattcatgtgcataatgcatttcattcacgtacgttaaaatataaatactctacttctttaaag

SEQ ID NO: 21086 - DNA, 374 bp, Zea mays
  Clone ID: cC-zmle18900074f02a1
gggcgggacggggtctacatttttaccattacgaataataaccacaaactgttaaaaagggttaacataacaaataaaccagacttatagcctggccaacaggacaaccgataacgtgccaaaaacctccaacaatagtgaaaattaagctatcacaggtagcttaactagggataaaataaacggaaagcatgccatgccacacttaatcgacctcctccatcttgctttcaccagcgtcgtcctcaagctgaggcatttcatcctttgcctcaacaggctcgtcctcatcgatgcttaaaccgagtttgaacatgccgtggatcccgttgccaaaggtgttggggtcatccaggctgaatcccgaagttaag

SEQ ID NO: 21087 - DNA, 509 bp, Zea mays
  Clone ID: cC-zmle18900074f02d1
ggccaccaaggagggtctgaagcttgatgagactgaggatttttttagaggaaggaggagctgaatgagggggggatgggctgtgcaaggtcatcaaggacgttctgggtgacaaagttgagaaggtggtggtgtctgatcgcgttgtggactcaccgtgctgccttgtgactggcgagtatggctggaccgccaacatggagaggatcatgaatgcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatcttgtgatgctgttgttcgagactgctctcctgacctccggctttagcctggatgaccccaacaccttcggtaaccggatccaccgcatgctcaaactctgtctgagcatcgatgaggactagcctgttgaggcctaggctgagatgccttacctt

SEQ ID NO: 21088 - DNA, 318 bp, Zea mays
  Clone ID: cC-zmle18900074f04a1
aaacttgcaacctctaaaccccccgccctccccccccctctctcttttccccccccccccccccccctctctgccctggtctcaattacactaccccctcccccccctcccactcctcttttccttccccccccccctcccacccccccaaaacaaacccctcctttttttccccccaaaaaaaaaactttacaacccccaaccccccccaaacttttccaaaccccaaaaaccacaccccccccccttttatcccccccccaaactaacaaaaaacccctccccaaacaaaccctttgtgggggggcgggaagggcc

SEQ ID NO: 21089 - DNA, 221 bp, Zea mays
  Clone ID: cC-zmle18900074f05a1
ggtactgtagactaaaaaagggcagggcaaacgagtaaacaatatcacatttcataacatctgatgagcaacatcatcgatgtagctcacataactacctgactacgcgtagagctggcaggtcactggaacttggaagcagaccttgacggtcggcaccgcatcgagccctacccgaatcttgtgtggggccgaagctgagatcttcttgcctgggccac

SEQ ID NO: 21090 - DNA, 232 bp, Zea mays
  Clone ID: cC-zmle18900074f06a1
atattgggggtgggttttaacaaacaatggaaaacaaacagtatcacgagcttcaactcagaagtctacaattcataaaccacggataaaccacgaacatatcagagggttatgttgtgctactgataattcgactatagcttgcaatacatcttttagcaaaggcaaactctgacccacatctgctggccccccagttacacgtaactgtctatcagagacttcctcatgt

SEQ ID NO: 21091 - DNA, 267 bp, Zea mays
  Clone ID: cC-zmle18900074f07a1
agatggggatggcgcccgtgaaaggtcaccggtgcatgctgctttgcttcagggaaacaccggactttacaggtagagtgtactactagcagtccacttcacatatctgcgagctagaccttaaagattgaaagcttgcatttgccatcgaagcttgaggaccaacaacaaacaacgactcacgcacgcacgcgggatataaacaagagccgatgactgtgcgctcaagcgacgcacaccggcgggtctcacgggccacgcctaacg

SEQ ID NO: 21092 - DNA, 215 bp, Zea mays
  Clone ID: cC-zmle18900074f08a1
ttttgttcagaactcaggcagagcacaaattggctgggcagttattatgatacatcacacagccatgatggtcactgtttaatgttgtgcaccattcgactaactagtaaataacagaaccaccaccatccatcaacttgaatcaacattgtgcatagttgtgccagcccagtagacattacgcagaacagtacatgtggcatgatataatctgg

SEQ ID NO: 21093 - DNA, 375 bp, Zea mays
  Clone ID: cC-zmle18900074f09a1
ggactaggagctggggaacgggacatattatttcaacatggtacccgtacgtacagcagacaaagcaactagttacagtgccttgcgggaagggcgccgaaaatacaagccttttcagccgaggcaaatggtaaacaacagcaggcatgcttgatgaacaagagagatggaaaccaaaaaaaaaaacgaagatacaaaagggctctactgtactactagctaggtctgttcttgtcccaaagcaagctgctcgatggagatgcagttgcaacaacaaggaagccctctgccggtgcagcaggtaggtagccgaggttgagttagcgccttgacacacgcggatcggagctggtcacggcggaaaagggaaacaaa

SEQ ID NO: 21094 - DNA, 467 bp, Zea mays
  Clone ID: cC-zmle18900074f10a1
cgcccctaagcttctatacctgctagaccgcccgcccttttttttttttttttttttttttcctttttttattcttttggggtgggcttttttattttataactattcccccttcccttttccttattctccaaaaaagaaaaccccttttatatttaaatttcccaacccttaacttccttcctggacacccccaaacaaaacttcatccaacccaacttatttaccacccaaaaaaccaaaaaccatttcccgaaccctttcaaacttccaaccaagctcttcctttattaaacttctttgtggagggatagacccccaaaaaaaaagccgtggcccccaacttaaaccccccttttttcccccccaaatttttttaatcccaaggaccccccatcttgcccctttaacccctcaccaaaaaaacaccccccttgggccactcaccacccttagaatcttaaaaa

SEQ ID NO: 21095 - DNA, 397 bp, Zea mays
  Clone ID: cC-zmle18900074f11a1
gcatatacaaatataaatctaaaaactttccatattaaatatattcatgcatcctattttttttgagaaattgctatatcagggtatcaacgtgtcatgtttccatataaccgaatcgtacaatcccttccttaccaagcatgtacatgatacacatgatcctatatcttgtcgatgacaccgcaataagcaaccctccatgctttgtttaacaacaagacacaaaacacacgccaaagacccaaaatctagcccaaacttagtcctacataaaaagacactacctcaaaaccatgtccatggacatgtaggcttgatgaattgcttgctgaaccgatcttcccaatagtatgcccacatagaccactattgccactgtacatataccgatactctg

SEQ ID NO: 21096 - DNA, 267 bp, Zea mays
  Clone ID: cC-zmle18900074f12a1
tttttctcttttttttttttttttttttaagggggggggtgtacattaaataattttttttacccttactccccctcttttattttttttttactgatataaatacaacccccggcgttcaaccttcaaattccaaaatactcttcaaacactttcggcatttgaaacaaaaaaactgaaattaaaccatccataacataatattaacaaattttccctggaccaaattattatattaaataacaatgccccccccccaaccaaaaa

SEQ ID NO: 21097 - DNA, 618 bp, Zea mays
  Clone ID: cC-zmle18900074g01a1
ttttgtttatttttttatttttttttttttttgggttggtttttttttaatatttttatttttaataaaaaaaattttttttatattattaaacaagaacaacaaaaactaacaaaacatcgaaaaaaaaaaaaaaaaacataaaaataaaaaaaaaaagtcaaaaaaaaaaaaaaaactccttaaatacaaccaccaaatctaataaaaaaaaaaaacaataaatcaatcaaacaaaaaaaaaaaaaaaaaaaaaaactcaccactcctcccaaaattttgtataaaacaaaaaaaacaactctgggggggggagagaaaaaagttatacgtaaaacaaatccacacaaaaatcaaaaaaaaacataaactagtaaaaacaaagctagccttaataaaataaaactaaccttactcaaaataaaaaaaaaaatcaatatgtcaacacaaaaaaataataaaaaaccaaaaaaaaaaaactttatataccaaaaaaaaaaacaaaaaataattaaactcacctatactatatttaaaaaaaaaaaaaatcttcttacaaaaaaaaaaaataacaaagatttaaaaaaaaatatttctttcctcataaaaaaaatacaa

SEQ ID NO: 21098 - DNA, 597 bp, Zea mays
  Clone ID: cC-zmle18900074g01d1
ggcgatttagaccaactagcgacatataaagcacaatactgttttctttatggcagccaaaatattttgcctcggtggctccttggtatttctgcaagtgctgctaccgcgaccattttcccgcaatgctcacaagctcctatagcttccccttcttcccccgtacctttcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccatttaaccagctacctgttgcctacccccagcaatttctttcattcaaccaactggcagcattgaactctccttgctatttacagcagcaacaactactaccattcaaccagctgcttgtgtgagccctgctaccttt

SEQ ID NO: 21099 - DNA, 452 bp, Zea mays; identical to SEQ ID NO: 21061
  Clone ID: cC-zmle18900074g03a1

SEQ ID NO: 21100 - DNA, 224 bp, Zea mays
  Clone ID: cC-zmle18900074g03d1
gcccacgcgtccgcggacgcgtgggccacttggaaggggtttttttcatgatagtattatcaatagaaaccgggggggaataatgtcgtgactatatatatgtctgatattaagactagatttgataagggtggcataacaagtcctgatattctgtgtgcattcagaatatctgcttttatgcccttgcgttgatattttgcaaaccaaaacaaactgttctg

SEQ ID NO: 21101 - DNA, 359 bp, Zea mays
  unsure at all n locations
  Clone ID: cC-zmle18900074g04a1
caggggaccataaaagctcaatgaaagggtaaaactagcacggacacacttgccaaataaatccaggggaacaataccagaccacatgggctagcggcaccacaaagcagattacttcgaccactaccagcctactaacaagaaaaaagaagtgaatggagacgaaatcagctacaataatggcacagcacagcttccacagcctagagcatttaaaacattggggctcgaacaactttgcaccccctgcgaagattactgtacctggcctgattaccttgnggggcatgtttgaccttataaagaccattctgccggaggtgngatgttcaaagggtcaagtgatccctcaggagttg

SEQ ID NO: 21102 - DNA, 376 bp, Zea mays
  Clone ID: cC-zmle18900074g06a1
ggatcctctaaaactggggcatggttttatttgtattaaaactgatcagctggaatagtttcaggtcttaatcacagctaaccgaacgggatctgaaacagatagtacagtattgtgagtaccctaatccggagctttattacacggtggttcagagtacaagagcacagcaagtctacatcgagcgccgcagggctagtcggcggcggcggctactcgaagttgtagtgcttgtcgacggcctcggcgacgtcccaggtgcagctcatgcccttggggaagacgacaaggtctcccgcgccgatctccacgaactcctccccgtggccttcggggtacaccttcacctttccctgcaggaggtagcacgtctcct

SEQ ID NO: 21103 - DNA, 231 bp, Zea mays
  Clone ID: cC-zmle18900074g08a1
gacccacataaaaacaacacgggctgggttaaatttccggtacatcaacaaaaaacacacacattgaatattcacttaccaaacccaaaggaccaaccataatactccgtaaatgataatatcaactcatatccacccaataccaataacaagataccacaagcttgctatgctatgttggaagcaaccactatgacactccaacaccccacttgcaattccacgacaaca

SEQ ID NO: 21104 - DNA, 390 bp, Zea mays
  Clone ID: cC-zmle18900074g09a1
agaagggtataattcataattgcggtaaggaagaaaaggctaatgtgtgtcctttctttctcgcaacaaattcacgtgcagagagacaacaacttcctgaaagaaacgattatatatgtctttcatcatatataatgtatgtacatcgatagaatgaccacgagccaaacgattcgattgatctccgcaatactacgtacaatgcaatgcaaactcatgaccaccagattgcttgagctgaacaatacaatgaaggatcatcatcagttgacttcgacgttccattgctcgctcttcttgagctgcttcttgtagtccaaccagttcatcccgtccttggctgcgaggtcgagcatgatgtcatcaatgcccttcttcatgcccttgagc

SEQ ID NO: 21105 - DNA, 266 bp, Zea mays
  Clone ID: cC-zmle18900074g11a1
catggccgttttttttttttcgaaaaaccagacacctgctggggagggggcggatagcctaaaaggacttgaacacgaccataataatccaaccccgccagttcgcagtaaagcagcgtcgaacgctctggctgagagtaaacaacagctccatgagaggtcgaaacccaaaagcctgaccgtcagggcacatgttaacagctagcctgcttctccgggactcgccaggaaaggacacactgggaaaacttgggaacaatattacc

SEQ ID NO: 21106 - DNA, 335 bp, Zea mays
  Clone ID: cC-zmle18900074h01a1
ggggttgggtttttattattacaaaaaaattttattcaaggcacaagcttattggcggaattcgtacaggaactgagtgcgtgcaccttccatagccaagtaccaagaccctggccaaccaggcaaccacaaacatacataaggcacgcaggcaacccccaaccggcctggattcccgcccccgggcggcttaatttgccctggggaggaaactctccctgcgctccgggacccccccggggcaggggttgatgtcctcttaaaccctgggggcgcgcaccacaaaaccggggccgccggggggaccatgggggtgggggggggtggcccccccc

SEQ ID NO: 21107 - DNA, 511 bp, Zea mays
  Clone ID: cC-zmle18900074h01d1
cccgtccgcacacagcaatccacacaagcacttcgacgtcacacgggtttcttctcacagacacaccaagcgtcggcgcggggggcttactaccaggaggtggactactgctcggaggaggtgaggtcggtggccccggccggcttcggccgtcacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatggtctgtggttgactggttgtgcagggtcatcgtacttggctatcgtacgtgcacgcactcagctcctgtacgaattacgacaataggctcg

SEQ ID NO: 21108 - DNA, 489 bp, Zea mays
  Clone ID: cC-zmle18900074h02a1
gggcgaaacgttattctttggggtatggcatgcgggcatatacaggcacgaaagatttgggggtagcaatgtagaagaaagcaaaaaaaaattgtcgatcctgtaaactgcagctaatcaatcctacaccacgccgtctgctgaatctcgttgtgttcatcaccactggttatccttgctcgatgtttgctgtttactgctgctactagcgctgtgtgttctcctcttccccctcagagcgagccttcgaacgagacccgcagctgcaccgccggcctggaccgctgctgcgacggcgcgctggccaagccgtccagcatcttgaccacgtccaccgtgtcgtccaggtagtacctggccatgctcggcttcttgcccaccgtgcacgcgaacaccttgctgctggccggcagctttacgccgctgttggagggccggcacacgatgctctcgaacatgtcctcgtccgaccggtcgttgccgatgcac

SEQ ID NO: 21109 - DNA, 527 bp, Zea mays
  Clone ID: cC-zmle18900074h02d1
ggggacgcgtgggatatggccgtgctgtcgtgcagggcatttgctatggcgtggcagtggacagcctccggggggggatggtgaggacggggaagccgccggacctcgtgctgtgcattggcgacgaccggtcggacgaggacatgttctagagcatcgtgtgcccggcctccaacagcggcgtgaagctgccggccagcagcgaggtgttcgcgtgcacggtgggcaagaagccgagcatggccaggtactacctggacgacacggtggacgtggtcaagatgctggacggcctgtccagcgcgccgtcgcagcagcggtccatgccggcggagcagctgcgggtctcgttcgaaggctcgctctgagggggaagaggagaacacacagggctagttgcagcagtaaacagcatacattgagcaaggataaccagtggtgatggacacaacgagatttaacagacggcgtggtgtatgaatgattagctgcccttacaagaatcacaattttttttgctttctttt

SEQ ID NO: 21110 - DNA, 452 bp, Zea mays; identical to SEQ ID NO: 21061
  Clone ID: cC-zmle18900074h03a1

SEQ ID NO: 21111 - DNA, 451 bp, Zea mays
  Clone ID: cC-zmle18900074h03d1
tgcggggacccgctgagcttggagcccgtggcggacgtgcacgtgtatgacgcggcgacggggcggtggcggcgcggggcgcccatgcggtcggcgcgctccttcttcgcgtgcgccgaggccggcggcaggatctacgtggcggggggccacgacaagcacaagaacgcgctcaagacggccgaggcctacgacgcggaggccgacgcctgggacccgctgccggacatgttggaggagcgcgacgagtgcgacggcatggccaccgtggtcggcgaccggttcctggccgtcagcgggtaccgcacggcgcggcagggcgggtttgagcgcgacgccgagtggtttgacccggcggcgcgggcctggcgcaggctggagcgcgtgcgcgcgccgtccttcgccgtgcacgttgtcgttcgcgggcgtttagaggatccagcttacgtac

SEQ ID NO: 21112 - DNA, 327 bp, Zea mays
  Clone ID: cC-zmle18900074h04a1
gtggggaagccacaaacattaggaaaaaaactttattattgaactataactcataagcaatataaaagagggcacccccaatgatgggttgttggtaaaaccctgttgggtttgtcaaaacatgttggttgaatggcaacaattgttgccgatgtaaaagggtgccaaccttaggggcaacgtgcaaggataaccggcacaacctttgttgtgctaaaaaagcaactgggctcacaacacctagcttgctgaatggggacagtgtgcggtgcacacaagcaggaaagtgacatgctgccactggggtcgatggaaaaaattgctggg

SEQ ID NO: 21113 - DNA, 453 bp, Zea mays
  Clone ID: cC-zmle18900074h06a1
ttttttttttttttttttttttttttttttttttttgggttcttttttttatttttttctttataaacaattttttttattttttattattactttatttttacttacactatctttttatggtgaaaaaaaaacctctttttttcttggggccccctaacatacaaaaaaaaactttttttttaataacccacaaaaacccctaacaaaaaaagccccccacaccatctttctttacaaacaaatccctgcttttctcaaaaactgtcgacaatacaaaaccaaactcatatcctcttaaaaaagaatatcgctattcccccaaaatcctcacaaaaaacaaacccctttcttttttaaaaaaaaaaaaaaccctttttaccaaactaactcaaaaaaaaacaaaaatctccctgccaaaaaaacaaacgggaaacctgcccccccaccttt

SEQ ID NO: 21114 - DNA, 427 bp, Zea mays
  Clone ID: cC-zmle18900074h07a1
gaaaagttcatccaagatcctgggggggataacttttgcacagggcacatattttttgtctgtgggatatacatgaattgcactctctttattttaaaaccacagaactgccatcctcttacatcttgtcaggcttctgtcaggtaatatttgtcgatgaacatctgcctctcctctggcacagactccataaacatcaaatttgtgagaatatgtttttccttgctttcacctttagcaggaaaactattgattatgttgaagtcatcctgttttgcagctttgtgaatagttacatgattgcatctctctgattcgttgagttctttacagcgctcatttctgcaacatgatgttactcttccttttgcttctgattcattttcttgacccacttgattgaaggctgaaatagttgtgggctttc

SEQ ID NO: 21115 - DNA, 133 bp, Zea mays
  Clone ID: cC-zmle18900074h08a1
aacaaggaccaacaagagccatgggggtgatgcaactagaacaaatcgcaatgcttaactagcaatgatgaataagactatttgtatacatgcatcgatgttatatcgctagaaactcaacaacacatagctt

SEQ ID NO: 21116 - DNA, 392 bp, Zea mays
  Clone ID: cC-zmle18900074h09a1
cagcactaagaggattgccacggcaaggtttatcatcaaacagagttacaaagcaatgtataaagtagccagcaaattcatggcgaggagtaccatccatttccacactcaaaagatgcaacacatccaaggagaaaaagatcatccagacaatgagaactcaagagttcaccctagaacaacttaaaacacgcaaggcacaactcctgctcacgttcaagactcatgatcctttctactcagtcagatcatcatcggcatcaggaagaggttgtgcagctgctgcagcaagctcagcttcatgctgctgctgcataaccatgtcgatggtaacttccggaggcttaagagcaacagcttcaacaaagtgaaggttcggatcaccagccagc

SEQ ID NO: 21117 - DNA, 452 bp, Zea mays
  Clone ID: cC-zmle18900074h10a1
cctctagaccgccgcccttttttttttttttttatcttaccgggacccgtcctcttacggggtgggggtatttttttttatattctttcccccatcaaccaattacagatttacaattgatctagcaaagggctcccctctttggcaagaataaacaagcctccatcgcctctcgagatccttaagtctttgtccaggtaggtagtcaaaaaccaggatcgagctctgttgttgccgggaattggtaccttgaggggtggctgcccaaaaatggacccagcaatgctagcaaatgcttgctgcaatggattcaatgcctgctggactggccccaggcttatcttctgcccaaatatatcaacttgttgaggtatatccacggatgattatattgtccgaggcttaaagctccccttcttaaattggacccctatccttgatgggctttgaac

SEQ ID NO: 21118 - DNA, 467 bp, Zea mays
  Clone ID: cC-zmle18900075a01a1
cgaaaggctctttctttttatttgatccaaggagaacaccacactccacagctgagttttacatgcaaacggattgtaccaacttacagacaatgtcaatcatgtgatgaccttccaatgtgatcccttgtaacaggaaccaaatgggataatgatgatggacacctaacttctgttgctcccagctgtatatgactacaaaatatcaaactggttcagtgactgtgagcccaatttcaatgccacctatgcacattagcatgtgccttgcctgcactttatcagctacaatggaaactccatttgcagcagtacaggggggctcatagagaaggaactcaagccaaactttgaagtttctggttttaatgtagtactagcaaggttcaacaacacaacagtcaatagctggcttcatctgtctcaagccttcggaggtaataacgcagacaattgatcaacacctg

SEQ ID NO: 21119 - DNA, 572 bp, Zea mays
  unsure at all n locations
  Clone ID: cC-zmle18900075a01d1
catccccaaggttgatatcgatattgcaacacatatagttgttgaagacgttgggtcaaaaagaagcatgctttacatagggacaggggatcggcctggcctacttcttgagataatcaagatcatcgcggacacaaatattgatgtggagtcagctgagattgatactgaaggtttggttgcgaaggacaagttccatgtgagttacagaggtgcaaaactaaacagctcctcatctcaggtgttgatcaattgtctgcgttattacctccgaaggcctgagacagatgaagacagctattgactgttgtgttgttgaaccttgctagtactacattaaaaccagaaacttcaaagtttggcttgagttccttctctatgagcccccctgtactgctgcaaatggagtttccattgtagctgataaagtgcaagcaaggcacatgctaatgtgcataggtggcattgaaattgggctcacagtcactgaaccagttngatattttgtagtcatatacagctgggagcaacagaagtaggtgtccatcatcattatcccatttgggtcctgt

SEQ ID NO: 21120 - DNA, 260 bp, Zea mays
  Clone ID: cC-zmle18900075a03a1
ggcaaaaaaaaaaaacccccaaaaattaaccttcaaagcctccccccgtcatttgagggtttctaacccccgtcaaatttaaacccccccttcttcacattgccccgataaaattttttaatggaatgaaccgttttaacatgacccccctccccttacaaaccttttattaaacctttttttttcaaccccccaaaaccaccgctttttgcctttccttaacacaaaaaaacatgggcgctgcccccttaggctttgga

SEQ ID NO: 21121 - DNA, 449 bp, Zea mays
  unsure at all n locations
  Clone ID: cC-zmle18900075a03d1
gcgttaccgggtccgtctgcgacctctccgagagggaccatctgtagtttttgctccgcgaggttgccgaccgggtcgggggcaagctcaacatcctcgtaaacaatgtaggaacaaacataaggaaaccaactactgagtttactgcagaggaatactcgtttctgatggctactaatcttgaatctgcatatcacttgtgccaaattgcacatcctcttttgaaattatctgggtcaggcagcattatattcatatcatctgttgctggagcgataggaatctttagtggaactatatatgctatgactaaaggtgccattaaccatctaaccaagaatttagcttgtgaatgggctaangacaacataagagccaactctgtcgctccgtggtacatcaccacttcacttacggaaggaactttggcaaataagaactttgaggaa

SEQ ID NO: 21122 - DNA, 547 bp, Zea mays
  Clone ID: cC-zmle18900075a04a1
tcatcctctagagcggccgccccccccccccccccccccctcccccttccccccccccccccccccctctctgtccctggttacctcccccccccccccccccccctacacaaaaactccccacaaacttaacccaacccacccccccatcccccaacccacaagaaccccaccacccccccaccaaaaaccccacccccccccccggaaccccacccccttacccctaagaagcccaaaaaaaaacctaccacacaaccatacaccacccctcactacccaaaattcattcccccccccaaacccccccccacctccattcccaaaaacaaaaaacaaaggggggcgccccccaaaaatataaccaaaaaaaccatatccctaaccccccacccccccccacaaaaataaaccccccctccccccccctaccacaaaaacccccacccccccccgctggcggcccctccccaactaaacccccccatcctatattcctttccccaaaaaaacacccccccccatttttccccccccccccattccc

SEQ ID NO: 21123 - DNA, 385 bp, Zea mays
  Clone ID: cC-zmle18900075a05a1
gttcatcttcatcacaaattttttagagctagagcatatgctcatatgacaagcagcaagcattcaggagaacacagttaattcactcttgtaccaacacaaacagtccgcatgacttgagataccaaacatagcaaataataagcagacagtttgccttgtcttccctatgctgctcctggttatttcttgccacgcagcttcgttcccagggccctctcgagcttgccaatgatctgctggttgggaattgccttgcctgactcatactcctggatcacctgtggcttctcattgatcatctgagcaagctgtgcctgggtcaacttcttatcgagccttgcttgcatgagatttttcttcaggtcacttggaactcgctcat

SEQ ID NO: 21124 - DNA, 468 bp, Zea mays
  Clone ID: cC-zmle18900075a05d1
cactgcgcgttccctggctccctgcgttgcgtcttgggggagttagttttttgggagacccgcgagaggctggggtggggggactatggaccgtagagtaagccacagccaaggagggagagggggatggccggcatcgggccgatcagacaggactgggagccggtggttgtgcggaagaaggcactcaccgtcgctgccaagaaggatgagaaggccgtcaacgccgcgcgccgctccggcgcggagatcgagaccatgaagaagtacaacgctggtatgaacaaggcggcgttcagcggcacattcctcaacaccaagcgccttgacgactacacagagaacctcgcccatgagcgagttccaagtgacctgaagaaaaatctcatgcaagcaaggctcgataagaagttgacccaggcacagcttgctcagatgatcaatgagaagccacaggtgatccaggag

SEQ ID NO: 21125 - DNA, 498 bp, Zea mays
  Clone ID: cC-zmle18900075a06a1
tttttggaaatgcaaaccaaatagtccagttctatttaggataatacatggtgtagcgaacaaaacaaagctttatgcttgcaagcttacagaaagtcctattacaatttatttttccttgcgaacagagcccatcatgcgtatgcctaaatttctcctataccgtcgtcttttgcccatgagaagtggggtctcatctcatccagcggtttccttcacgctagatgagcgacttgcgtactcctgaaccatcgcaccaaagagtgatggcctccgcatcaacttggagggtgcgtcgaattctgccactagacctgcgtccaacaccaggactcggtcactgtccatgacagtcgggatccgatgtgcaacgctgatgacggtacattcagtgaactcctcgcggatgatcttttggatagccgcgtctgtttgagaatcgaccgaagccgttgcctcgtccatgaagaaggatccgctgcgtttcagtatgactcg

SEQ ID NO: 21126 - DNA, 626 bp, Zea mays
  Clone ID: cC-zmle18900075a06d1
ccccggcatgtccctttcctacggcatttctctcaattccttggtgttctacttcaatttccataagctgtatgatcgggaatgatatggtagccatagagagggtgcatcagtacagtactctcccttctgaggcagcatgggaagttgccgacggtcttccctcacaagattggcccagccgaggagacattgatgtgaaagatctgaaggtcgatacctttttttttaatctgcattacgtcctattatagcaccttaacaagtgctaagatgaacgagtgatgagcagagcgcaactcttttcaggttcggtatcgtcaaaacacgcctctaatcttgaaaggcattactgtgagcatcaaaggtggagaaaaggttggagtcgtgggaaggactggcagtggaaagtcgactttggtgcaggctttattcaggatcgtggagcctgcagatggccatatcatcatcgatggtgtcaacatctgcactctggggcttcgtgatctgaggtctcgcttcggtgtgattccccaagaacctgtgctcttcgaagaactgtacggagcaacataaacccagcacggcggtattccgaggctgagatatggcaggaaatacaatct

SEQ ID NO: 21127 - DNA, 102 bp, Zea mays
  Clone ID: cC-zmle18900075a07a1
gatcctctagagcggcacgccctttttcctttttttcctttttcctttttacctcctcttttctttctctctttggccccgggtttatttttttcttgcctt

SEQ ID NO: 21128 - DNA, 559 bp, Zea mays
  Clone ID: cC-zmle18900075a08a1
gttataaaaaaatttttttttttttcaaataataaaaaaaataatttaaataataattatattttttaattcaaaccaaaaaaaaaaaaaaaaattttttttttttaaaaaaaaaaaaaaaaaaaacccaaaaaaaactttttcttaaaaaaaaaaaaaaatttgaaaaaaaataaaaaaaaaaaaaaaaaaaaaaaaaaaaaaattttaaaaaaactttggggggggggggtggctttaaaatccaaaaaaaaaaaaaacaaaaagtttaggtaaaaaaaaaaaaatttttcaccccaaaaaaaaaacaacccaaaaaaaaaaagccccaataaaaaaaaaacaaaaaatttttaccatctttaaaagagaccgggttattatacccccaaaaaaaaataaaatatacaacaaaaaaccaaaaaaaagctcttataaataaataaaaatgtattcaatccccacaccccaaaaaaaaaaaaactaatattcttcattttctgggacacacccaccaacaaaaaaaaaataacaaaaaaaaaaaaaaaaaacccaaaaa

SEQ ID NO: 21129 - DNA, 538 bp, Zea mays
  Clone ID: cC-zmle18900075a08d1
agcatgcaaacacaaccaaagatgaagtttctaaagagtatttagttttgttcacatataaatctgcagaaggaacggggtctgaagaaaaatctaatgagctccaaactcaaattaccgaacagtttgtgacagtcaggcaattttggcccatgaaaaggaaatatctgaagaaaactttccaacagcagtcgaaattcaggctgatggtccaaacatgcacatcaaccaagataagcaagatgaagctgctgacatcgaaactgaaatgaagccagaaaaattaggggaatctaattttcaggaacaccaggacaatggtactgagcaaaagtctcctaaagagactgatgaaggagaccagcaacttgtggccaagaaagagattctgacccaagaaatggatgtgcatgagacagttgaaagacctcagcaagcagttgaaagtcctcagcaaacagtgagcataacatccaatgaagaccaggaactgtttgattcaaaggtccaggaacgtgatctcaatgtagtttcaccc

SEQ ID NO: 21130 - DNA, 408 bp, Zea mays
  Clone ID: cC-zmle18900075a09a1
ttttaatttcaattaacacaattattccttgtcgatggggcaatggtttacatcatggtacaaaccgaaaaccagcgtgcgctcacatgcatccggacacctaaaggtcaccggcggcgcctccctcacttgccggggacgaagttggtggcgtaggcccaagcgttgttgttgacggggtcggcaatgtggtcagcgaggttctcgagcgggcccttcccggtgacgatggcctggacgaagaatccgaacatggagaacatggcgaggcggccgttcttgagctccttgaccttgagctcggcgaaggcctcggggtcgtcggcgaggccgagcgggtcgaagctgccgccggggtagagcgggtcgacgacctcgccgagcgggccgccggcgatgcggtagccc

SEQ ID NO: 21131 - DNA, 465 bp, Zea mays
  Clone ID: cC-zmle18900075a09d1
gcacgcgttcgtcctggccatctgggcctgccaggtcgtgcattttttttccgacgagggctaccgcatcggcggggggggtttactttaggtcctcgacccgctctaccccggcggcagcttttacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgacggtgacctttaagtgttcggatgcatgtgagcgcacgctggttttcggcttgtaccatgatgtaaactattgttcaatcgacaaggaataattgcgttcattgtcattaaaa

SEQ ID NO: 21132 - DNA, 222 bp, Zea mays
  Clone ID: cC-zmle18900075a10a1
ttttgttcaactaaatattttataaatcaaaaccgagggtactatgtttcttcttctacagggtacccttgcacgatttacacctacccctacccgagagggggtactcagcttcgtgtatcgataagtgcatataaccaatccgtttcagctttagcttgatacgctgggtatttacaaactatacgctggcaaaacaaggtatacccccccacgcgtccg

SEQ ID NO: 21133 - DNA, 219 bp, Zea mays
  Clone ID: cC-zmle18900075a10d1
gacccgtgggggggtataccttgttttgccagcgtatagtcttgaaatacctttcgtatcaagctaaagctgagacacattgggtatatgcacttatcgatacaccaagctgagtacccctctcgggtaggggtaggtgtaaatcgtgcaagggtaccctgtagaagaagaaacatagtattttcggttttgatttataaaatatttagttgcacaaaa

SEQ ID NO: 21134 - DNA, 501 bp, Zea mays
  Clone ID: cC-zmle18900075a11a1
ttttctttaccttcttattgataattaatactagaagggagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggtgatacacttcttttccgatttaagttgagatacagtagggttccgtctccaaagccaaggaagttacttggggccaacatccttcaacgcgcagatttgctcctcccccatcgcagactggacagtcacaacaagatccttcccgctttcgaacccttccttaatctgggccacaagagtctcatcagttgggagtctaagatcatccttagtgttgccatctgaagtaagaaagctcacaaatccatcctcagaaatatcaatcagctgatactcagtacggttcacatgcggaatgtcacagttgtgtgat

SEQ ID NO: 21135 - DNA, 543 bp, Zea mays
  unsure at all n locations
  Clone ID: cC-zmle18900075a11d1
ccgtgggcggacgcgtgggctgcgcctctacattgcttttttctctgcttctccgcctccgcctgatcggggcaagacagggatcgccatgtcggactccccggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattggtccttcatcacacaactgtgacattccgcatgtgaaccgtactgagtatcagctgattgatatttctgaggatggattcgtgagccttcttacttcagatggcaacactaaggatgatcttagactcccaactgatgagactcttgtggcccanattaaggaaggcgtcgaaagcgggaacgatcttgtcgtgactgtccagtctgcgatgggggaggagcacatctg

SEQ ID NO: 21136 - DNA, 320 bp, Zea mays
  Clone ID: cC-zmle18900075a12a1
gggttgggttttttttttttttcctttcctttctttgaaaaaaaaacggcttgttcattcccatttacacccccccattttatgccggccccaggtgttccttctaacccgcaaaataaaaagaaaaaccaacgttgcccccctaaccaaccctttttcctatcctcttaaaaaaacacccgggaccctttgtgaaaaaccggggaaactttttaacccacccccccaacgtcttgtctaaacatgccccaacagatttcccagctcgcagtgggacaaccctcccctatcccccacttaaaggccaggcgccccctttc

SEQ ID NO: 21137 - DNA, 436 bp, Zea mays
  unsure at all n locations
  Clone ID: cC-zmle18900075a12d1
ccgtggggggaacaaggcgcaggactacctttgcacctttgcttcaattttcaggaggctggaggagagggcccataggggagccaataaagcaggcacgctgcctttcagctgggtatacggtagggacgtccaactgtgacatcggaaacctgctgcggactgcttagacaagacctgctgcgtctgcgttacatagttctccaggttttgaccagatggtcccgtgtcgtcttatagagcgataggagaacgtgttggtctgtggtgtagctgtgttttttatttttatttttctgtttggatgtacaacctgtggccgcatgaactggggcgtggagatgggagcgaccatgccgttctttgtcnnnttaaaaacaaccattgtcaccaccggtgggtgctcaaccttcgctgcgtaccccatctacgacat

SEQ ID NO: 21138 - DNA, 360 bp, Zea mays
  Clone ID: cC-zmle18900075b01a1
ttttccataaaggttacatagttttttcaacaaacaaaggaacaggacgctgatgtttgaatacatggacattgtacttattcaactacaagcatgcccattgcttattacaatgctagcaataaagggtacgtcgaaataaacagggtgcccatccagcactgatgactaaaatagtggtggcaaagaaatgagtagcggtggggaaaattctcatacatggtctcaatctacaacttccgtaccttataaaccatttggcagccattattgtcttacacaaaatctacagcagttcaccgtgcctcatcttctaggttgcggaacccagtggtaaggtcgtcgtacagttttttaaac

SEQ ID NO: 21139 - DNA, 479 bp, Zea mays
  Clone ID: cC-zmle18900075b01d1
cacgcgtacgcggacgcgtgggctttttacgagaaatttgatttagttttcattgatattaggacaaaagcgggggaggggttgcttagggaggacgatctgaatgaaattgtgcagcttgttggtaaagatgcgctggcagaatctgacaagattacgctggagacagcaaagcttttgagagaagattatttggcacaaaatgcattcaccccatatgataagttctgcccattctacaaatccgtttggatgatgcgcaacattattcacttcaacacattggcaaatcaggctgtggagcgggcagctggtactgacggccataagataacatacagtgtcataaagcatcggttgggggatctattttatcgcctagtatcccaaaagttcgaggatcctgcagaaggcgaagaagctttggtcggcaagtttaagaaactgtacgacgaccttaccactgggtttcgcaacct

SEQ ID NO: 21140 - DNA, 489 bp, Zea mays
  unsure at all n locations
  Clone ID: cC-zmle18900075b02a1
cctccccccccccctttcttttttttccccctctctctcttctttttgtcctctgtttattttttttccctttttccccccttcccctttttttcctttttttttttngccccaaaaaaaaaaattggggaatttaaacatgccccgaccaaaaaaatcccctttaacccgggttgccagcaccctaaaaaaaaccccttgtttccccaaccctctgcaaacaaaaaccccaccccctggggggatttctcccccttaacccagggtttttcccttttccccccagacccaaaaacaaaaattttccctttcccccaaggcccaaaaaaacccccccaaaaaaaatttttcttccccaaaaaaaaaccccctcttttaaaacccccccaattctcctcccccctccaaaaaaaaaaactaatacaatggacccctaacccccccaaaaaaaaatttcccattccccccctttcccataaaaactccccc

SEQ ID NO: 21141 - DNA, 491 bp, Zea mays
  unsure at all n locations
  Clone ID: cC-zmle18900075b02d1
gctggcggtggcgggcatcctggtcccggacctgctggctctgtgtttcttcatcgacgcggggttctcgtggtttggggccgggtcccgcgagtacttcgcggacccctggacgctgttcgtgtcgcagatggcgctgatggggtgggcggaggggcggcggtgggcggactacctgaggcccgggtgcgtggacatcgagccgcgcttcccgaaccgcaagaacccggtgcccgacgtggggtaccccggggggctgtggttcgactgggccaactggggccgcgggtccccggagcccgtgatggtgctgcgcaccaaggacatcaagaacgggcggctcggcatgctcgcctttntcggcttctggtttcaggccgcgtacacgggccaaggccccatcgacaacctgcttgcgcacctcgccgaccccgggcactgcaacatcttcttggcgttcacgttccactgatccgatcttgcttcggagc

SEQ ID NO: 21142 - DNA, 347 bp, Zea mays
  Clone ID: cC-zmle18900075b03a1
ctgtggcacaattattgaagggcaggggtattataaaagccgaacaacacagcaagcaatgctaaagaacaggtgatgacccgcaaaagcatccgctgttgttgcttctgtaaataaactacacttctctggtacacggttctatcgaaagaaacataagcattccctgcctgaaaatggcaacgcacccctttaccagcaattatttacatctcccatccgtcccagagaaaaccaccatgaacacattagtgctagggagggatcccacaccctagaattgatgcatgctgaacaccatatctctaataaccaaaagactgcagtcgaaaaacccctgagaaaac

SEQ ID NO: 21143 - DNA, 457 bp, Zea mays
  Clone ID: cC-zmle18900075b03d1
acgcgttcggtgtgagactcgccatgcaccctaaaaaattttcagtttaaacgatttggcctatcccgttggcggctgcggggtgatagtgcctgcatggccacctcgattatgaatcatggcctgatatctgtgtcgagtccaaaatccttccactgctatggaagctcatagatctgttgcttcatcgctaccacactaccgcatgggactcatcataacatgccttcgacgccgaagcaccccggcgtgctacatcatcccgcggaccgtcctgcctgttctgtcgaccaagctgctctcggcgaataacatacttctcatcccgctcacaagccgtcacctgtccaacacatggtcacatgcagatcatagcacgctagacaggtctggatgtctaatactgtcacggttgacatgtggctttctagacaattcaagtccaccaaaaatgatg

SEQ ID NO: 21144 - DNA, 316 bp, Zea mays
  Clone ID: cC-zmle18900075b04d1
ccgcacgcgttcgaaaggagagaagatctccaaccccacacctgtttccttaaggccacatctagccatcctcgggcgcggggtcttaccccaaggacaacgcaacacatcacacaagagaaccaaaggaaacaaacagagcaggagcatgggactcgaagcaagaacgcgcactacgccggccgaacacttcgcacgtactgaggacccacacgcaccgaagcatatatggggctcccgaaccagctgacggacgacacagcggaccgcccgcgcccaaaatccggccaagggaaggtccaaaagtacgcctaca

SEQ ID NO: 21145 - DNA, 329 bp, Zea mays
  Clone ID: cC-zmle18900075b05a1
ttttttttcttttttttttttttattataataaaatttggttattgtttttttttattttttttaaatactcttccccaccaaatcatcccactataaaaaactttctaactctaaatacaatcaaaaaaaacaaaaccccaaaaaaaaaaaaacaaatttttcaaaaaaaaaaaaaaaaccccccaaaaaaccccaaaacacaaaaactgtaagtaaaaaacaaaaaaaaaaaacccttcccaaaaaaaaaaacacactataaaatctcaacccaaaaataaaaaaaaacatcttaaaaacccagtaaaaaaagccccacacattctt

SEQ ID NO: 21146 - DNA, 461 bp, Zea mays
  Clone ID: cC-zmle18900075b05d1
ccccacgcgttcgaaatgggtttaaggttgttactttgctacgttttatttctctgttacctttctcccttggggggtagggatatggccttacttcagtgaagttcttgccgtatgtcttgggcagttggttgggaatgcttccaggttcatgggcttacgtcagtgccggtgcattcgggcgagctttaatccaagatgagtcggaaattggtttgggaggaaacgaacagctatggacactgggcgttggattattgtttacagccattgctgccgcttatgtaacgaggctcgcaaaggacgctgtaaaggagatcgactactataatggtaggattctctaggagaaagggccatctggatagtgtactagcctagcacattgtacatcactggcacctttggtgcgataaaatcttatagaaagccagagcaattttatgaggtaatgtgatctc

SEQ ID NO: 21147 - DNA, 374 bp, Zea mays
  Clone ID: cC-zmle18900075b06a1
aaaaaccaaaaaaggggggccttctcttttcccttgcgcggccccccctcccccaaatttaaccgcaaaaagccctttttccctccccctttaaaaattcccccccccccccctaggaaccctttttttttgttttcccaaaaaaaacctttaccagccaaccccccccccgacccttatttgtgggggggagttcccaaaccggccccccaaaaaaaccccccccccccctttacccccttaccggggggccccttgcgtctgggggaccctcccccctcttggggcccagggtttccccaaaatttgccctcccccctgcgaggaaggggactttacccctcttccaaatctccccccttcccccccccccc

SEQ ID NO: 21148 - DNA, 588 bp, Zea mays
  Clone ID: cC-zmle18900075b06d1
ccatcccgcttacgtcactgagaccgtccttgctgcctgctacaaggcgctttaatttgcaccatgtcctcctggagggtagggtcgggaagcccaacatggtgactccaggctccgactccaagaaggtgactcctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggacgtgccctccaggcgagcaccctcaaggcctgggctggcaaggtggagaacttggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaagttgcggagtgtggtttgctcgttagagcttattttcggacattcaaaaacatgc

SEQ ID NO: 21149 - DNA, 504 bp, Zea mays
  Clone ID: cC-zmle18900075b07a1
cctctaaaacgaccaccccccccccccccccccccctcccccttccccccccccccccccccccattgtccttgtctactctcacaaccccccaacccccccccccccccccctccataccaaccccaatacaccccccaccccaacaaccacataaacaaaaaccacaaaaccacaacccaacacaacaaaaaccaaacacacaccaaaacaccaccccaccccaaaacaccacccaaccccaaacaccccacccccccccaccccccaaaaaaaccccccccacccccccacctccaaaaccacaacaaaccccccaccccacaccctaagatgggggcacccactaccaccccccacttcaccacccacacacaaaacccaacccctaaaacaaacacccccccaaccaattctaaaaacacaaaccaccccttccccccccaccctccccatccccccaccccccacattacaccctaccacctctcaccacaccctacc

SEQ ID NO: 21150 - DNA, 561 bp, Zea mays
  Clone ID: cC-zmle18900075b07d1
ccccttcctgcgcaattgcacctagcagttgaggagtgcctctttttctcttttcgtatggcttggcaagattatacgggaggcttgtatttctcatatccatatttggcttacgtctttggagctgaggatgagcgcataatggcacaccgtctagcattggctgcccgtgaggtgcaccgtccactcgcagtgcgattgttggctttgcattggctactcggctctggcatgttcaaaatctggtgcctggtctcacccattggttttaccctgtcgtgtttgttcatgccgctctatgatggcgttgcccacaggctaccatatcaccatatcaatcgaggtccttcaccatatcaatcgaggaatgggagctggctacctcttctagacagacaagcagtaggcggtggattgctgctagcaagttttctaagttcatgatgtcagagtatattccttaaaaagtgacttactctggcacgtaccttactatatcttttaagatatgaaaacatctacttttagtgatgctaacaaaagtatagaataataattagt

SEQ ID NO: 21151 - DNA, 522 bp, Zea mays
  Clone ID: cC-zmle18900075b08a1
gtattagtgaatgcatttattcatcacggggtcgggtattacaaatcaccaaatccgagcggtagctctcctaattaacgagacgtaagcacgacgggttgatcaatcttgtcccataccctctctcccattcatcacaaaatgaaacaacgcacgacgggttgatccatctccaggctcatagagatctatcatagttaattcaagaccacgtttcgatcgatggacggagcggatcaatggcgggcttaagaggatcctccgaacgtgtctaaaatggtggtatggagtgggtcgctaaggtgggtggcccacttgttgagtggccccttgccggtggcggcggcctgcacggcgaagccgaggaaggcgaccatggcgaggcgcgcgtgcttgattctcgtcagctgcagccgctccttcttctcggggtcggccgccaaggcgagcgggtcaaagtaagagccgccggggtacagcctcttttccggtcgagctcggcgttgcgctggaactccatgt

SEQ ID NO: 21152 - DNA, 535 bp, Zea mays
  Clone ID: cC-zmle18900075b08d1
ggatcggctacatcgagttccagcgcaacgcccagctcgacttttattataggctgtaccccggcggctccgagggtggggcgctcgccttggcggccgacccccataagaaggagcggctgcagctggcggagatcaagcacgcgcgcctcgccatggtcgccttcctcggcttcgccgtgcaggccgccgccaccggcaaggggccactcaacaactgggccacccaccttagcgacccactccataccaccatcttcgacacgttcggaggatcctcttaagcccgccattgatccgctccgtccatccatcgaaacgtggtcttgaattaactatgatagatctctatgagcctggagatggatcaacccgtcgtgcgttgtttcattttgtgatgaatgggagagagggtatgggacaagattgatcaacccgtcgtgcttacgtctcgttaattatgagagctaccgctcggatttggtgaattgtaatatatgaaccagtgatgaataaatgcattcactcgtacaac

SEQ ID NO: 21153 - DNA, 465 bp, Zea mays
  Clone ID: cC-zmle18900075b09a1
aaagaacagcttaatagcaacaaaacgcaggaaacggccacataaaattgcaacagaattgaacatatccaaacatagcagttatgtaaaggctgataataccacaagataaaatggaccatccatgacacagagtcagcacagggaactctgcgtcagatcacacagctaagcactcatcattcgaacaagttcaagaaaactagataatattattatattgggtaacgctacttgtccatcctcactcctcatcctcatcgccagcatcgccgccaccgcttgccttcttctgattctttctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaaaacacgagcatggtgaatggact

SEQ ID NO: 21154 - DNA, 559 bp, Zea mays
  Clone ID: cC-zmle18900075b09d1
acacagaagcggcggcggcggatcaaacgcaggcgaaggcgttgttgtttgggaaggagcaccagccatggggggcggggacttctaccgcaactatggtaagaccttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacattaggcgttgcaggcaaattgtcaacgtgccatcattcatggtgagggtggagtctgagaagcacattgacttttcactgtcaagc

SEQ ID NO: 21155 - DNA, 367 bp, Zea mays
  Clone ID: cC-zmle18900075b10a1
gggttggggcgcaaatcaatgtgaagccggattaaacacaaaaaaaaacagaagaacaagaaaaggggtcaacaaaacaaaccacacctcaccaaaaaaggacaggacaccctccaaggttggtttggtcggttgttcacctcataaaaacacacatccctcgttttttacagactttttttccacgcaacaacaacaaaaaaaaacctaatccacagctggctcaaaattcaaacgacccgaatccccggcaatgggttgggcaaaagggtggaacctcttttccttggttggtgggtcaaaactcaagagccagcagaaaccagtgccctggtccccccccgggggcggcaggccccgatcaacg

SEQ ID NO: 21156 - DNA, 446 bp, Zea mays
  Clone ID: cC-zmle18900075b10d1
ggcccaggccaacccagagcaaacaacaattcgcacaaagttgacaggaggcccaccgggggggaccaacggggcccagagacgggcggccccgaggacccccacccggtccacctgacgagagccctcgaccggccgcccaccacagcggcccaccgaccccctccacgtgcagcagcacagcagcggccagggagcaccagccaggaggacgaggaagagggcagctggcaagccggagacggcaggaccctaagctctctagcaatagccgctgcacggcctcggctgcccctacatattccgcaacgcgtatgtcttgcgacgacatgaagagcagctccagccaggcctgcggatgctcctcaggcacagggctgatgccgtccttccggctcccgacaacgagaacctgggaataaagaaggaaggcggcaagcactgcc

SEQ ID NO: 21157 - DNA, 192 bp, Zea mays
  Clone ID: cC-zmle18900075b11a1
ggaaaaactgaggggctgggtatttctcttgggaatatgtacaaaacgcccggggtaagtggcgccgaccgaggaaaaaacaacttgctacacctcaactccgatccttttcgcgatctccttgaaggagtaaacgtcactgccccaaagccaggcacccacgcgtccgcggacgcgtgggcggacccgtgg

SEQ ID NO: 21158 - DNA, 176 bp, Zea mays
  Clone ID: cC-zmle18900075b11d1
ccgtccgcggacgcgtgggtgcctggctttggggcagttttcgtttactttttcaaggagatcgcggagaggatcggagtggaggtgtagcaagttgtttctcctcggtcggcgccacttaccccgggcgtcttgtacatattcccaagagaaataacaagagcatcagtttctcc

SEQ ID NO: 21159 - DNA, 470 bp, Zea mays
  Clone ID: cC-zmle18900075b12a1
cttggatcctctcagcggccgcctttccttttttttttttttttttttttttttttttttttttttttggggtgggttttttaatccaacattgaggacctatttaaaaacaaaattttaaaccatggaacacatttagaacacttttccttaccgcggaaaaaaaggacatgggattgtcccttttatgagccctggctccacaaacgttcacaaagcaaggttttgaaaaaatactggagcaaaccacatcccccatcctgtaaaccattccctttgccaatgagggggccccctcaaacaaacacctggtcttcatcttgcctaacaaaaggacccctgaaaggggatcaaaaaacgttatccatcccacccttttcgaaaaaagccccaaaggaaggcttctccccggtttctccacaaaagcccaccctaaaaaaaggcctaccctttgggcccctctttttaaa

SEQ ID NO: 21160 - DNA, 469 bp, Zea mays
  Clone ID: cC-zmle18900075b12d1
ggccaagttcattgccgtctatcttgctcagggcattctcctcatgaccttttcgaggtcctggaccagaggggagtgggggggctgtttaagcttgctacacagaggggccccaaagctaggcctaacttgaaggtgggcatttgtggagaacacggtggagagccttcctctgtggccttcttcgcgaaggctgggctggattacgtttcttgctcccctttcagggttccgattgctaggctagctgcagctcacgtgcttgtctgaggctgcctcctcattggcaaccggattgcctgctgctggtggatgtggtgatcaacagtattattacagagccatgctatgtgaacattactagtagcagtgcttataaaagctacaatcccatgtcctttttttccccagtcatgtaaaacttccaaactgctccatggttcaaaactctggtcttcaatacatcatc

SEQ ID NO: 21161 - DNA, 330 bp, Zea mays
  Clone ID: cC-zmle18900075c01a1
gaggcaatgaacacaccttttgaatccttcaggtgttacattctcacaacaaagcacaaaacacacgatgttcagtgcacccaaatctcccacatagctaatgggtgtaaaatttattcttgcaactgaaagcaacaatcttgtccatttcaacgtgcagcgagcaaaaagaaacccctccatccatgtgagccgcgaaagcaaaactaagctaaaactcctctacggtgatgccccccctgacaacctcttaggcgtcccgggtgcgcgaccttttgaacccagcggtgaagtggaccttggcggcgttggccttgacggcggtgaccc

SEQ ID NO: 21162 - DNA, 601 bp, Zea mays
  unsure at all n locations
  Clone ID: cC-zmle18900075c01d1
cccgccagcgacagcagcagagagatcgcccgggccgctcgcctgtttggattgagaaaggaaacaagagatggacgggatcgggaacaaggtgggcgcttactggctgggacagagggccaacaaggagatctcctcggcaggcgacgacctcgattcgctctcgaccagcgtcggggatggagcgaaatggctggtgaacaagctgaagggcaagatgcagaagccgctggcggacctgctcaaggagcacaacctccccgtgggcctgttcccgcgcgaggcgaccaactacgagttcgcgccagagacgcggcgcctgacggtgtacatcccgtccccctgcgaggtcggctaccgcgacggctccgagctgcggttcgacgccacggtgtcgggcacgctgggcgagggccgcctcacggaggtggaagggatcaagaccaaggtgctcgtctgggccagggtcaccgccgtcaaggccgacgccgccaaagtccacttcaccgctgggatcaagaggtcgcgcagcccggacgcctacgangtcgtcaggggcggcatcaccgtcgacgagttctagcttagtcttgctttcgcg

SEQ ID NO: 21163 - DNA, 119 bp, Zea mays
  Clone ID: cC-zmle18900075c02d1
ccgaaaaaaaaaaaaaataaaaaaaaaaaaaaaaaaaaaaaaaatttatttttaaaaaaaaaaaaaaaaaaaaaggggaggggggaaaatgtaattataggaaaaccccaaccaccacc

SEQ ID NO: 21164 - DNA, 236 bp, Zea mays
  Clone ID: cC-zmle18900075c03a1
cccccccccctctcttttttttttttttttcccctcacaaaaactggggactgggtagcctatatacccgaaaaccacccccccccctctcacctaaaaccaaaaaacaccacccgcatgcccaaaccaaccctgaaccaaatcaaacatcccacacccaacctcatcacactaaccaacggcctaggtcccaccgataagccccaccgtgccaaccgacgatagcaaaacccccc

SEQ ID NO: 21165 - DNA, 204 bp, Zea mays
  Clone ID: cC-zmle18900075c04a1
aaaaaaaaaagggaatgtgtttatttttataaccaaaaaacaaaaacacccaccacaacataacaataacaaacatcttcctcacccaaaaaatcatcaaaaacagtactaccaacaaaacagcaaatggaatattccatccttcatacaacatcaccacacttgaaacaaacaaaagtaaccaatctatgcaggaaacaataa

SEQ ID NO: 21166 - DNA, 253 bp, Zea mays
  Clone ID: cC-zmle18900075c05a1
acaaaaaaaaaggggaagtgtttaatctaacccccaaaaaacaaccaccccaaaaacaaaaaccaataacaatcatcaaccacaaacaaaaacttttcataaacccacccaagaaaaacacaggcaaccaaaacattcattaaaaaatatataccccaccccagaacccacaaataatccagtaagattataaaaaaaatcaagcaaacaaacaaagccaaaaccacgtaacaataaaactttcacgcccacg

SEQ ID NO: 21167 - DNA, 372 bp, Zea mays
  Clone ID: cC-zmle18900075c06a1
actccttaaaaataaaccggggccttgtggtttttcataacaacaaccataccacaaccagaaccgcaaccctgacacaacagctccccaatcaaaaacaacacctaccacctagaacctaacaacccacaccaccaaattttcacacaaacaaggccaaacacccccccaaagaactaacatacccctgccacgcactgaagaaaatgacttaagcctcttcctcaacttcctcctcctcctcaaactactcatccaaagcgaattcatcctgccactgatcatacgcgggcacgagatcattacacgttcctctcctcctcggtgacctccaactcatccataccctcacctgtccaccagggcaagaaa

SEQ ID NO: 21168 - DNA, 201 bp, Zea mays
  Clone ID: cC-zmle18900075c08a1
actaactaaaaaaccgggaaaagtgttacatttaaaaccaacaaaacacaacatccccaaccaaaaccaacaacaaacagctcctccaaccacaaaaccatccaaaacaccaataacactaacccaccccatcaaaccctgcaaaaaaacaaccacaaatcccctccaaatcctaaaacaatcatgaaaccttaaaaacaa

SEQ ID NO: 21169 - DNA, 272 bp, Zea mays
  Clone ID: cC-zmle18900075c09a1
cagacaatcagggggccagggggctttttcaaccaccaaaaggccccaccccaattgaaaggaactaaggaacaggggctcatttcgcagggccagccaacacactaactaataaaactcggcacaggaagctgagcaggaaaccaccaaaaaagtcgctccactacctaaaacaagatagtatctgcgctgatacacatactcgcctatgtattcgggctccgcccttatatcaagctgaccaccccgagctgactctaacacactggaat

SEQ ID NO: 21170 - DNA, 528 bp, Zea mays
  Clone ID: cC-zmle18900075c10a1
acgttattgctctactgaattacgggtacggtacatttgcatatacataccacatcacactttgtaaagcttccaagaccaaaaaaaaggttctccttttgttggatcgccttgacgattttgcagccacagatgctttaactatgcatgcctactgatcgtcacagatgtacatgtatagttatctgcagagtgagtgagtggcagtgaagcctttcaaggatgatgtgcctgcccccctatgtttccgagtatatacaaccactgcaacggtggaattaaccgactcaagcgaagaacatttcactcagtattcctcaagcaacgcatccaaatgttccctccttgcagcatgcttcagcttctccatcgtaacgagccctacctgcctcacgcgctcccttgacaacccgaattgtctgctgatatcctcccatgtatggcactgctttcctatgccatgatataatcgaataatgtccctctcgcgctcgttgagagttgcatttataagactggtaactttct

SEQ ID NO: 21171 - DNA, 564 bp, Zea mays
  unsure at all n locations
  Clone ID: cC-zmle18900075c10d1
cgtctgggggcggcagcggcggaagagcgggcggcttttggggcgctgtcggaggccggaagagcgggggcgacagcggggagctgatgcagagccggaaccgcatctacctccggggcaccgtgagcaaggacctcctcacgcacaagcaggtcgtccagctctccaggaagatcaaggacggcatctggcttcagcaccaaagatccaagctgaaggagaaactgggcaacgagccgtcatacaagcagctggcgcaatcgctgcggataccagctcctgagctgcgagcgaggatgcgcgagtcgcttcttgcgagggagatgctggcgatgagcaacacccggctggtgatatccattgcccagaagtacgacaacctcggcgtcgagctgccagaccttattcaaggtggtctgatagggctgctccgtggcatcgagaagcttgatgcctcaagggggnnnaggatctccacctacgagtattggtggatcccgcaggggggatcaaagagcattggccgacaactcgagagccgtcaggctgcctacttatttgcac

SEQ ID NO: 21172 - DNA, 460 bp, Zea mays
  Clone ID: cC-zmle18900075c11a1
cgagtgtagaaattgggagaagggacgttacatacagatggcaagagtccaaagcgcatgtatgaaacaagggtattacaaatagcgtgttttgttggggttatggttacaacaggggtgcggcgagttgagccgatcacatggtcgctttagcattgaagaaaattacagcttctcaccaaggatgaaatattaagtgcgagatccatcagggcgtggagcccctgacctgtcaatctgacctgcaattaccctttcaaaacggggagatgcttcaagtacaacaacccctcgaacgatatatctggctgctggtgctaaaatctggggtaccagaacatgcccttgatgccttgaggatcaacttcgaaccccaggttcttgtagaaatctataactttgttatccgcaaacagtgtaatgttgttgatgtctctttggagcaaagtacgaattactt

SEQ ID NO: 21173 - DNA, 583 bp, Zea mays
  unsure at all n locations
  Clone ID: cC-zmle18900075c11d1
ccacgcggggggctctccccgctcagctccgctcccggttacacgcaattttcccggtcccgggaacagggactaaaggggcctccaaccttcgccgccgcaccttcctcctcgatatgtggcgtgcgcatcccaactgtgcgccgcttcgaagcgcaaagcacggcatccacgcccagatttctgcgtaatcgggtggcagcaaaaacacggtctacatcagcttggtccttgaaggctggctcgagggattctctcagatctggccttttgaagaataatagcagtacagagacagtagagccaccaccagcaccacttgaagtggaagagcctttgcctgtggaaatagtactcctagaaagaacactacctgatggaagtacagaacaaatcttattgtcttcanccggagatgttgacgtatatcatctccaagccttatgcgataagggaggatggccacgcanccctctttcaaagatagcagcctcattaagaaaaagctacttggttgctacactatattcaataattacaacttcagaaacagaaattcatttttctaaatgaanaacatctt

SEQ ID NO: 21174 - DNA, 432 bp, Zea mays
  Clone ID: cC-zmle18900075c12a1
ggaccatcaaaattcaaaagtcggtcatgcattttatttaccttggggaggagatacgagggtacaacaatcaaatcaaaggatatataacgaccgtcgatttaagaacctacgaaaacatatctgctttctaggttgatgataatgctcaaaaacttctaaagatgagcgttcctctgttatgatgcattcataggccctcggaagaaaaacgaacccacctggccacctccgatgctggatcatgaattacttgtttgataatatggtacgattttcacgtacttacactgccccgacactcaataaagacccaaaaatttccaccataatgcaccagcaactccccaaattacagcattgattgcggctgttataaaacccagcttgaatacatccggaaggtcaacataccccgctccaaagtatact

SEQ ID NO: 21175 - DNA, 551 bp, Zea mays
  unsure at all n locations
  Clone ID: cC-zmle18900075c12d1
cccgtgcgcctgatgtgatttacaaaatattcccccctgttttaaaggattctcctgaagccccagcattggctgcctaggggctaaataacatgggtccaccaacaaaaaatgaatgggtcatgattgggacgatgcttcttgcagtctcactatggatttttggggaaactattggcgtatccagcgttgttgctgcaatgattggactctcaatacttcttgtgcttggagtgctgaactgggaggattgtttgaatgagaagtctgcatgggacaccctagcttggcttgctattttagttggtttggctgggcagcttactaaccttgggattgtgtcctggatgtcgaattgtgttgccaaggttcttcaatctttctcattgagctggcctgcagcatttgttgtccttcaggcctcgtacttctttattcactatatatttgcaagccaaactgcacatggnggagctttatactcagcatttcttgcgatgcatttagcagctggtgtgccagctctaatgtcagcacttgccttggcatac

SEQ ID NO: 21176 - DNA, 241 bp, Zea mays
  Clone ID: cC-zmle18900075d01a1
aaaaaaaaaaagagaactgggtatacttaattaccaattaactccccccaccataacccaccacaacaaacaacacctcccgaatggaaaaaattaccttaaacaactcacttaataacacacctcatcgcattgttaatcaaactacacaatgtccccaaataaaacaaacttaccatttaacaattgaaaaaaactccatcacaacacctaaaaaaacccccacctaccaaacaaaaac

SEQ ID NO: 21177 - DNA, 191 bp, Zea mays
  Clone ID: cC-zmle18900075d02a1
aaaaaaaaaaaaagaactggttatcttttataatcaaaaaccaaaaccaacccaatctactaaaaaataaaaacatcacccacatgcacaaattaaccctgaacaatttaaaaaatcacccacacaaccttattataaaaaaaaaaggcaatattcacaccgataaaacaaaccgtccaacctaacaataa

SEQ ID NO: 21178 - DNA, 195 bp, Zea mays
  Clone ID: cC-zmle18900075d03a1
aaaaacaaaaattgaatttgttttcttttattcccaaaaaacaaaaaaaacccccacaactaacaattacatatatcttcctcacccaaaaaatcatcattcactgcactacccacaaaacagcacatggaatattccatccttcatacatcagcaccacaattgatgcaaacaaaaggaaccatcttttgcaag

SEQ ID NO: 21179 - DNA, 415 bp, Zea mays
  Clone ID: cC-zmle18900075d04a1
aaatggctaggggtaggggcacatatatgttcggggtacatcatgtatgcagactgttgacatcgaatcgtatagactaagtatcgagatctcaggggcaccacttgttacagtatctcgcatgcttctgcttctgaccggccaaacatggcgtacctgttgttcgcaacgttgtcctacgcgaagtccctcaagaacagagggaccaacttgaggaaaaccgcgagctgcggaaagggcaggttgagggactccattatcctcatcaccgcttcagacttgatgaaagacctgtctttcttgacgagaacaacgctggagatgtcgtcaggggacctccctgacctctgcaggagcttcctcccggactcgctcttcaacggcacgtacctgatgctcctgttggggtcgtgct

SEQ ID NO: 21180 - DNA, 550 bp, Zea mays
  Clone ID: cC-zmle18900075d04d1
cgacgacgatggctgtcgccgggcagtgctcctcctgctactatactttacccaccctgcagctccagctgcgagggggggacattcacctgccgctgcagccccaagccgcacgaagagcgcggtggccgacgttgcaggtggccacagctgccggcagcgggcccatcatggcggtcacggacgccgagttctttcagccttccgacaccaggccaatcatgctcttcgacggcgtctgcaacctctgcaacggcggcgtccgcttcgcgcgggagcacgaccccaacaggagcatcaggtacgtgccgctgcataccgagtaccttaggaagctcctgcagaggtcaggaaggttccctgacgacatctccagcgttgttctcgtcgagaaagacaggtctttcatcaagtttgaaacggtgctgaggattaatggaatacctcaacctgccctttccgtagttcgccgacttcctcaagttcgtccctctgttcctgtaggacttcgcgtacgacaaacgtgcgaacaacaagtacaccatgtttg

SEQ ID NO: 21181 - DNA, 142 bp, Zea mays
  Clone ID: cC-zmle18900075d05a1
aaaaaaaaatggggcatggtgtttttttataacaaataacctaacaccccaagaacctccaccaagtaacaacagcaccccaatcgaaaacattaccaacaacaaatcacctaataacccacaccaccgcaactttcaacaa

SEQ ID NO: 21182 - DNA, 179 bp, Zea mays
  Clone ID: cC-zmle18900075d06a1
ctccctttttttttttttttttttttcctccccccaaataaaacgggaaagtgagaccccctataaacaaacaaaaacaaccccctataccccaaacaagaaacaacagcccccgaacaggaaaaaccaccaacgcccccaacacaaaacccacccaccaccaaaacatgcaggcataa

SEQ ID NO: 21183 - DNA, 287 bp, Zea mays
  Clone ID: cC-zmle18900075d06d1
acgcgacgcgcccgcccctcgccattcgacccacaagaattttatttttcaaccaccaccaacagctccgagagaggagggtactacatataccgcaaattcctcacccaaaatgagagcacgcactgctactcggatcccagatcacctacggtgataccaataaacttttcacgatcaagaatcagcgcacacaccgaccactcctgctaacccttatctcgcaaaaacaaaaacaggctatggctgacgctgcaaagacgaagaagatcaacccggtgcacctt

SEQ ID NO: 21184 - DNA, 152 bp, Zea mays
  Clone ID: cC-zmle18900075d08a1
ctacaaaaaaacagggggccgggggtattttataactacaaaaaaacaccatccccacctacaaccaacaacaaccctcttctccattcacaaagccaccctaaacatatacaagaataacccaccccacctaatcttgcaaaaatgcttcc

SEQ ID NO: 21185 - DNA, 242 bp, Zea mays
  Clone ID: cC-zmle18900075d09a1
cccccccccctttccttttcacttttaaaccccaacaaaaaaaccgggggaatggtgccccttataaaaaccaaaccaccccaccccaaaccaaaacaaacaaaaaacaggttccccataggaaagaacacctaaaccaaaaaaaagtcacacacacaccaacaaatcgtgccttctgatcgccacagacccacacctaaacctaataccagaccgaaagaggggcaataaaaacccaacaa

SEQ ID NO: 21186 - DNA, 336 bp, Zea mays
  Clone ID: cC-zmle18900075d10a1
aatgtgctaaaggggacggttatatttggaaaaagtatattccatcaactgcccattttacaacaaataacaatcttgtgtttgttaacaagaaactcatgcatcatcaaaatgttgaacagtggaattgaaatttttttccccaaacaatggacatttgggcactgtcttatttcttggccttatgagtaagcattgtacaaatctgagatctcttttttgctcaccattagttcatctggaacttccctttagccttttcaaagacttgttcgtcgatcaatgcaccattgccgtcacctttcttgatctccaaattggccttttggtagaacc

SEQ ID NO: 21187 - DNA, 468 bp, Zea mays
  unsure at all n locations
  Clone ID: cC-zmle18900075d10d1
ggggaggagacgccagcgccatccatcgcggcattacccgacattttaccacgaaacccgacccggggccattcggggcccatacggcgctacccccccactatccctcaaaacctgaagctgaacccatggcccctctcatcaacccccaaccatcgatgacgctcaccttgcggcgtcagaggatgcaaccatctcccttgcttactgcatttcctcgtcactcagctaaactgtgcactacaaggctcacaaacttctccacaaaagcacctgaaaaaacccctatctgacgaccacgatcgcaaagacacgctgaccattcagagcatcgttnaacttgcctggacgaacaggcagttatctaacatcacatggaatcgaaaacacactgaccctactgcacatgcttccgttcctgccatgcacaggcttgcacaaagcttgagaaaactgacctcttacact

SEQ ID NO: 21188 - DNA, 423 bp, Zea mays
  Clone ID: cC-zmle18900075d12a1
aaagccccaaacaagaaaccatcctgggcatgggatggaaaacatacccatgggggcattacaagcttaaaaacagggctgaccttgcccaaagcagtatataaacgatccgtcctttattttaacataggacgggactaaacacattggtaaaaccggggccatacagccatactaaacacagttttttggattttaaaaccccttaacaaaaggcccaaggggggggtcgggccctggggagggccaaacccaggaccatgtacctggaaagtctggctcggcacaacctggaaaacaccgggtggctccttgaaaaccttgacctgctggggggggagcttccgggaaaagccggtggcggcgttcttggaggggaagagcactgcgtccctggccttctgttcccttccaaggacgggg

SEQ ID NO: 21189 - DNA, 588 bp, Zea mays
  unsure at all n locations
  Clone ID: cC-zmle18900075d12d1
cagttcccctgtcctgatcgtcctgttcctcacagcttcagccatttttgccgagccggagaagcagggggcccccggggcacatgagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaggcgtatgagaatcaagaagactgtgtttagtatggctgtatggcacaggtctgacgaatgtgtatagtacagtactatgtaagaataatggacgtatcgtctatatactgctttgcgcatgctcagccctgttctaaagcttgtaatgcaccaatgcgtatgttttcaatacaatgacaagtatgctattttgntggtgcttgaaaa

SEQ ID NO: 21190 - DNA, 363 bp, Zea mays
  Clone ID: cC-zmle18900075e01a1
aataaagcaaggggttcgtgatcttttgttgaaatgattgaaacaaaatgagcacaattacacatgaagatttaattttcctgcagtttggacatatttagggtcgacaagacaggtgatgatctcctccattcccatcagacgctgctgctagctgcttcaccacttccaaaaaacgttggagccgcacttgaacttttccttccccttgcactcaatcttgaggtcgtcgttgatgaaagggactttcttctgcttggcgaggtcctggcacccagggaagttgttggggaactggcatctgccgaacctccactgtgtatgcccgcgcaaagttggctccactggtggccaacctttttt

SEQ ID NO: 21191 - DNA, 355 bp, Zea mays
  Clone ID: cC-zmle18900075e01d1
ggcggggcatctgaccgcgcccgatgtccgcttttccgctctgctcggcctggcggggggcggggtcgttttaaacaccaccgcctcgcccaacgccaccatcttcgatgagtacctcgagaagagcaaggccaacaaggagctgaacgacaagaagaggctggccaccattggagccaactttgcgcgcgcctacaccgaggagttcggcagctgccagttcccctacaacttcactgggtgccaggacctcgccaagcacaagaaagtccccttcatcagcgacgacctccagattgattgcgaggggaaggaaaagttcaagtgcggctccaaccgttttctggaagtggtg

SEQ ID NO: 21192 - DNA, 181 bp, Zea mays
  Clone ID: cC-zmle18900075e02a1
aaccaaagaaatgggaacttttttcacctacaacaaaacacaaaccccctccaccaccaataacaacaaaaaactactttcacaaacaaaaaatcatcataaaccaatatcaccttaacacacccaatcaaattaaacatacacaacccaaaatacctccacacaaaacaaaatatacaac

SEQ ID NO: 21193 - DNA, 131 bp, Zea mays
  Clone ID: cC-zmle18900075e02d1
ccgtccggggacacgaacggcctgcccaactacaacccaacaatttgtttttttctaaacaaacaaaaaccaccggggggggggggaaataaactacctattaccaaaactcccctgtcaatttgtaagaa

SEQ ID NO: 21194 - DNA, 159 bp, Zea mays
  Clone ID: cC-zmle18900075e03a1
tagcttcatcctctaacggcccccttcttccttttttttttttttcctcttcctacaaaggcatggaactttaacccaaaccacccacaaacccccacaccccccaaccaacaaaacatcccaaaacaaaaacaccacaacacccccaaacaacccccc

SEQ ID NO: 21195 - DNA, 143 bp, Zea mays
  Clone ID: cC-zmle18900075e03d1
tccggggacacctagggcctgcccacctacatcccaacaattttttttatacaaaaaaaaaaaaacccacgggggggggggttaaataaacaatctgtctgcctcactcccctatcaaaatgaaaatacccattactgctata

SEQ ID NO: 21196 - DNA, 147 bp, Zea mays
  Clone ID: cC-zmle18900075e04a1
aaaaaaagacagtgtaatttatatatcccacaaccacccacaaacacaaacacaatcaaataacaacaaaaaacatctcactaaattgaaaaattcatctaaaacatacccaacaataacacaccccaccaaatcattcaacaatca

SEQ ID NO: 21197 - DNA, 133 bp, Zea mays
  Clone ID: cC-zmle18900075e04d1
tccgggaacaccaactacctgctcaacaaaaacccaaccattttttttttacaaaacaaaaaaacctcacgggggggggggaaaattatacaaactatacgcaaccactccctaaccacaatgtaaaaacaca

SEQ ID NO: 21198 - DNA, 159 bp, Zea mays
  Clone ID: cC-zmle18900075e05a1
cttatgggatgtgtattttttataatttacaaccacccaaaaaaacacaccaaaaccactaacaaaaaaaaacatctctcacatagaaaaatttatcctaaacaaatccaataataacccaccccatcaaatcattcaacaaacacgcaacagatctcc

SEQ ID NO: 21199 - DNA, 256 bp, Zea mays
  Clone ID: cC-zmle18900075e05d1
ccgtccgagaacaccaactacctgcccctcaaaaacccaacaattttatttatactaaaaacacaaaactcaaaggggcgggggagaattatactaactgtaaccaacactcccttgtcaaaatgaaaaaacacatcaatgctcaagtccccaacgatcaatcatgacaaacccaacattctacccatctacaccaatgccaacctttgactactccagcaaacccttgtctcagctaatcaaaaatctcctatct

SEQ ID NO: 21200 - DNA, 287 bp, Zea mays
  Clone ID: cC-zmle18900075e06a1
gggattgggcattttttacctaaaaaaacaaacaaaaaaaccaacaaacttacaaaaaaacataaaacaatttcctcatgcataaaaacatcatccaccattccaatacctaaatatctcatataaccatgcattaatcccatgataaatcgcctcttaaaacaaatatactcattcttcaatctaaataaactactttcgtactcctaaaccatcgcaccaaaaaatgattacctcctccccaacttgcaatttactcccaattgtgccataaacctaaattcaac

SEQ ID NO: 21201 - DNA, 143 bp, Zea mays
  Clone ID: cC-zmle18900075e07a1
gggcaggggatcatttttctcgtactcctacccaaaaaaaccataacacccaacgaacaacaaaaaacttctctcacattcaaaaacccacctacaacatatacaatatttacccaccctacctaatcatgcaaaaatcattc

SEQ ID NO: 21202 - DNA, 280 bp, Zea mays
  Clone ID: cC-zmle18900075e07d1
tccgggcacaccaagaaccggcgcatctccaaccaaccaattttttttctacgaaccacacacaacccacaggggggggggttaaatttacaaactatatcaaacactccctagtcaaaaagaaaaaacacaacactactcgagaccacgaagaactaacatgacagaaccaaaatcataaccatttccatcaattgaaaccagcgactaccccagccagcgcttatcttgcaaaaacaaaaatctgacatggttatcgctcaaaaacagtagcatatcc

SEQ ID NO: 21203 - DNA, 139 bp, Zea mays
  Clone ID: cC-zmle18900075e08a1
ctaaaggggagagaaaattatttactccataaccaaccaaaaacaccatcataatccataactaaaaacaaccttctcttacaaagaaaaacccacccacaacatatacaatattcacacaccccacctaattatccaa

SEQ ID NO: 21204 - DNA, 250 bp, Zea mays
  Clone ID: cC-zmle18900075e09a1
cttaaagaccggggcttatattccttgcccaactacccaaaaacaccatcacactccacaaccaaaaacaaccttcttctacatacacaaaaacacctataacatacacaagatacacccaccccacctaatcattcaaacaaacctccacacaccccagcctaatcctaaaccttgaacttaacaataagaataaattcttttctacaatcccatcctacccacaccatacaacaaaaagacccccccc

SEQ ID NO: 21205 - DNA, 288 bp, Zea mays
  Clone ID: cC-zmle18900075e09d1
tccgggcacacgtagggcgggccctgcccaaaccaaacaatttttttttttttatgcagacacaactctcaggggggggggttaaatataataagtagtttcgacactccctagtctaaatgaaaaaatacaaaattacccgaggtcactaaaaactaccttgggaaatccataatgaaacacattcagagtaatattacctaacgacaatgccagtatgcgcttgtgctcgaaaatacgaaatagcacatggtaggcgtaccaaaatatgaggaaatccacccgatc

SEQ ID NO: 21206 - DNA, 256 bp, Zea mays
  Clone ID: cC-zmle18900075e10a1
gaggagggggacaattattccttggcgattgaacaataactaacatcatggaccaaacccaaaaccagggtgctcctcatatgcattcggacacctaaaggtaaccggcggggcctcccttacttggcggggacgaatttggtggcacaatcccaagcctttgctttgtctgggtccccattgtggccaacaaggttctatagcggcccctttcccgtgacgatgccttgtagcaaaaatcctatccctataaaca

SEQ ID NO: 21207 - DNA, 284 bp, Zea mays
  unsure at all n locations
  Clone ID: cC-zmle18900075e11a1
aaaaacaacagggttggagtttgtattattcatctggcatcatcacacatgaggggacccacaccccgcgtcacatggaaaatccanaaaaggaaggactccattcataacatggcatggattcactcatgcatggaaattccattacactccacaccttactggacctaactttttggcccccaccccctgtttgctgctctaaaccttcctttaggcctccgggggctcctgcttaccctatttaacgccgcccttattctcggctgacggattggaaaccg

SEQ ID NO: 21208 - DNA, 425 bp, Zea mays
  Clone ID: cC-zmle18900075e11d1
ggccaggcgtgcgagcaagcacaactaagctcctttcagcgacgttacagagggagctagggagggggacgacagggacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagaacgtgtggagtgtaatggagcttccatgcatgagtgaatccatgccatggtatgaatctagtccttccttgcttgtatcttccacgagacgcggcgtgtgcgtcccctcatgggtgatgatgccagatgaatactacaaaaaaga

SEQ ID NO: 21209 - DNA, 483 bp, Zea mays
  Clone ID: cC-zmle18900075e12a1
aaataaaaccaccaataaaacgtgggctggattcatcagtaacaacgcaaactataaaggaagcacggagatcttatcaatctgcaagtacagcgttcaactgttggtggcaacagaagtaaaacatcaactactcaatcgcatgaaagaagtacaacgtttgcattgttcgccgacatgaagctccactgcagcaaagattattcatggtggatgagtaagagtagcttctcaatatattgcctaggtaaagcaaaatctcctgttgccacaatttatcaacttgaaagcacaacataaagcattccttttatttaacattgttgccaggccacagatatgggtagaactccatctccgccacctatgcctggggtgatgccgcctcagtcttggctttcttctttccactaaaaagcttggaaccaccataaaaaataaccccccacattgagaggcttgctagaacaaactgtacgaggg

SEQ ID NO: 21210 - DNA, 518 bp, Zea mays
  unsure at all n locations
  Clone ID: cC-zmle18900075e12d1
ccacgcgtcctaaagctagagacaaccgctgtttaaacgaattcatcgccatggcgtctcgtggcgttgctggggcggcctactcctcctcctccctctcctcaccgtcccccctcgctcgcctaatctctcgccgcggccttgccggtgccgcagacggccatgggtctgcgaaggtgcccttgtggaaagatccgttgagcccgagcaagtggaaggaagagcacgtgagtttaccctagaatatcttgtttaaagtcattgaagctaactacattgaggttgtgatgattatcgtactactcttaggcatacagcctgtgagtacattatatcttctttatgagggtctgccactgagctcttgagttcatttggatgcttaagtggaacctgagaatgtcttctgggtggaaaacacaatacttggaactagtgcccaactttttggccttgnnnncnnataccattgtacctacaatcttaggtggcctctgtcatcagttgaancaatatcc

SEQ ID NO: 21211 - DNA, 292 bp, Zea mays
  Clone ID: cC-zmle18900075f01a1
ttttatttttaaacatagtgatgtcaaacagagcagtgggactacttgtcattacaacaacaatagaacatcacaaccactgtacaccatacttctattgtcttaaaataaccacccaaacaaatggacaaccttacaaaaacatgctccacgaaattgatgtacccgcaataaggtccgatacactaaacaaaaatcacaggcctgccacatggaatcacaaaacaaaaacatactctatcaaacacattggagaacggagaacaccaccctctttaggtccctctccaac

SEQ ID NO: 21212 - DNA, 315 bp, Zea mays
  unsure at all n locations
  Clone ID: cC-zmle18900075f01d1
cccgtccgggaactcgagcaccggggcgccttcatccccaacccatttttatttcancgagcacaaagagcaccactggcgggtggggggacaccaaaaaacggcccaggagcccgtaccacaacgcacacgagcggatggcgcactacaagcgccagcgcgttcggtagaggaacgtgccatgctgagctctcatgccacatggccgagcagtgccttcactgaaaccgacactgccgagagcccaccacaccaccggagcatgcatccgaaaagccctccactcaccagagggctcagggacggcacccacag

SEQ ID NO: 21213 - DNA, 212 bp, Zea mays
  Clone ID: cC-zmle18900075f02a1
ataatcttcttttttttaaaaaaagaaagtgtaatttttacacttcacaaccccccccaaaccaaaaacctcacaaaaaacaacacaaaaaaactaccaaaatcaaaaaaacacctaaaacacaccaaaaaaaaaaacaccccaccaaaaaaaacaacaaaaaaaaaaaatcacacacaataaaacaaaacaaccaactatacttgaccaaa

SEQ ID NO: 21214 - DNA, 360 bp, Zea mays
  Clone ID: cC-zmle18900075f02d1
cccgtccgaagaaatccattgacaggccctctacaggcgaattaaatgctctattctataacaacagccaccgccgggggaggcgcgaaatcgacgtcctgctctccatactcccgaatgccagcgccagtgccgagacctactgcgtgccggggtgggccatcccgcacaacccgctccctagctgccgctggtacgtgaccaaccggacctgcagcatcagaccgtgcctcccgtggccggatctgaacaggacatgctgctccaagctggcagacatcccagcgtactgccggtgcacagcgctgagcatcctcatgaacggagcgatccctccaggcccggacgcgcagctggagg

SEQ ID NO: 21215 - DNA, 340 bp, Zea mays
  unsure at all n locations
  Clone ID: cC-zmle18900075f03a1
aaaaattgactttggatattttttaacccataacctcccataaaaaccaaaaaaacccaaaaaaaacttaaaacccctaccaaatacaaaaagccttcctaaacaaaaaaaaaaaacccccaccccacaaaaccgttaaaaaaaaaccaaacctacctctccataaaaaaaaaaaatcaatataactagtcagtaacccaaaaaaaaaaaaacaatcaacacccccacaccaaccaaatatacaacccctaataaaaaccactacccttcaaagaaaacttcccaaaaaaaacctaaccctncaaccccaaccaaaaaaaaaaagcccccccaaaccccc

SEQ ID NO: 21216 - DNA, 211 bp, Zea mays
  Clone ID: cC-zmle18900075f03d1
ttaaagttcctgtctaaccccatcccaaccatatgctctctacaatgcgcatctatctcttggggtcaggttttaatttaattttctttttctaacactcctatacgtatttgtgagtactgattaattctctactgcatgataatacatttagacatatcatatttattaactgcatgaactatctttacatatcaacaaatatgttaaa

SEQ ID NO: 21217 - DNA, 310 bp, Zea mays
  Clone ID: cC-zmle18900075f04a1
aaaaaaaaaaaaaattttaatttttttttcacccttcggcttaaaaaaagggaaaaaaaaaaccctaacccacaaagaaatccaaataaaaaaaaacaggccgagggtttttttattttttttaaaggccccagaccccccctttaaaaaaaaacccccctcccctttatttttaatccaaaataaaaaaaaatttttcaaaaaaaaaaaggggttttcccccaaaaaaccctttttttttttgttataaagaaaaaactttcttggccaaaattttggaaatttttaaaccctccttttaaaaccttgt

SEQ ID NO: 21218 - DNA, 581 bp, Zea mays
  Clone ID: cC-zmle18900075f04d1
cccgtccgcggacgcgtgggctgcaacttggagggccccgtctgtttttgtttgttgctattctagcaaagggaaggggttggttcggaccttcggcttaaggccttcgttcacgtcgtagtctgaatttgttattataacaattaatattgcgaggggctactgttggaggccttcgtcttccgaaggtcctcaaaaacatgactaacaatgtttcccaaagcataatatatgtgcaggaaccttcggacatgggatgaagctgtacacaatatggaaacaaggatcaaaacgaaggttgaagcagtgccgaagctgtgcgcaaggaagcttcagctcaatagcagaaaaagaaaccgacttaaggaggaaaacaccatttagtcctcgacagattgttcttaagttagtactaaatatgaagggcatgagtgtaattttacacaggctgcgtcctgtgcctataaatagatgaacaataccctcgtactgtctatgctgacttgtactcactcgtgcgtcacgcttgtactttcacctttgtcaagccgaagtacaatataatcaatattgtcttattc

SEQ ID NO: 21219 - DNA, 368 bp, Zea mays
  Clone ID: cC-zmle18900075f05a1
aaccttagaactggggatgtaaaaacggaatatcaaaagtgctaaaacagagaaagtttcgcctgtaaaaacggaatatcaaaagtgatttcgcctcgctaagttcccttcttttaaccgaatataaatacggtacccctcagtaagtcctcatctataactcccggcagagtccaacatttgtggttgtccaaaactttcatagcatgccagactgcagccttacactggccagtctttaccgacgacctccaggcttccttgcaggcggggcctgctcgtcctcatccgattcaacatctccgtactgccaaatccgcagcctttccttctttgccttgtcctggaactgttccaggttctggaga

SEQ ID NO: 21220 - DNA, 584 bp, Zea mays
  unsure at all n locations
  Clone ID: cC-zmle18900075f05d1
cccgtccgctatgtcgagggtgaaaatgcttccaatggatccacatttgattctaaacaaaagcaaattctcaagggggttggcacggaagttcttggtggtgggaagttttatgttcagacaatgggtgaccagagggtggcttcaattcaacagcagcttgcatctttgaaacttaaagatgcgccggtcattggtgcttttaatcctgtgaagggagagatagtcctcgcacaatttagcgttgacaactcctggaacagagctatgattgttaatggacctcgttctgttgaatctccggacgacaagtttgaagtattctatattgactatggcaaccaagaggtggttacctacagtcgtttacgacctgtagacccatctgtttcctcgtctcctgctcttgctcagctatgcagccttgctatcataaaagtgcccagtcttgaggatgactttggtcaagaagcagcagagtatctaagtgaatgtttgctcagtagctcaaagcaatacccggcaatgatcgaagaacatgatacttctggngggaaatcaaatggacaaggaaaccgaaatgt

SEQ ID NO: 21221 - DNA, 147 bp, Zea mays
  Clone ID: cC-zmle18900075f06a1
caagggggcaggggattatttttcatggactcctccccacaaaaacaataacccccaacgaccatgattacccttcttttacattcacaaactcatcaagaacaaacaccatcatcaccgagcttactgaatcatgctgaactcact

SEQ ID NO: 21222 - DNA, 287 bp, Zea mays
  Clone ID: cC-zmle18900075f07a1
ccttctactgggcatgggaacatttattattgtactcttccacacaaaaatcataacaattgacgaaccaaaataaccttctccttcattgaaaagccatcccaccacctatacaatatataccgaaactaactaatccttccaacttgctttttatccccccaacattatcctacaccacttaacaaaacataaaggagaatatatccctatcggactatctaacccaatcctaacagtgtcacgatcttccgaaagttcttatcctcctcatatgttttcatcag

SEQ ID NO: 21223 - DNA, 289 bp, Zea mays
  Clone ID: cC-zmle18900075f07d1
tccgggtatatttacatctggcgcttctaaaacaaaaccatatgttatcttctatacttaaacaactcaaaggggggggctttttattgaaattctacctcaaaccctacctaatcattctcctaaaacacaacaactattgttctacattacaaaccttgatcaaaaaaccacactattaacattttccactaattgaagctagcaactaatgcaatatgcacatcttctccaaggaccaacatatcatctgtttatccttccattacagcaaactgctgatctaaac

SEQ ID NO: 21224 - DNA, 218 bp, Zea mays
  Clone ID: cC-zmle18900075f08a1
ttttgcttttcaccggatgaatttttaattagggtacgggacaatacgtagcgttatgggcacaaaaaaagttagtccgacttttcaatgccgaaatgattagtccgactggatcacacatggtgctcggggtacatgatctgtagcccacaagcaaaatcacagagacacttggcagacaagaagaagagttatccacatctagctttgtttcaggg

SEQ ID NO: 21225 - DNA, 226 bp, Zea mays
  Clone ID: cC-zmle18900075f08d1
cccgtccgccctgaaacaaagctagatctggataactcttcttcttgtctgttctgtgtctctgtgattttgcttgggggcggcagatcatgtaccccgagcaccatgcgtgatccagtcggactaatcatttcggcattgaaaagtcggactaactttttttgtgcccataacgctacgtattgtttggtagattaattaaaaattcatccggtgaaaagcaaaa

SEQ ID NO: 21226 - DNA, 314 bp, Zea mays
  Clone ID: cC-zmle18900075f09a1
gggcactggatgcacatacatatacccatttcattagatctatataatgcatgtgtctaaacttgttcaaatatatatacacacagactagcacagcaaacatacatcactccacgattgccacccgatccaaggacggtcttgcttcgtactgtcgacgatcaaaaatctgcgggccggccgggccatctttcctgctagcgaaatcgaaaccacgccatcacttattaagcctcagccggttctgggagtgtgatcaatcgggttgatgagtcgtactccaactcaatgccacagcttgccggacgcgtggg

SEQ ID NO: 21227 - DNA, 354 bp, Zea mays
  Clone ID: cC-zmle18900075f09d1
cccgtccgcccacgcgtccggcaagctgtggcactgagttggagttttacttatcaacccgattgatcacactcccagaacgggctgaggcttaataagtgatggcgtggtttccatttcgctagcaggaaagatggcccggccggcccgcagattcttgatcgtcgacagtacgaagcaagaccgtccttggatcgggtggcaatcgtggagtgatgtatgtttgctgtgctagtctgtgtgtatatatatttgaacaagtttagacacatgcattatatacatctaatgaaatgggtatatgtatgtgcatagagtgtacaaagaaaattttaaaaaacaaaaggaagagag

SEQ ID NO: 21228 - DNA, 284 bp, Zea mays
  Clone ID: cC-zmle18900075f10a1
gctggctaaatcttactcaaggggggggattcctaaaattacatcatgtattgtgtccatatccatgccacagttccaagcactttcactttcccacaacgcccaacaatcatattaacaatatggtaccaccacgttcatccacggacaaaggttgcagcgtacatcttataacctgcacctaaatggctttatacttttaactaccaaaagtacccttctacactacaccaataggaccttatttcaacaacccacaccccatccattctacatttccccca

SEQ ID NO: 21229 - DNA, 395 bp, Zea mays
  unsure at all n locations
  Clone ID: cC-zmle18900075f10d1
ttcagcgccccaccatgcagagggaaaagggggcaaatggagaggaagcacacactctaccccagaagaagcaaaaagaaagatgaagaacactgcaagagaaaacattgagaatgaagacatagatgaagcctggacgtgtataagagagcacaccctgccacacgtccatcaggagggcgagaagcgggctctcacctttggaacagagaacgaatcctcgcaaccaacaatccttaaaaaagggaaggaggcagctgcaagaggctcgatcagacctaatcaaaactcaaagggcctgactagactagctganggccgtgacgactggagccaggatattccttctgccaaacgccctcttgacaacgccgctttcaacagctatatccgaa

SEQ ID NO: 21230 - DNA, 460 bp, Zea mays
  Clone ID: cC-zmle18900075f11a1
ttttgattaaatcttgtaatttagaatatactgagtggggaacagggaaaagtacatgcatgcatgcatatatatatatatagctagaattattgagacgacacgtctcatctcctgcgcgggcggtactgcatgtggtggcacaagacgacgggccctggcggtgtatagctagctagaattataggaggtcatcctccttgtgcgtctcgatgacgacgtcggaggtggggtacgcagcgcaggtgagcacccaaccgtcggcgacctggttgtcgttgaggaagctctggtcggactggtcgacggagccagagacgaccttgccggcgcaggaggagcaggaccccgcacggcaggagaagggcaggtcgatgccttcctcctggcgaaagtcaggatgtagacgtcctcgggcacctgcagctccacctccccctgcggggtgatcagctttcac

SEQ ID NO: 21231 - DNA, 499 bp, Zea mays
  Clone ID: cC-zmle18900075f11d1
gaaccacccgtgcgcgcccggccggccagtcgagtgagtccatcctttatcgccattttatggccgccaccgccctgagcatgagcatcgtccgcgcgccgccgccctgcttgtcgtgcccactcaggctcagggtcgcggttgccaagccgctggcggcccccatgcggcgccagctgctgcgcgcgcaggccacctacaacgtgaagctgatcacgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttgctcaacgacaaccaggtcgccgacggttgggtgctcacctgcgctgcgtaccccacctccgacgtcggcatcgagacgcacaaggaggatgacctcctataattctagctagctataca

SEQ ID NO: 21232 - DNA, 330 bp, Zea mays
  Clone ID: cC-zmle18900075f12a1
aaaaacgagaacgggtaaatacctttcaactatatggacagccatcccaatcataagttcacttgacactctaagaattacaaacaaccttttccttctcacatgtccatggtgtgtctgaaggtaccagacacatggcccatgatcaacagccaatatacagggaagctcaaagggcaccacctaaaccggggtaaaaactgatgctattaacattatatctgccaaatcgggcgcccaaacaaaaaaaataaacgttcactttgtgcatcagagaaaattcacaaatattgtttttcaacaacgttcttagattagacgaacttcata

SEQ ID NO: 21233 - DNA, 456 bp, Zea mays
  Clone ID: cC-zmle18900075f12d1
ggctggggctcgggctctttctcctgttttacggacgcggatcgcatggggacctgcggggtgcgtgcgaagggtcagctctgctgctaacctacgggtttactctcacaagcagcggcatggcctgaaagcatgcagaactgaaaccagtaccctgcataacctacgctgatgcctttgctctaagagaaaagggtgctacccctattgtgaagcacgtcaggagtgatgatacacgttttagacatggagatgaacaacactcggatgaagcactgcagagaatctttcaatatggcctgcgcgggggcattcctagacgtaatgcacctatattacaaaagagtcgagaggaagacaccgacgatgggaaagacagggtagtgctcggatgtgaagcccaagcattggagctatctgattatgagaagagacaggctgacttcacctcctttt

SEQ ID NO: 21234 - DNA, 421 bp, Zea mays
  Clone ID: cC-zmle18900075g01a1
tttttttttttttttttttttttttttttttgggtcttgtttttttttttttttttttttttcctttttcctttttttttttgggggaaaaaaaacccaaacccatttataaaaaccaatcattccaccaatcccaaaaaaaccctcacaacaaaggccctttttttatttttacaaaaccaaacaaacattttttttccttttggttttgggtgaaaaaaaacccaaccaaggcccaaataaaaaaattttgtttacaaacgcctccccctccaaaaaacgccccccccccccaaagagggggggggggggaaaaaccccaaccgtaatccccttgcccccctttttggggaaaaaaaagcccaaaccccccccctctcctggggaaaaaaataaaacccccccccgggccctctcccct

SEQ ID NO: 21235 - DNA, 421 bp, Zea mays
  Clone ID: cC-zmle18900075g01d1
ccggcggagaaagaagagaagcaccatggcgcacctttgtcccctccctgccgcatagggggggtcatgctcgcctcctggctctcttcttgccctcgcgtcgggcttctggggcgcgtctgctgcccggtgccggggccgggacgccacccggcgccgcgcgtctccggtcggtgcgatggcctggacggccgctctctcggccctatatgcaacaggaacgcaagctgacgaaagctcaaggagcacatcaggacaaggtgggtcggcggtgtccaagcactgccacctggccgggaggagacctgccctctcccgcgcggggaagctcgccgggccccagactcgcgctgcgagatcaccctttaccagcgcctgcgtctgccgccaggaggacccagtccactacccagcatcgacc

SEQ ID NO: 21236 - DNA, 543 bp, Zea mays
  Clone ID: cC-zmle18900075g03a1
catgcacacatccgtaaacttgcatcctctaaaacgaccgccctttttttttttttttttttttttttttttttttttttttttttttttttgtttttttttattttttttttttttattaccctttaaaaataaaaaaaaaaaaaaaataaaaaacttttaaaacacaacccaccccaccaaaaaaaaaccccctaaaaaaaaaaaaaaaaaaaaaaaaaaaaaaaaaagaaaaaaaaaaaaaaaaaaacaaaaaaaaaaagggaaaaaaaccccccaaagggggcttgggaagtttttcaaaaaaaaaaaaaaaaaaccccccttaacaaaaccatattcaaaacccggggggcaccaaaaaaaaaaaaaacctaacccctaaacaaaacaccctcccaaaaaaaaaaacaaaaaaaaaacttccaaaaaaaaaaaaaaaaacttaccccaataaaaaaaatctacccctaaaaaaccacaaaaaaaaaaaaccgaaaaataaaaaaaaaaaaccctggcccaaaaaaaaaaaccacaacc

SEQ ID NO: 21237 - DNA, 482 bp, Zea mays
  Clone ID: cC-zmle18900075g03d1
cccgtccgcccacgcgttcggagacgagggatgtgtaatctgattttcgaataaccgaccaaaccaaccttggacgctgtcgggtccgtctgtggtgtggtgtggtgtgttgtgttgtcctttttcttgttcttctgttttcttttgtttttaatccgacttcacactgcataaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaataaaaaaaaaaaaataaaaaaaaaaaaaggggggccctttttaaagatcccaattttacttcccctgggggggggggggagggttttttttttgtgtcccttaattttaattattgggccgccttttaaaaacggtgtaattgggaaaaaccttgggttacccaaattatatccctttggaaaatattccctttttccaattggga

SEQ ID NO: 21238 - DNA, 510 bp, Zea mays
  Clone ID: cC-zmle18900075g04a1
gaaacagttgccaaaaaggcatatgaaggattccttgatttgatctaccaaaaaaaccatcacctctatctgattgaacaccgtcaggcacagcacataaatgaccaacaagaactaaattctacgctcgtgaagggtcctggtctaaccattaaaaacaaatcagcagcgggggaagccgcagaggtgacataagctcctattatacactcacaaatattaagagttctcaaaataagcagacgccagaagagctaaaacacgtcaaaaacaggtctatgtctcccttcgggtcctccgacgtgggcctgtctcgtccttttcatcctctttctcatccttgtcaccactgcttccagcaccgtccgtctccgcggccttgggcttcttcgcctcagctgcaggtttcacaggtgccaccggcttcttgccaccaaaaaggatcttgaagagaacggtaacgaacacgatgacaacggagaccaaaatgccaatagtgattgttgggct

SEQ ID NO: 21239 - DNA, 445 bp, Zea mays
  Clone ID: cC-zmle18900075g04d1
cccgtccgcccacgcgtgcgcctacgcatggacctagcaagggacttcgctttgaaaaacgccctagacaaggcacgggccgggccagataccacaaatgatcggacactggacctgcaacttgaaaagggacttgaaagtggacgtgcctgcataggtgccaaccttaactacaatcctccttaggatgccggagggtatgccaaggagactgcatacgctactacatacactacaaagtaaggtgcatataccagcagggcaaacaacatgcttcatcacatgcttactcacactagtacgaatactgagcagcaccttgagcatcaactttcagtcccacacgacgagctatacgacgagcactctgatgtctacacacctaacaaggaggcaaacaatgaggtcaaaagtgagaacgatagggaagaaaacatgattgctg

SEQ ID NO: 21240 - DNA, 498 bp, Zea mays
  Clone ID: cC-zmle18900075g05a1
ttttccttcaattgcttctctttccaaaccatgatttgggcatcaaatgtacagaaaattatcatcacgcaagagaatacagtaattacaagttgcacaagtgacgactgcaggcacagctaacagctttctacatgctagctaatatgctactattctctacctctaatatttgctaccaagcacctgcagcttaatccgcttgtgctaccaccagttcttgcagcttaagaccaccaaatccatagcaagtccgcatctgcaacgtcacggccaaatggtccggccctgtcactgattcacgaataactccatgttgtaggcatccttgtggactgaattggaggagcattccgaacattcacatcaagtggcagcatccgatactcaatctcgaggtccttcaggactttgatcatctcctggagcactagctctcgcctgacgaaccgcatacccatgtcctggaagttgagcgtgtgccgcagccatattgac

SEQ ID NO: 21241 - DNA, 587 bp, Zea mays
  Clone ID: cC-zmle18900075g05d1
cgtccggaatttttacagaagtcctgatatgggagaagcaattttcttttttattcatgtctcaactcctgtcgagaaaggggccctgatgaaggaacgaatactgcgctacattgacaacaagaaggaacattggtacccgggtgcgatggttgtactccgggacgtcgatgacaccaacaaactgaaagtgtcaatatggctgcggcacacgctcaacttccaggacatgggtatgcggttcgtcaggcgagagctagtgctccaggagatgatcaaagtcctgaaggacctcgagattgagtatcggatgctgccacttgatgtgaatgttcggaatgctcctccaattcagtccacaaggatgcctacaacatggagttattcgtgaatcagtgacagggccggaccatttggccgtgacgttgcagatgcggacttgctatggatttggtggtcttaagctgcaagaactggtggtagcacaagcggattaagctgcaggtgcttggtagcaaatattagaggtagagaatagtagcatattagctagcatgtaaaaagcttgtagctgtgcctgcagtcgt

SEQ ID NO: 21242 - DNA, 452 bp, Zea mays
  Clone ID: cC-zmle18900075g06a1
aaagcgacagacttcaattacaagtgcagggactagagcagttcagcaagtgatgatggaaggaaacacccaaacattacccaggggggccaggacacaaacaaaggtttttcaacaccacaacctggctcgacagccaaacagattcatgcaagcagatcagtattcctcctcctcgtcaccgtcatcactgccgccctctgcggcgacctcctcgtagtccttctccagggcggccaggtcctcgcgtgcctcggagaactccccctcctccatgccctcgccgacgtaccagtgcacgaacgcgcgcttggcgtacatgaggtcgaacttgctgttgatgcgggagaacacctcgacgacgctggtggagttggagaatcatgcacaccgcgcgctgcaccttggcgaggtcggcacccggcaccactgtcggcgcctggtagttgatg

SEQ ID NO: 21243 - DNA, 583 bp, Zea mays
  unsure at all n locations
  Clone ID: cC-zmle18900075g06d1
cccgtccgtgtgtctcaggtgatctcatcgctgactgcttctctgttgttttttggtgccctcaatgtggatgtgagcgaggggcagaccaacctggttccttacccgaggatccacttcatgctctcctcctacgcaccggtgatctcttctgcgaaggccttccacgagcagctgtctgtggcggacatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccaggcgccgacagtggtgccgggtgccgacctcgccaaggtgcagcgcgcggtgtgcatgatctccaactccaccagcgtcgtcgaggtgttctcccgcatcaacagcaggttcgacctcatgtacgccaagcgcgcgttcgtgcactggtacgtcngcgagggcatggaggagggggagttcttcgaggcac

SEQ ID NO: 21244 - DNA, 213 bp, Zea mays
  Clone ID: cC-zmle18900075g07a1
ggacagacgattggggatttgcacgttccatgttctgaaatgaaggctatcagagacgccaattacaaattattatacacttattatacaaacgcaggatctgtgctataactaataagaaaaccgccaaaactgaatctacggcgtgttcttcctttgcacgggcaatctgtaacttttatctttctacagaggccttaagagcgggtaatc

SEQ ID NO: 21245 - DNA, 523 bp, Zea mays
  Clone ID: cC-zmle18900075g07d1
cccgtccgcccgctcccaccaccgccgcagccctctcctcctccgtttccgtatcacattccacttccattcccgcgggccgggccgccatcatggccaccgcctccctcctcgaggccactcgcctcctttccaccccgcgcccgccccgccgcagcctccacacccacctcctcaggaccccgcgcctctccgctctccgcgctcacctccaccgttccgcaactctcgacgcgcaggagccgacggcgaggcctggcgcgctcctggtcctcgacgcgctcaggaggtccgtggtcgactccctcgcggcgctcaagcggcccgcgctcgcgctcctgctggccggcgcgctgctcgccgcggcgtcaatgggcgggccgcacgccgcggcgctggccgcttcgggcgggcgcgtcggcgggtccgccttctcctcccgctcctcctcacctccgtcctacggctacagcgcgccggcgcccaggggcgggtacacggtcgcgccctactactcgccttc

SEQ ID NO: 21246 - DNA, 217 bp, Zea mays
  Clone ID: cC-zmle18900075g08a1
aaatcatgaactttacttgccatgggaggagaaagtaaacaagcaacatatttatgccattgttcaaggagacccgatcacattaacagtactagcagccatcgtcgccggcaccacagagaagcaacacatactcaaacatgccagagctgccggcgacgagattgatatatagttgacacatctatcacacgacacatgtaccagcagtataaca

SEQ ID NO: 21247 - DNA, 229 bp, Zea mays
  Clone ID: cC-zmle18900075g08d1
ccggtgtcgtgtgatagatgtaccaacaatatatcaatcttttcgtttttaacaccggcacacaaaaacagggataagggttctttttatccagcgactaccactccacaccactgtaaatgttatcaaaactacctgaacaatggcataaatatgcagactgtaaacttttatctctaatggcaagtaaagttcaatatttgcgaataaaaaaaaataaaatgtctgt

SEQ ID NO: 21248 - DNA, 460 bp, Zea mays
  Clone ID: cC-zmle18900075g09a1
atatccacaacaatccatatagagttggattaggaactatgtttgaagtaacattccctattacttgggaagaaatgaataaaggagcgaaaaaagaggaaaacgaaggtaacacctgaatttggttgatataagaaaagaaattttataccccaaattcagggtgttacaaaaacaccacctaatgaaacctgaatattgtaactttgttgctgccataatgaaattcagtgttaccgtgatgagaaaaaagtcaccacctaatgatttgtcttcgccatgtacatgttctgttgttggtgcaaatttgcaaaatgatagatgccaacagaccttgtgtctctagttccatcccatggatagttggcaacaagagcccccccatgcaagctagcagaagccgtgaagtgttcttgctttacccaattcataatggctctagtttcaagctgtttggtca

SEQ ID NO: 21249 - DNA, 420 bp, Zea mays
  Clone ID: cC-zmle18900075g10a1
gggggaaagttgaagtatcattcataatcagaagctggtagcttttggatcaagtcagttgcctcttattacattacagatggagcataggctgcacgcatttagatgaagaaaaagaagctaatttttcattcaaacagcataacataactggctgtccagacaggcaattcggacaacacctggttggtcagcgcttcttgtgctcctggacgaacttggagttcttgaggtcctcctcggtgaagttggccgtcatcttagtgatgatgaagccggtgatggcaaaccccgtgaggaagggccaattgcgcttccactcccggcggaagaagaccggccacggatcgaacgtctttatctactaggcctccggcttcggcttcggctccggcttgttgcgatcttcttgcacccttc

SEQ ID NO: 21250 - DNA, 519 bp, Zea mays
  Clone ID: cC-zmle18900075g10d1
gaaccacccgtgcgggggatcgaactcgaaggagaatttccattcgttcccatccacttctcacctcaatctcgcgagaggcgaagccggaggaggagggtgcgaggacatcgcgagcagccggagccggagccggagccggaggcctagtagatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccaggtgttgtccgaattgcctgtctggacagccagttatgttatgctgcttgaatgaaaaattagcttctttttcttcatctaaatgcgtgcagcctatgctccatctgtaatgtaataagaggcaactgacttgatccaaaagctaccagcttctgattatgaatgatacttcaagtttcgatcaaggg

SEQ ID NO: 21251 - DNA, 374 bp, Zea mays
  Clone ID: cC-zmle18900075g11a1
attattatcttcctatcccctcaccttcttattaaacacttcctattcaaaaataacacttatagaagaaaaaaagcctccaaaactaaaaaaaaaaagggaaccccttaaacaccaaaaaaaaaaccccaaaaaaaaaaccccctttccaaaaaaaaaataaaaagctctaaaaaaaaaacccccccaacccccccaaaaaccaattttaaccccaaaaaaactcaaaaacacccaaaagactcaaccccattccccaaaaaaacaataaaaaaaacctgtccaaaaaaaaaaaaaaaacccacccccggaaaaaaatttttcccgtaaaaaattccaaaaaaaaaacatcccaaaataaaaaataaaaaccc

SEQ ID NO: 21252 - DNA, 421 bp, Zea mays
  unsure at all n locations
  Clone ID: cC-zmle18900075g11d1
gggacgcgtgggcgaggataatcnngaaagacttttcaaaatttcttgccaagagagcgaaaagggggaggctggggacaaggacgcatagcgcccccccatatgccatcaacatgaagagaccattgaacataatataaagtaaataagactagttaaaagaataaaaaaaaaaaaatataaataaaaaaaataaaaaaaaaaaaaaaaaaaaaaaaaaaaaaaaaaaaaaaaaaaaaaaaaaaaaaaaaggggggggccgtcttaaaaaacccaagcttactcccccgggcagggaccgacaaagccttctattaggggccccaaaataaattgggggggccgccggttgacacctccaggacgggaaaaacccgggcgttccccnccaaaaanccctgggggaaaatccccctttccc

SEQ ID NO: 21253 - DNA, 476 bp, Zea mays
  Clone ID: cC-zmle18900075g12a1
ttttgataagaaatcgttttcaccaacaaaaggttaggttaacaattgcacgaatgcactgcaaacatagcaagcaaccattcttcttaatcatctaacgccctcccgtttcaactccacgcttgctgattttggtagcaagagcaatctaagaccttggcttctctttcttctccttgaaaagggcaagcagagacacaccggaaaccttgacgaccttgaaccggacaccaggaatatctcccacagcgtgccccttacgaccaaatccagcaatcaagacctcatcattttcctcaatgtagttcaaacaaccgtcatttggcacgaaggcagcaatcttcttgccattcttaacaagctgaacacgagcacacttacggatagcggagttgggctgcttggcctcaataccaatcttttccaggacaatgcccttggcatgggatgacccacgaagggtttcttccactcat

SEQ ID NO: 21254 - DNA, 530 bp, Zea mays
  Clone ID: cC-zmle18900075g12d1
ccgtgcgggcggtcccgctcccagctcgtgttccgcttttttcagccgttttcgcgaagcgctccagagagcgtccgtcggcgtggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactgcgctatccgtaagtgtgctcgtgttcagcttgttaagaatggcaagaagattgctgccttcgtgccaaatgacggttgtttgaactacattgaggaaaatgatgaggtcttgattgctggatttggtcgtaaggggcacgcctggggagatattcctggcgtccggttcaagggtcgcaagggttccggtgtgtctctgcttgcccttttcaaggagaagaaagagaagccaaggtcttacaatgctcttgctaccaaaa

SEQ ID NO: 21255 - DNA, 483 bp, Zea mays
  Clone ID: cC-zmle18900075h01a1
cctctaaagcggccaccccccccccccccttccccttcccccccccccccccccccccctggttctctggtaacactctcccccccccccccccccccccccccccccacccacccacccctcccctccccccaaaaaaaccaaacacaccacaacaccaccaaccaacacaaaaaaaaccaaccaacaaacaaaaaacaaaaaacccacaaaaaaaaaaacccccccaaaccccccaccgaaaaaaaaacaaacaaccaaaaaaaaaaaccaaaccaaccctacaaaccccaaaaaaacaccaaaaaccgctccccaaaaccctctcaggacaaacaaaaaaacaacattaaaaaaaaacccccccgcccccaaaaaaaaaaaaccccttgaaaaaaaaaaaaaaacaaaagccccccccaacaaaacacccgaacttaaacaaaaaaaaaaaaacctaaaaaaaaaaaaaaacccccccaa

SEQ ID NO: 21256 - DNA, 452 bp, Zea mays
  unsure at all n locations
  Clone ID: cC-zmle18900075h02a1
agcactcacgagcattatgcattggggggaagatctccaacgacatgcatttcttttcttctctcctggagcatgagtgcatgacatgtttgccctcatgagcactgttcgttatagaagatctgtagtacatcttttttacaataacgaagggtatggttgagatcgataagtagtacggtggtgaccgtagatagtcgaatcctccgctgcgactgcgattgaatcatagtacgtcatctccagcttgtctgtcctccttttcgtaggatgtatcaaaattggcacttgtgttcaccgcgcggtgctcagtgcacgaggtaggtgacggcgagcgcggcggccatgagcacgtacgccaccgtctggtccaccacccgcgccgtcgtctccgccactgccgccttcttcaccgacgaccccatcggnggcaaactttttagctgtcggag

SEQ ID NO: 21257 - DNA, 472 bp, Zea mays
  Clone ID: cC-zmle18900075h02d1
gcgaggccatccaccaattgactccgacagctaaaaagtttttctctatggggtcgtcggtgaagaaggcgggggggggggagacgacggcgcgggtggtggaccaggcggtggcgtacgtgctcatggccgccgcgctcgccgtcacctacctcgtgcactgagcaccgcgcggtgaacacaagtgccaattttgatacatcctacgaaaaggaggacagacaagctggagatgacgtactatgattcaatcgcagtcgcagcggaggattcgactatctacggtcaccaccgtactacttatcgatctcaaccatacccttcgttattgtaaaaaagatgtactacagatcttctataacgaacagtgctcatgagggcaaacatgtcatgcactcatgctccaggagagaagaaaagaaatgcatgtcgttggagatcttccatgcaatggataatgctcgtgagtgct

SEQ ID NO: 21258 - DNA, 510 bp, Zea mays
  unsure at all n locations
  Clone ID: cC-zmle18900075h03a1
ttttattaaagtattgtcggcgcctcggcagggttgggtatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaaagggagggagagagagagaggaaccaatgcaagaaggtgatccgatcaacaggcagaggcatggccatgggtcgatctagccacggtctctactcgctgccggggggcttgtaggcgatgaagctgacgcactgcgtctgcctgacgttgtcgaagccgatgacgcggtggaaggcgtccgggtacgcggcgatggcctnctgcagctccttgtacacctgcgtggcgttcgtgcagccgaacatgggcagcttccacatggt

SEQ ID NO: 21259 - DNA, 597 bp, Zea mays
  unsure at all n locations
  Clone ID: cC-zmle18900075h03d1
cccgtccggctcgatctactactactactagctggtacacatactatccattctgccagccagcttgccatggcgcccaccgggatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacanagcccccgcagcgagtagagaccgtggctagatc

SEQ ID NO: 21260 - DNA, 367 bp, Zea mays
  Clone ID: cC-zmle18900075h04a1
ggggtgaaacaaccccttgggttacatctcatcaatacacatgactgattggggctatcagatcaccaacaacaacatttagcaaagccaaccaagaagaaaaatggaaacccacaccctctctctgatatatatactggatgcatgtactcaccatgaatccaggatgatgatatgatatatcaagcaaacatgcagagccaaaaccatggagtatatatactttgaggatcaggaccacccgtagaccaggtttaggtagcggtccttgatccacttgaagctcttgcggaaggagccctttattttgccctcacgccgtacgccttgtacgccgccacccggcgcttgcgctccatgtccgggt

SEQ ID NO: 21261 - DNA, 487 bp, Zea mays
  Clone ID: cC-zmle18900075h04d1
cccgtccgagcgccggcggcagcgggatggggacgtcgtcctacttttacttttacgagtacggcggggcgggggcgggggcgggggaagagatgaagcggagcaagtcgaagcggcggtggctggcgctggcggacccggacatggagcgcaagcgccgggtggcggcgtacaaggcgtacggcgtggagggcaagatgaagggctccttccgcaagagcttcaagtggatcaaggaccgctacctaaacctcgtctacgggtggtcctgatcctcaaagtatatatactccatggttttggctctgcatgtttgcttgatatatcatatcatcatcctggattcatggtgagtacatgcatacagtatatatatcagagagagtgtgtgtgtttccatttttcttcttggttggctttgctagatgttgttgttggtgatctgatagcaccaatcagtcatgtgtattgatgagatgtaacccaa

SEQ ID NO: 21262 - DNA, 529 bp, Zea mays
  Clone ID: cC-zmle18900075h05a1
tttttatcaacaatcagtcaagctacctcgcctcatgggaatataacatcttgaacaaccataatacaaaatgaaatgcagttctgtcacgacaacatcgcattcataagcaataccacccatctagtacctagcaagcatcaccacacgaacctcaaactgacgagtactaacagcgatacaaggaatatcatatctgtaccaagcactgcggagaatgacttaggtctcttcctcttcttcctcctcctcctcgtactcctcatcctcggcagtggcatcctggtactgctgatactcggccaccaggtcgttcatgttactctctgcctcggtgaactccatctcatccataccctcgcctgtgtaccagtgcaagaaagccttcctcctgaacatggccgtgaactgctcgctgacgcggcggaacatctcttggatggaggttgagttgccaacgaatgtggaggacatcttcaggccaattggtggaatgtcacacacactcgacttcacgttgttggggatc

SEQ ID NO: 21263 - DNA, 567 bp, Zea mays
  Clone ID: cC-zmle18900075h05d1
cccgtccggctctccgttcaccagctcgttgagaacgcagacgagttcattttgctcgacaacgaggctctctatgagatcgggttccgcacgctcaagcttgccacaccaacctttggtgatctcaaccaccttatctctgcaaccatgagtggtgttacgtgctgccttcgcttccctggtcagctgaattctgacctccggaagcttgcagtgaacctgatccccttcccacgtctgcacttcttcatggttggatttgctccactgacctcgcggggctcccagcagtaccgcgctctcaccgtgccagagctgacccagcagatgtgggactccaagaacatgatgtgtgctgctgaccctcgtcatggccgctacctcacggcatctgctatgttccgtgggaagatgagcaccaaggaagtggatgaacagatgctgaacgtgcagaacaagaactcttcctacttcgtggagtggatccccaacaacgtgaagtcgagtgtgtgtgacattccaccaattggcctgaagatgtccttcacatttcgtggcaactcaacc

SEQ ID NO: 21264 - DNA, 452 bp, Zea mays
  Clone ID: cC-zmle18900075h06a1
ggttgtgtaaagcattgtttggaactgggcgcttacagaatagaatttgaaatagaatatgatagctgcttgggacaggcagacagccttatagataacaacaccagacgcacccatgacaatacccagctaatctattactatgttggctcatcgatccaacacctttttttcgtcgtcgtcgtcgtaatcatcttcacacgcacgcacgcacacacaccatcgttttattcatccggatccattgctttagttcagaagttggggcctgcggcgaggatctcgtcagtcaggctgctgtcgtccccgatcttgtagctggcgaacacctcgaagttcttcttgaagagcccgccgagcctcaggagattctccttgtacgcggccttgtccgttcaggtgttgatccggtcgaggatttccgacggcacgccgttgatctcagtggggat

SEQ ID NO: 21265 - DNA, 583 bp, Zea mays
  Clone ID: cC-zmle18900075h06d1
tccggccgcaggccaccttgtccgcctgcttcggcgcggcctttatttttctccacccgaccaagtacgccggggtgcgcgccgagaagatgcagaagtacggcgccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggggacgacagcagcctgactgacgagatcctcgccgcaggccccaacttctgaactaaagcaatggatccggatgaataaaacgatggtgtgtgtgcgtgcgtgcgtgtgatgatgattacgacgacgacgacaaaaaaagggtgtggatcgatgagccacatagtatagattagctg

SEQ ID NO: 21266 - DNA, 403 bp, Zea mays
  Clone ID: cC-zmle18900075h07a1
aaaatattcaaaaactataaattccaacatcttcttttttaaaaaaaaaaaaaaaccccattttttaaaacccaagggaaaaaaaaatttatttttttttaaaaaaaaaaaataaaaaaaaaaattaccccctccccgcggggggtaaacaataatttatttttttaaaatcaccttctctatatataggcgggaagggggaaaaatttttcttcatccccggggggggataaaacaacccgggctgtttgataaaaaaaccacccttggtgttgaaaaaaaaaaatataactggggagaaccaccccccatccccgtcgtgtgggaagtaaaaaatccctattaaactcaccaaaaaagacttctaatggaaaaacaacaaatatttttttccccccccccc

SEQ ID NO: 21267 - DNA, 488 bp, Zea mays
  Clone ID: cC-zmle18900075h07d1
cccgtccgtgtatttgtggtggaggggagagaatcccggatgttttttgattgccaagcgaggtccacgtgacgctggctagggatccgattggaggccccaaccaaaaatcatcgtcaatctcatggtgtcgagtggggattgactatggtacgttaattaatcacgtggtatggaggacaagagatggattgatcacaagacgatgctgatggacgaagctaaagaggataaatcaaccaagtgccaggatgggaggtgctcgccaagcgagtatcatttaacaacactaacgtagtgtttatcccaggcaagccccggtgcatttgccacccccttgttgttataaaacttttatcacttatatgttgcattaggtgataggagttgtgtgaataaacagttgatgcattaccattccttggaatttgattactattccttgattcctctttataaaagagaactaaagatgcttagccctgctt

SEQ ID NO: 21268 - DNA, 208 bp, Zea mays
  unsure at all n locations
  Clone ID: cC-zmle18900075h08a1
ccccccccctcccccnnccccttctttccctcncccccccttttttctttctccccccttctttttctctttctccccccctttttttttcctttccctccctttttcttctctttctttctttttcccttttttttccttctctccctccccccttntttccccctttcctttttttttccttttttgccgggggggtggcctcccc

SEQ ID NO: 21269 - DNA, 313 bp, Zea mays
  Clone ID: cC-zmle18900075h08d1
tccgaagttattcatagatgactcggtcatgggaatatttgttttattttgtcatgtatcgttaaatttcagggggttggtttcagctgccagaactgttagcaagagtattctggagctggaagctcgaacgcaactggttgtatctatatccgtgaatgccgaataaaggaggggcaataaactgcagcgaaaaaaaaaaaaaaaaaaaaaaaaaaaaaaaaaaaaaaaaaaaaaaaaaaaaaaaaaaaaaaaaaaaaaaataaaaaaatatgaaatttacataatatagtttcaatattttttccttttt

SEQ ID NO: 21270 - DNA, 381 bp, Zea mays
  Clone ID: cC-zmle18900075h09a1
aaacatcgccatactgtttaagtttccccatgcttcaatgtctcgctggggctgatgacttaggaagatggactcacttgctcgaaggctggaagagaatttatgggatcaaaacatgatcggaccttggaactaaaaactccaaccaagaaaacggaaaccaaatacacaacggggctcatgaactggacgagcaaaagcacatgccatagatgctgtattactgacatactgctctactcgccttgcaaaactacggcctttatcctgcgtctctcgctggcttagagccatttgaagagaatgccaccatgggcggcgaaaaagggggcgaagacaagggattcaaccgccataagcttgatgaggatgttgagggaa

SEQ ID NO: 21271 - DNA, 488 bp, Zea mays
  Clone ID: cC-zmle18900075h09d1
cgagggactcaacgaccacaacgtcgtcgtcaagtgcgctttgatttttaccgccatctctgaaggagctagggcgggccttttcactgagtacaagtatgttggattcttcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgcctttcgagctggtgcagtaatgggcttcctgcttgctgccagcggacttttggttctttacattgctatcaatttgtttggaatttattacggtgatgactgggaaggtccttttg

SEQ ID NO: 21272 - DNA, 569 bp, Zea mays
  unsure at all n locations
  Clone ID: cC-zmle18900075h10a1
tttttatatatacatttttatatataaaacaagccaggctagttgtacaaccgcatgtaactcaagactcgccaaaagccccagcactcattatttaccactaacaacaacctaacactatgaacatggtactccaggcctcatcctgagccgagccgtctccaatcgtgcagagagtcggtgatttacacgttgctgcttgaggcctgcatcatgccgtcgcggatctgctcgctgatgtccttcacgtggcctggtccgtggggtatgaagatcgtggtgttcttggagccgtccccgagctccttgatggtgtcgaagtactgcgtgaccatgatcaggtccatgacctccttcgcgctggtgcccgacaccgagtgtgagaagttcaggatgttctctctaaggccgtcggttatcgcctgccgctgtttagcgataccgacaccagaaagatatttcgcctctgcttctgcctncgctttcttcaccataaggatcttctctgcttctcccttgaaacacttgccagttgaagccttttggctgcattatgtcgttcattgcct

SEQ ID NO: 21273 - DNA, 552 bp, Zea mays
  unsure at all n locations
  Clone ID: cC-zmle18900075h10d1
ccacgcgtgcgaatgcccagcagcaaatccattcctacgtctttgatgttggtcgggccatagggccgagaaggaatctggaccatctctttgaccagaagaaccatgtggccaaagctgtattggaggagcttgaaaaggtgatggcagattatggttacagcattgagcacattctcatggttgatatcatccctgacgctgctgttcgtaaggcaatgaacgacataaatgcagcccaaaggcttcaactggcacgtgtttacaagggagaagcagagaacatccttatggtgaagaaagcggaggcagaagcagaggcgaaatatctttctggtgtcggtatcgctaaacagcggcaggcgataaccgacggccttagagagaacatcctgaacttctcacactcggtgtcgggcaccagcgcgaaggaggtcatggacctgatcatggtcacgccnnacttcgacaccatcaaggagctcggggacggctccaagaacaccaccgatcttataccccacggaccaggccacgtgaaggacattagcg

SEQ ID NO: 21274 - DNA, 429 bp, Zea mays
  Clone ID: cC-zmle18900075h12a1
atccaaaccatatgccataacttggtatggacatgataatttcagcacgcgttcttacatcacagagggggtggtaagtaatacaacctgctgctccgaaccacacctagtacacgtgcgctaactttggcatgcagggagtacccaaaaaaggagctttacagtggagtggacacacccaaactgacgaccggccgtggcccaacgcgacacgagcagtcgatcgttcgagcaaaaaagcggagtggctggtgcaagcacgaaggcaagggagcagcagcgcactagtatttagtatggtacagcaccacgtcgtagtacaggtgcacgtcgtacaatgtaggtgtatatataggtacagtacagtccgtgcggggcggattgcaggcagagcaaaacgagcaacgccagctggagagcccggcggta

SEQ ID NO: 21275 - DNA, 439 bp, Zea mays
  Clone ID: cC-zmle18900075h12d1
gacgcgggggagaggcaccagcggcacagtttacccaagattagcggcgagaggccaccggggcgccggacgggcccgcaggcggggctcgcctcgctctgcccgcaaaccgccccgcacggactgcaccgtacctatataaacacctacatactacgacgcgcacccgtactacgacgagctgctgaaccacactaaatactagtgcgcagctgctcccttgccaactggctggcaccagccactccgctcctgtgcacgaaccatcgacagcacggggcgcgtagggccacggccggtcggcacgaggggagcgcccacaccactggaaagctcctcgggtgggtacaccctgcatgccaaacggagcggacgtgcactaagagcggatcggagcaccccggcgcacgactgaccaccccctctgccacgtaagaac

SEQ ID NO: 21276 - DNA, 532 bp, Zea mays
  Clone ID: cC-zmle18900076a01a1
ctggatcctctaagcggcgccttttttttttttttgtttttttttttttttttttttaaaaccgggggtttattcatgttatgacaaggaaattcattatactccgtacttagtacacgaaccttgaacaaaacatattctgaacacttaggtatttacagaaaaccgcacacaccggttttcattaataagtagaaaaggacaagtctaatgcatagcagcataggtgcaacactaaaatattaccacataccataaaacgagcttcagcttcagattatcatgctgcaaaacttccaaaagggacacctggatggtagatgacttgattcaatcagtctcatgatcagggcgtggggtgtaccattcagggtatctacccatccttctcagcaaccttgtgtatggagactctggcatcaacgcctcctcttcttctgtgagctcttcctgtgttttcggcatcccatcaggcacggggaatggccctggctttgcagtttgcccctgggagcctgattgtactgaaata

SEQ ID NO: 21277 - DNA, 583 bp, Zea mays
  Clone ID: cC-zmle18900076a01d1
ccaagccgctcgtgcagcgtaccaaggaccagatcacatttttattgcattatcgtcgaaggtgatgaagggtgcagctggggggatgcttactttgaactgaataaacttgagcaagagctgcccaaagaggaaatctcaaggatggtgaaggactcagagggtgacgtgaggtacctgatcgagagcattcatcatcgctcagatttgcggaagaagatagcagagaaatctcgtaattcagtaccatcaggctcccaggggcaaactgcaaagccaaggccattccccgtgcctgatgggataccgaaaacacaggaagagctcacagaagaagaggaggcgttgatgccagagtctccatacacaaggttgctgagaaggatgggtagataccctgaatggtacaccccacgccctgatcatgagactgactgaatcaagtcatctaccatgcacgcgtcccttttggaaagtttgcagcatgataatctgaagctgaagctcgtttatggtatgtgggaatattttagtgttggccctatgctggtatgcattagactttgtcttttcatgctataat

SEQ ID NO: 21278 - DNA, 397 bp, Zea mays
  Clone ID: cC-zmle18900076a02a1
tttttttttttttttctttttctttctcttcttatttttgtttggattcatttatttatatcctttaaaacccccatataaaaactcctacaatcaccccaaccccacctacagccaaagaaacaggaacaaaaccccccacaaactattacaaataaaaaaaaccaccacccaaaacaaaaccctccccaaattaacacaacaaacaaacccaataaaaaccccaacaaatactacaaacccaaaaaaaatatacctcacgaacaaacacaatccacaaacccaaaccaaaaagcccgggaaaacggtggtgccccaaaaaaaaaaaaaaaaacccaaacacacccaaaaaaaaacacaccacccaaacccaaaaacaaaccccttttcacgcccc

SEQ ID NO: 21279 - DNA, 522 bp, Zea mays
  unsure at all n locations
  Clone ID: cC-zmle18900076a02d1
caaccacccgtaccgaaactcaaaaaaaaaaaaaaaaaaaaaaaattaaaaaaaaataaaaaaaaaaaaaaaaaaagggaaaaaaaaggaaaaaaaaaaaaaaaaaaacccaaaaaaaccaaaaaaaaaaaacaccacaaaggaccccacctacagacgaccccaaagaaaaaaccaccgccaccaaaaaacaccacaacaaaaagaaaaaccaaaaccaacccaaacccacccacccaacaaaccagcacacggaaaacccccggcctaacccaaaaaaaaacaccacacacacaccccccccaaacaaaaacccgcacccacaacaaaacaaagaacacaaacccctttccccccagagcaaaaacaccccgacagaacccaccatagaaaaaagaacccacctaacccaccccccccctcacaaagtgccccaaacacgtccntggcacactcaccccttaaatgggcaaaactcctaccaccaacccaaataaaacaaaaccgccccccccccacgaa

SEQ ID NO: 21280 - DNA, 173 bp, Zea mays
  Clone ID: cC-zmle18900076a03a1
ttttgttgcataagcatgagtcattctctgagagcagaattgtcgtccttatcaaggacctatatatcacagctccaaattttcttgagttgacacacaccatgttatacaattttacacgctagaatgctaaccatatgcagatagaacctagccatagaaaatataataag

SEQ ID NO: 21281 - DNA, 183 bp, Zea mays
  Clone ID: cC-zmle18900076a03d1
gtcattttttcttattatattttctatggctgggttctatctgcatatggttagcattctagcccgtaaaatcgtataacatggtgtgtgtcaactcaagaaaatttggagctgtgatatataggtccttgataaggacgagaattttgctctcagagaatgactcatgcttctgccccaaaa

SEQ ID NO: 21282 - DNA, 508 bp, Zea mays
  Clone ID: cC-zmle18900076a04a1
gtttacctactccctccgtttccgtttcaaactgtgaatgattttaactttttttgagtcaaagcatcttaaatttaactaaaattatagagaaataaaaaaatgtgatatcaaacaggtatactatgaaaatatgattaatgaagaatatggaaatataattaatgaagaatctaaagatatttggtatcataaatgttattattttattatataaatgtggtcaaacttgagatacatttgaatatttgtaaatttggtaaaacctgagatgctttgacttttttttaagaaagttagaataacttataatttgaaatggaacagagagactgtttctttctctcttcgagcatgtacagaaactaccagtttcgtggttgctggcctcgctggttggagaaacaacacctgccgccggccatttttgtactttgtagtttgtaccagaacgcataaagatatcatggtgacgagattgtctcaaaagaaaaaaaaaaaacccacg

SEQ ID NO: 21283 - DNA, 532 bp, Zea mays
  unsure at all n locations
  Clone ID: cC-zmle18900076a04d1
gacccgggggcggacgcggggggggccccccccccgggggatataagcgcgttaccagganacccaaangcgggcaggaacagacaacaaagaacaaaaagggccggcggcaggcggcgcagctccaaccagcgaggccagcaaccacgaaacggggagcggccggacatgctcgaagagagaaagaaacagnctctctgttccatttcaaattataagttattctaactttcttaaaaaaaagtcaaagcatctcaggttttaccaaatttacaaatattcaaatgtatctcaagtttgaccacatttatataataaaataataacatttatgataccaaatatctttagattcttcattaattatatttccatattcttcattaatcatattttcatagtatacctgtttgatatcacatttttttatttcttctataattttagttaaatttaagatgctttgactcaaaaaaagttaaaatgattcatacgttgaaacggaaacggagggagtaaggttactagttct

SEQ ID NO: 21284 - DNA, 386 bp, Zea mays
  Clone ID: cC-zmle18900076a05a1
cttggatcctatacagcggacgccctttcctttttttttttataaatttacaaaacaatcgatatcggtaagagctgggcttatttctaagggtttttccactgaaaatgtatacttatgccttgaatgtgaattatgaaacattatcaaactatatctggttcatatgctaaaggaaataatgccactaattgatattgagggtggacttaatctgctgcaccacatatgggaggcccctgaagctgtcatagttacatctgttgacacaggattccaatacctgagttgcatctgcttacatttactggagcctgccacatttaaacttatcttggcggagcttccctgaccgtttaaacccttcccgaaaccaggccatctta

SEQ ID NO: 21285 - DNA, 545 bp, Zea mays
  Clone ID: cC-zmle18900076a06a1
gacaagacaattcgaactcattgggtaggactggatggttgtagcttgcgcgatcataccctccaaaacagtggttcattaggttacaagaggaaagcaaatacaatgcaatgcatacgaatggtgaggacaatccagattctggaacccagcttgacgagagattacaccttatctacttctacagaccctgtctctctgcttgcacgcgtacccgactcctgttctccggtccatcactcaccctcaggcctagcatatatactcagctacctccatttgcataagcttagcagcaaatacctgtgaccccggaagctgttcattttgtctgcaccccaaatatagggctccagcagaccgccaaaactgtctccgtgatccactgcggcacctaactggtcaactgaatcaaccagttgtggcgaaaatcgcatccgattgagctgtgacgatcactgcaccatgcgcttcctcttgcatcttttgcccttcttccctgagtaacttggaggcttcttgtcactgccaatactggatgcttc

SEQ ID NO: 21286 - DNA, 546 bp, Zea mays
  Clone ID: cC-zmle18900076a06d1
cgagaaccgggtaggcagctaaaagaagaggagagcatgagaaaattcaacaaagttctcgctgcaggagactcaggggcatcgtggggaacgtatgacatggaggaccaagagtcgcatgacgagaccacagaagaaggagggcccgtggaggaagcatccagtactggcagtgacaagaagcctccaagttactcagggaagaagggcaaaagatccaagaggaagcgcatggtgcagcgatcgtcacagctcaatcggatgcgattttcgccacaactggttgattcagttgaccaggtaggtgccgcagtggatcacggagacagttttggcggtctgctggagccctatatttggggtgcagacaaaatgaacagcttgcggggtcacaggtatttgctgctaagcttatgcaaatggagggagctgagtatatatgctaggcctgagggtgagtgatggaccggagaacaggaggcgggtacgcgtgcaagcagagagacagggactggagaagagataaggtgttatccctcgcaagct

SEQ ID NO: 21287 - DNA, 228 bp, Zea mays
  Clone ID: cC-zmle18900076a07a1
ggcaccgggcgtaggggacattatattcaataatcatccctctggggattcaaagaacaaagaaccagaagcccatttttaaggcagtaacagcaggctatcaaactttgtagtatctttccgatggatcagtcatttagggtagaaatcaaaactcagaggctgagaagcttagtactttattacattatgccgcagccacagttcatacataattatgtggaatgc

SEQ ID NO: 21288 - DNA, 265 bp, Zea mays
  Clone ID: cC-zmle18900076a08a1
gtgatttactccttgtgaccatccgactcctggacgggccccgggacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccggccccattttgaagctgttataacaatgaccaaccaggg

SEQ ID NO: 21289 - DNA, 213 bp, Zea mays
  Clone ID: cC-zmle18900076a09a1
agaccaaattgcttcccctaaaggaacaggggcaaattgcttgatacaaacagttatttggaatacagagaactggctaatctatctgtttatcaaagctttttcataaaacttgagacccctagaagtgcgtgattacttggcctatatggcaaatatgtgttactcaacttgccgctaccaagttttggtgcttggacattaattgaggga

SEQ ID NO: 21290 - DNA, 613 bp, Zea mays
  unsure at all n locations
  Clone ID: cC-zmle18900076a10a1
aggaaatgggtttttttttttttttttttttttttttttttttttttttttttttttttttttttttttttttttttattaaaacaaaaccccccaaaaaacccgggtgatacccttaatatatttacaacaaattttagggtttcacttttttttatatataatataaaaaaaaagcgggaatttcttttaaatttatctcttttttttatttttttttttttttatatataatcatataaaataaaaaaaactatataatataaataacttttaaaacacctcgggtttggtcttatttctnnanaataaataaaaataaatattattttgttggataaatattaatatttaattttttttaatataaaaaaaaatatactgagtagatttaattataaataataattaaatacacaacaaactccccgcgaaaaaactttttataatatttatcaccacatttttttttcattttctcacaccaatataaattaaaattatttttcctttctttatccctttttaaaagaaaaaaaaaaaatgatttctatttttattcaaaaaaataaaattatttttttggtaaaaaataaaaaaaaaaagatttttt

SEQ ID NO: 21291 - DNA, 203 bp, Zea mays
  Clone ID: cC-zmle18900076a11a1
ggaccccggggttttttttttttttttttttaaaaaaccaaaaccttattttttttttttaacaaaccccaaaaaaactaaaacctgctaaatccttaccggacgggtcctttttatttaaaacccaaaaaaaccccccggtccaaaaccaacatggatccaccgtccaggggcccccctcacatttttttttaacaaaaaca

SEQ ID NO: 21292 - DNA, 341 bp, Zea mays
  Clone ID: cC-zmle18900076a12a1
ataacttctgggggccagggggaaactcttttacgacacaacatactaacaaaacaacatcctaacttgaccaaccgatcagatcagcccacctccaaacgcaggacgattactcgtatttcagtgaaaaagttgcaacttgaaaacccaagagttttgggaaaacaataattctggaaccaatgtataacgacagaacatttttttgcatatgtcaacactggcccatccgagtaatattactaggacataataacgtgctaaaacctaaaggcccatgggaaggggaaacaccatgttcaaaccaagggcatcttttctccattgaaaaaaaaggttgg

SEQ ID NO: 21293 - DNA, 409 bp, Zea mays
  Clone ID: cC-zmle18900076b01a1
gacacgcaggaaaggggcccatgtaataacgcaaaaaaacacaaatacatgcatataaatattaaatccggccctagacggacatgaccgcgagcacgttacacagatgaacatgaaccccaggagcgaccatggatcgataatggcgggtgcatttgacaggatcttatttagacgctgctattaattatatttatacgcctcgtcggcgtcgtcctcttgactctcgtgcgccatcaccgggccgggcgggccggctcaattgcagctgcagcaggagcagcctcagctggtgccgcaattgcaggtgttgcagtcgcagccgccgccctcggtggccgccttaaagccgccggcgctggccttggtggtcggcgcaacgaggaccatggtcttgatgctgctggcg

SEQ ID NO: 21294 - DNA, 582 bp, Zea mays
  unsure at all n locations
  Clone ID: cC-zmle18900076b01d1
gcacccgtgcgaggcaccacacctgttcctcctcttcctccttttagcacattttgcgcctgctccccttcgggggtcatcatggcttgcatcagcggcaagtgcaactgcggctccagctgctcctgcggcagctcatgcaactgcatgtcccctgacgtggagaccgccgtcgccagcagcatcaagaccatggtcctcgctgcgccgaccaccaaggccagcgccggcggcttctaggcggccaccgagggcggcggctgcgactgcaacacctgcaactgcggcaccagctgcggctgctcctgctgcagctgcaactgagccggcccgcccggcccggcgatggcgcacgagagtcgagaggactacgacgacgaggcgtataaatataattaatagcagcgtctaaataagatcctgtcaactgcacccgccattatccatccatggacgctcctggggttcatgtgcatctgtgtaacgtgctcgcggtcatgtccgtctcgtgccagatataatatttatatgcatgtatctgcgtttttctgccttaatacatgtgccggttattgcgnnncc

SEQ ID NO: 21295 - DNA, 474 bp, Zea mays
  Clone ID: cC-zmle18900076b02a1
aaagggagaaaggggtcatgaggccatgccgtagcagtaacgtaaacaagaagataatcagtcatacaacgttcgtcataaaatggaaccggtgaaagaagaacagccatgaaacataaccagtctccacatccctatattttctgtaggctaataagcaactactcatagaagtcgcataccttccagttcagtaatagcagcatcacgacgaaaactccctttactggtacgcaaccgagcaccaaaacacctaccttttaagggggagataaactagcatgatggcagccctgccggcggggccgggagccgcagccaccgccattcccagccacgcgactttcccttcctttggggccttaaaagccggggcagctttccttccttgttggaggcggcagcggtggcagaagccttcaggctctgatctcctcctttagcttgagcttttcctggcgcacggcattcacc

SEQ ID NO: 21296 - DNA, 527 bp, Zea mays
  Clone ID: cC-zmle18900076b02d1
ggcgacgaaaccctcgcctgccccacggccgccgcttttgacggacgttctcaacggcggcgtcgcgggggaggagcgggtccccatcacccaccccgcaaagtcctacgtcacgctcgccgacgacaaccccgctcctaacggcggcgtcgtgaaagaggaggagggcggtgcccacaccaccgcgaagtcctacgcagctgtcgccgcccaagccgagatcgaggacctccgcgccgccaagctcgacctggaggagaagctcgctgaggcccgccgtgagaacaagtccctcgccgaggagacgcaccgcagcgaggggatcttcacgcaggcccgggaggaggtcaccatcgccgagttcgccgccacctctgccgagaaggaggtcgcctcgctccgcgcggaggtcgaacgcctcgatgctgttctcaggatcgagaagggcgagcacgagctggacaagcagagacacgagaaggtcgcccaggaggtggatgccgtgcgccaggagaggctcaagctag

SEQ ID NO: 21297 - DNA, 373 bp, Zea mays
  Clone ID: cC-zmle18900076b03a1
actccttccgaacccgggggccaaccccaaaaatcaaaccggaccctaaaagggacccaactttccaaaaaagaaaactaataaaaacagggccaaaacaagggaaaaaaaaattccccgggaaaaaatgtaatgcaagaaaaattccacacaaaatacaagccggaaacaaaaaagaaaaacccgggggggcctaataagcgaaccaccccaaaataattgcattgccctaacaggccgctttcaaaaggaaaaacctttcagcccacctgaaaaaaaaaaactaccaccccccgggaaaaggccgatcaaacacagggccccaaggagccctttcttttccccaacaaaacgggaaacaagttatggccct

SEQ ID NO: 21298 - DNA, 414 bp, Zea mays
  unsure at all n locations
  Clone ID: cC-zmle18900076b03d1
cgaagaccaaaaaaaaaaaaaaaaaaaaaaaaaaaaaaaaaaaaatttttaaaaaatttaaaaaaaaaaaaaaaaaggggaaaaagggggggacagaaaaaagaaaccccccaaacaaccccgggcaggcaacgaaaaagcccnacaaaagggccaccaaaaagcaaaccacggcccggccgaaaacaacggcgggacgggaaaaacccgggcggaacccaacaaaaacgccgggcagcacaacccccaacccccagcgggcgaaaaaacaaaaaggcccgcaccgagcgccccacccaacaagggcccaaccgaaagggcaaagggaaccccccccgaaccggcgcaaaaaacccggggggggggggggaaacccccagcggaaccggaacacnggccagggcccaaacgccc

SEQ ID NO: 21299 - DNA, 358 bp, Zea mays
  Clone ID: cC-zmle18900076b04a1
cctttctttttcttttttttttttttatcatcttctttttatatggtttgggtttttttataatttacaatcaattaacattccatgtgtctctttacaaaaaattcaaaccaacggaaaaaagacaaacatcgcaatggaggcattatccaaaacagcgcacaaacgaaaaaagtaaaacccaaccagccccaacattgtacaaaaccgacaaccctcttgacccacccgcactcaaaataaaactttaacccctccctccaaacaccccctcaaacaccaacaagccatcgccattggcctcccggagcggcaggggcgggccctggaataacccaatgccacccaaagcagaaaa

SEQ ID NO: 21300 - DNA, 234 bp, Zea mays
  Clone ID: cC-zmle18900076b04d1
acctgcaccggcgaggtccacgagcgcagggagagctttctcgccatttgctaactgagccgcccgggggccggcatggacgcccgttcgtgcctgcctgcgtgccttatgtatgtctgtggttgactggttgtgcagggtcatcgtacttggctatcgtacgtgcacgcactcagctcctgtacgaattacgacaataagctcgtgacctgaataaaacttcttcgtaatact

SEQ ID NO: 21301 - DNA, 536 bp, Zea mays
  Clone ID: cC-zmle18900076b05a1
ttttgttcatctaaaaatattgctgaaatactgaagcgctccgatctatccctgcacaaagtcctcttcccgactatttttgttccttgccagattaagcacatacataaaattttatgatgcctaatgttgcataacttatgcttatttcactaacactataattgtctagcaggattgtcaaactcagatttgcacccagattaggattcaggaagttgatcacaacgtgatcagtctgtggtctctgcccacaccgcaatagccagggtgtgccgcccgccacaagccacgtacttcgcctgccactgcccgtcccggctgctgcgggtcttgggcggcggcaggtcaatgtccactcccatgggctggcctgtcgtcagcttcctgccgtagcccagacgaccatggtcgcccctcccataagaaaacatccggccatctcgagttagagcaactgaatgtgttcctccacatgatacctgaacaatatcctctccagctagaagctcaacctttagggggaccatgcgact

SEQ ID NO: 21302 - DNA, 571 bp, Zea mays
  Clone ID: cC-zmle18900076b05d1
cgagaacacgggaggcttggatttggagatgataagagcagtcgcttggtccccctaaaggttgagcttctagctggagaggatattgttcaggtatcatgtggaggaacacattcagttgctctaactcgagatggccggatgttttcttatgggaggggcgaccatggtcgtctgggctacggcaggaagctgacgacaggccagcccatgggagtggacattgacctgccgccgcccaagacccgcagcagccgggacgggcagtggcaggcgaagtacgtggcttgtggcgggcggcacaccctggctattgcggtgtgggcagagaccacagactgatcacgttgtgatcaacttgctgaatcctaatctgggtgcaaatctgagtttgacaatcctgctagacaattatagcgttagtgaaataagcataagttatgcaacattaggcatcataaaattttatgtatgtgcttaatctggcaaggaacaaaaatagtcgggaagaggactttgtgcagggatagatgggagagcttcagtatttcagcaatatttttcgatggac

SEQ ID NO: 21303 - DNA, 320 bp, Zea mays
  unsure at all n locations
  Clone ID: cC-zmle18900076b06d1
ccccaaaaggacccaagcggacggacgcgagcaaggngacgcaaagcgccgcaagaggggcaccaaaaagcacagcacgggccggcgcgggacaacggcgggacggggaaaacccaggcgggacccaacgaaagcgccgggcagcacagccccncaacgccagcgggcgaaaaagcgaaaaggcccgcaccgaacgcccggcccaacagaggcgcagcccgaagggcaaaagggacgcgccccgaagcggcgcaagaagcgcggcgggggcggggggaacgcgcagcgggaccgcaacaccggccagcgcccaagcgccc

SEQ ID NO: 21304 - DNA, 189 bp, Zea mays
  Clone ID: cC-zmle18900076b07a1
gccttgcatagcagccataataagaggggctatcgggatggtaaatggacacatggtagcaaaattacatagctaaaagataaaaagaaaacggacatagggccggagcgctacatctcatctcatcttgagaaaggcgaagcacctgcaatgggtgccggggctggctcactgggtgcaaggggtgga

SEQ ID NO: 21305 - DNA, 181 bp, Zea mays
  Clone ID: cC-zmle18900076b08a1
ggcaaaccgccaaggcgccgggggacggggatagtatataaatattacattggtgactccatagcgctagggggatcatctgcagtcaaccacagaaattgacaactagagtcttatttattgtgtactctaacgttgggaatcagtgggctactatcagcaatgggaaggaccacttaat

SEQ ID NO: 21306 - DNA, 484 bp, Zea mays
  unsure at all n locations
  Clone ID: cC-zmle18900076b09a1
aanannanaaaagnaaatatggggaactggggctccaaactaacagaaacaactttgttcgcatcgacaaacttaaacaaaaatgcatgttgcacgactacaggtagcgataaatgccataacacaaattctgagcgccgaataaaaaacccctacttgggggggaaaaaactttactggtcatcctcggncgcgatatctgcgccccccgaggagtagagttggttgagcctttcaatgagactggccttcctctgctcgtatgtcagcttcttggggttgtacctcttgtgctcctttggtggctgcttggttgacttgaccacagaaggatcagcacggatggcagcatggaccttcttgtacagagcttccatgtcgtcagcctcaattcccttcttaatgtactcactgaagtgagactggtacttctctggctcctcttcagcgaggttcctcatgtagtcagcaacatggccaccat

SEQ ID NO: 21307 - DNA, 217 bp, Zea mays
  Clone ID: cC-zmle18900076b10a1
aattattgttccgggggaacggggcgagaaatgcattcatcttcttgctgtgcttattattcaaacatatgagctagctacaagctcattcctcatgcactatgctcttcgcagttacttggagggcatcgttccgccgccgaaaatcaagggcattttgggatacccctttttgggggccaccttttacctcggcctccccaacaagggggggggg

SEQ ID NO: 21308 - DNA, 469 bp, Zea mays
  Clone ID: cC-zmle18900076b11a1
ttttgatctaaattttcctcaattgccattaaaggcgcggggagagggcattgttcttccattcagagatcagttcacacacacgcacagagacagagagagagagagtggagctttattttgtttcggtctacacgatggtactcagccactgtaacagttcagtcacggtactcagccatgaacgcctcatggaaagccttgaagcgggtgatcaccgcggggattttgtcttcctgcggcaggatcgtgcatctgacgtgccatgtcagaacttgggccaattcagatccaggaaccacaacaattccagttgattcaaggagacggagcgcatagaatgcatcaggtgctttcttggcagctttagcagcctcaattgccttatgtggcagatggatctgagggaaaaggtacattgctccttcagccttgttacatgaaaatccctcaagcgtgttgaatgcat

SEQ ID NO: 21309 - DNA, 300 bp, Zea mays
  Clone ID: cC-zmle18900076b12a1
cctcccccccccccctttttcctttttttcctcccccctttttctaagggaaaaggggtattttttattctcttaaaaccccataacccacaaaaaaaaaaaaaaaaaaaaacaccacaaccaccaacatcacacaataacctcccaatcactcaatacaatacaaaaaaaaaataaataacaaaaaacccaccccacccaacaaaactcccccccccccccaaaaaaaaaaacaacacaccccaaccaccccccacccccccaacccaaaccacaaaaaaccacccccatcccaccccc

SEQ ID NO: 21310 - DNA, 615 bp, Zea mays
  Clone ID: cC-zmle18900076c01a1
tcctctagagcagccgcccttccccctccccccccttctttttttttctcttctctcttcccttttttgttttgtttaaaattaatatttcataccttcctaccccaaaaaaccaatcttaaaaaaaacaaacaacatcccctatccaaacccaaaccacatacacaaaaccccaataaccatccaatacaaaaaaaaaaacacccacacccaaaaaaaaaaaaaaaaactacaaacaaaacaaccccaaccccccccaaaaaaaaaaaccatttcgcaaaaaacccccccccaaccataaaacaccaacgccacccatccacaaaacccaacccccaataaaaaaaacccccccccccaaaaaaaaccccacctcaaaaaaattaaaaactcaaaaccacacagggcccaccccccttcaaacaacccacaccagaggaaaccacacaatttttccacaaaaaaaaacacccacctaggcccccccaaaaaaaaccacacccccccccaaaagaaaaacataccccacacccccccaaaaaaaaaaaaaaaacccgaaaaaatcccaatcaactcatattgctgacaaaaaaaacccacccccacaaatttttt

SEQ ID NO: 21311 - DNA, 565 bp, Zea mays
  unsure at all n locations
  Clone ID: cC-zmle18900076c01d1
ccagtgtgtgcattggcgattctcctgctattatgtttatagggatgtttaggttccaccttaggtgtggggagtgctgggggtgagggaagagcttttttcccagatgaaaatgttctagctactgttgtgaagtcaaatctggctcctgtgcggtattgtgatgattctaacaatattactgagacctatcccttcaaccctaatggttctccactgggtatagcagccctttgctcacctgacgggaggcacctggctatgatgccgcatccagagcgttgcttcatgatgtggcaatatccatggtatcccaaggaatggcacgttgagaagagtggccccagcccttggctgcgaatgttccagaatgctagagaatggtgttcatagtgcagggaagcttcctgctgcaaggatgtagtcattcaagcaccggctgctacgagtatatggatgattggtggntgtatggcccaattgatgaccccttttttggcagaataaatgtgttttgaccatcaatacattatcttgtaataatggatcgaatttggaattttga

SEQ ID NO: 21312 - DNA, 563 bp, Zea mays
  Clone ID: cC-zmle18900076c02a1
agatgcacaattccgaaaaacacacacagggcagggctccagaatccagtctgcgtaaaccacagctctgatacaagtcaatctagataccagacttcaactaagggcttgttcggttattcccaatacacatggattggatgggattggaaaaaattttgaagaagtttgacttgtttgggattcaaacccatccaatcccgctcaatccacatggattgagagctaaccgaacaagccctaaaggagtttgacatgacatgggtcaaaataataaattgtgacaaattggccatgtccagtgggtcaccccaaagggatcggagatttcaacagcaccaaaaacaccaagtctgggcaaatcgtcctgtttcttagtcagcatccatctcctcaagagctgcctgagcagcagctttggcctgctcaacagttcatttggaaccttctgatgctgacggttcgattcatcacagatccagctcaactccaactcaaaagctttgtccttcgcttcgtcatgcactccataaattatctttgcaacttcacaatgccttccg

SEQ ID NO: 21313 - DNA, 628 bp, Zea mays
  unsure at all n locations
  Clone ID: cC-zmle18900076c02d1
gccaccgtcgacgcccgacggcaggtgcaccaggtcttcgttgaccccttcttaaggcctcggttccatcctgggccggaggggaccgcccgtcaacaggacttgatctactactcactagcggtgtagaggcgaagagaagaacttgaccatgagcagcataggcacaggttacgatttgtctgtcacgaccttctccccagatggtcgtgtcttccaggtcgagtatgccaccaaggccgtcgacaacagcgggactgttgttgggatcaagtgcaaagatggcattgtcctgggtgtcgagaagctggtaacctcaaagatgatgctggaaggatcaaaccgaaggatccattcggtgcaccgtcactctggcttggttgttgctggtttagcagcagatggcaggcaaattgtttgaaggaccaaatcagaagctgccacttatgaaaaggtttatggagaacccactnctgtgaaggaattggctgaacgtgtggcaagttatggtcattcttgcacgctgtactggtggctcaggccttttggtgccgtgtaatctaagaggttatgaagnnatcccccacagctctacatgataggaccctcaggagttgcctacaaatac

SEQ ID NO: 21314 - DNA, 146 bp, Zea mays
  Clone ID: cC-zmle18900076c03a1
ggccaaggatgggtcattagggcattaaaatgctgaaattgcccatcaaattacacaaccttaatagcagccaaaccggcaaccgtttcatccaatatcattagcaaccaccgggcaaattgtaaatcaaccaagtctgcttgcac

SEQ ID NO: 21315 - DNA, 179 bp, Zea mays
  Clone ID: cC-zmle18900076c03d1
gcccgcagacttggttgatttacaatttgcccggtggttgctaatgatattttatgaaacggttgccggttgggctgctatgaaggttgtgtaatctgatggccaatttcagcattctaatgccctaatgatgaatctttggccaaagtaaaaaaattttataaaaaataaaaaataat

SEQ ID NO: 21316 - DNA, 475 bp, Zea mays
  Clone ID: cC-zmle18900076c04a1
ttttgttaaactgcgcatcttaattaagttgtgcaggaaccagaacaacaacatatggatatacagcaagtcctaaccgttacatgaacaatctgttttttcttgaacgaatgtacatataattaagaacaagcatgcatgcatactcttagtttggtacgacaacaaaccatgttttttccgcgccagattaaacgaacaaaccgggtaccatgatatgattttatcaggaaggcagagcagcagcattcacttgcgagctcagttgctggtggcagctgccgcggagcgtgcctgcagcaccttggcaaactcggcgatgtggtcggggtccgggatgacctccttggctacgtcgagcgcggcgaagcgctccgcccacgtggccaggcgcgggacccggccggcgttcagcagcttgacgccccccaccttgtcccaggcgcgcagccagccgatgaagccttccaggcga

SEQ ID NO: 21317 - DNA, 484 bp, Zea mays
  Clone ID: cC-zmle18900076c04d1
ccacaggaataataggacgcgggcccggccgcctgcgttttcagctctttcggacacgcaaacgcaaggggccaagcagggaccaaccagccgggagagggagcgcacgcactgcgagaatggccacggccggcggaggggccgggcatctgaagctgctgggcgcgtggccgagccccttcgtgaaccgcgtacgcatggcgctgcacctcaaggggctggagtacgagaacgtggaggaggacctgaccaacaagagcgacctgctcctcgcctgcaaccccgtgcacaagctcgttcccgtcctgctgcacggcgacaagcccatctccgagtcactcgtcatcgtggagtacctggacgacgccttccccggcgctggccaggccgtcctgcccgccgacccctatgaacgcgccgtcgctcgcttctgggccaaatacgtcgacggcaagttgcacggcatgatggtgaaggcgctcat

SEQ ID NO: 21318 - DNA, 367 bp, Zea mays
  Clone ID: cC-zmle18900076c05a1
gggggagagcggcacatacgcggtcgggtcaactggcaaaagcaccaaaagattgagaatctcctaggatgcacaactactgtgcagttttctacaccaagttgctgagcatgacaaccaactcctccataacagaggggcagcttctgctcagatgctcaaagccgtcagtggcggcgactgccctcaaatttgcaggagagctgagaaaatggaagcagaccttcttcagtgcatggcagcggtgttgctcagcgagcgccaggatggttgctatcgtgcccacatggatgcactcacacagcttcttttcacatagcaatttcagcctctccaagttgtatttgtccgcagcgaccagtaggtg

SEQ ID NO: 21319 - DNA, 375 bp, Zea mays
  Clone ID: cC-zmle18900076c05d1
cctggtcgttgcggacaaatacaacttggagaggctgtttttgctatgttaaaagaagctgtgtgagtgggtccatgtgggcacgatagcaaccatcctgccgctcgctgagcaacaccgctgccatgcactgaagaaggtctgcttccattttctcagctctcctgcaaatttgagggcagtcgccgccactgacggctttgagcatctgagcagaagctgcccctctgttatggaggagttggttgtcatgctcagcaacttggtgtagaaaactgcacagtagttgtgcatcctaggagattctcaatcttttggtgcttttgccagttgacttgactgcgtatgtgccgctctccaccaatttattaattt

SEQ ID NO: 21320 - DNA, 546 bp, Zea mays
  Clone ID: cC-zmle18900076c06a1
gcttggatcctctagagggccgccctttccctttttttttttttttttttttttttttttttcttttttttttggggtgggtttttttttttttttttttttttcccttccccttctttttaaaaaaaaaaacccggggggccccggccccccttttccttaaaaaagcccaatttggtttgtggcccattccacaaacaaaatttgggaccttttaaacccccaccggggaaccaacaagggtccccccccctcaaaaaaaaaacaaaacaggggttaaaaaaaggtcttaaatggcaacaattttttgccccagaaaggcccccaaaattttattcccagggggggggccccccttttccctttccccccttaaaatttaccctaaagggaagagcccctacccccccccccttttggaagggccccccccctcccccgtggggggcacactctgggccccaaaacccttgttgaaaaacccatgcccaaaacccctttaaaaccatttcccccaagtttttcaaaagagcccccccccccccc

SEQ ID NO: 21321 - DNA, 362 bp, Zea mays
  Clone ID: cC-zmle18900076c06d1
gctacaaacaccttggagcgagaggcttctctgacacttgctgccggcaatgtgtggggacgcgccggggggcattggtttctcaatcaccgcttttggcaacaaaattagcacacaaactggaattggcacgtccattgccatagctggtgttgctatgtactcttacattaaggctaagattgaagaggagaaaaggaaaaagagcgcatgactgctgtgaataatattatcgggaccttcctcggacacaacatcgtcgaccatcccgacctactcctataccttgttttgttttcaccttgagctcattccatccattgtttgtttccagccggctgcttaaaggggggggggggggg

SEQ ID NO: 21322 - DNA, 266 bp, Zea mays
  Clone ID: cC-zmle18900076c08a1
aggggaaatggggtattttttttttttttttttccctattttcccttatttttttatttttaccaaaataaaaaccttaacaactacttactaaaaaaacaaaaacacttactgtcaaattaactcaaaccaccataataaaaaaaaaggacctttaccaaaccaaccaactaaaaacaaaattctggaaaaaacaaacaaaaacaaaaaaaacaagccaacacaagctagcattaaattatcaaccacagccataacacccttta

SEQ ID NO: 21323 - DNA, 369 bp, Zea mays
  Clone ID: cC-zmle18900076c09a1
cttccttttttttttttttttttttttttccttcttttcttttttgggggttaggtttttttttttttccattttccccccctccaccttttacacccggaaatttccgcaccaccccctttggagacccaaatcacccctgaataccgccacaaaaaagaaggcgcctatcttttcacacacggacacaggcttaaaaagccacacccataccaggggcaccaaattaacatccccaaacacaaacggagaggcctccgcaaaaccataattccggttcatccccccaaattcccggcagacataacaaaagccacaccgggggacccccatcatccacctgcataacaacacccgtggataccccgg

SEQ ID NO: 21324 - DNA, 433 bp, Zea mays
  Clone ID: cC-zmle18900076c10a1
aagattaacttagaataaagcctgacggggggaacgggatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgtcaccaccaccgtagccgtcgccgccaccgtagccgccgccaccgccgtagccgccaccgtcatcacggtgcccgccaccgtcgtagccgtcgccttcacggccaccaccgtacccaccg

SEQ ID NO: 21325 - DNA, 206 bp, Zea mays
  Clone ID: cC-zmle18900076c11a1
tttttaattaagtcattatttgtccattgcctgagaatggggagtgggatacatcatgaaggtgtgctttgtttgtattcagtacggtagtttgaccaggtccgtcttacagaacaggactgctacatctcattttttttaagttgctactagtttgctacatccttgagctgacaatacaagatggtaggtagatacacgtccca

SEQ ID NO: 21326 - DNA, 493 bp, Zea mays
  Clone ID: cC-zmle18900076c12a1
tttttgattaaacattttgtttaaacgtagaatcagaggcgatgggggaacaacaatgagagaaatcgcctgtgattctctccttgcttggacactcctactccgcaccacaacaacacaactcaattccatggtgttctcgtcactctatataggccatgcttgcgcattgaggtcgcgatagtggagaaacaccaacagctacacatctgtctcgtcttgctcatttgctctactgattcctctccctcatcctccatcaagctcttgctccactcacacaccagcacaccgtgagtgtatctatgacaaatttgctaaatattaaatagaaaattaactgaatacgatgatttagagatcaacaattaagatcggagccttgaaccattgcataccctgattgttgcgggcgtgacaaggacggtgtcggtgttgtatccgacgaggcactgggcgatgcgggtaccaccaatgtgcatggaggatttgt

SEQ ID NO: 21327 - DNA, 328 bp, Zea mays
  Clone ID: cC-zmle18900076d01a1
aaaaaaaaaagcccccctttttcggggggcctaaaaacccaaggcctggcccggggggaaaccccccccccgttttttcccccccccccctgacaaaacccccacccaaaaccccgggcccgggtttcacttgcccctggggccccccccccccgggaagggggcccccccccggtgggccccccccctgaccccccccccttgggggggggggggaggggcccccttggaaccggggtcccttttgggcccggggcaaaaaaaaaacaggccctccccccccccccaaaaaaagagccggaaccccttttcctctttaaaggggccc

SEQ ID NO: 21328 - DNA, 572 bp, Zea mays
  Clone ID: cC-zmle18900076d01d1
cgaacccataccggatgcaaggcctgaatcagtactgggctttttcaggtttccagcacaacgggcgaggggctggaagaacgcctgaagaaggccggcgcctgctccggcctcagcgagaaagactacttcgagactgccctctgcttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtgtgcgtttctgtcaagtgtgcatggaataatactggtactgtgtttcctgcccggcaatgcact

SEQ ID NO: 21329 - DNA, 530 bp, Zea mays
  Clone ID: cC-zmle18900076d02a1
gaatattcagttaagaccattccaaggctgcttggcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgtccaaaaaatatcatattcgtaaagcagaaacataaatgtactcccattaatgtggaataggcggaactgaattagtcaattcaagttgacattgtcaatttatccagaacttctctcttttcctcggtgaaacaagaatctgttttgctcaaaccaaaggcaaggagcgcttactttagcctttatttct

SEQ ID NO: 21330 - DNA, 557 bp, Zea mays
  Clone ID: cC-zmle18900076d02d1
acaaataaagggtagagcaattcttttttctagagattctttagaaagttttacaaagtgaagcgaaagaggtttctttggataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctactttttgctgttcttgat

SEQ ID NO: 21331 - DNA, 419 bp, Zea mays
  Clone ID: cC-zmle18900076d03a1
gggtcattaatttttcaaaggagagtatatttatttcgattgactttaaggtttggctctggaacgaccgtccgacaacacagcaacacggttgacagtctgcagtaaacacacgcgcatggatggatggaaatgaagacaacttaaaaccctccaatatccacagcatctacctacctacagcagtccacatccacacacgctcagcagacacacagatcgagcatatgtacattcttcacatcagattcctatcctgaaacaagtccagagggttcaacgtggaagcattgaaatccatcagaaatcccacacgaatgtaatgacaagtgaacagaatttcttcaagtcttccgcggaagtcgacgatgtgcacagctaaatagacgggactctggaggtggcgcgcgactgggcgt

SEQ ID NO: 21332 - DNA, 241 bp, Zea mays
  Clone ID: cC-zmle18900076d04a1
aggggcgggccactggaatttacaagctacagcacagccgtagcctaaacgtagcatccgaacatttttgtcatggacacagggacatacataggactagaataacatcaacaaagtagtcgcagaaaaaccaagctgaagccaacagacagatttacatatgccatgcaaaccacaagcccgatacttaggatacgggcattcacaatctggggcttatcctaactagttttgcttcttt

SEQ ID NO: 21333 - DNA, 239 bp, Zea mays
  Clone ID: cC-zmle18900076d04d1
gacccagaactagttaggataagccgcacattgtgaatgcttttatcctgtttatcgggcttgtggtttgcggggcatatgtgaatctgtctgttggcttcagcttggttcttctgcgactactttgttgatgttattctagtcctatgtatgtcactgtgtacatgacagagatgttcggatgctacgtctaggctactgctgtgctgtagcttgtaaattccagtggtgcgttgctt

SEQ ID NO: 21334 - DNA, 337 bp, Zea mays
  Clone ID: cC-zmle18900076d05a1
gggccctattcaccaaaaaaaaaaatttccaccaattcccttttttttgaaacatttgggaaaattatgaaaacccatcctccctctttggggcccgggatttccccaattgaaaaaaaaagcctggggcgaattgaacaaaatattggcccccggctggataatacctttcccccgggcaaggggccctatatttaaaaagccttgaaagccaaaaatccaaaccccccccataaacaaaataaagggccctttgggggccccccattttttggaaaaaaccgcgttaaagccgggggtcttaaggcccccaaggggtttaaaaaaggaatggaaa

SEQ ID NO: 21335 - DNA, 208 bp, Zea mays
  Clone ID: cC-zmle18900076d05d1
ttgcactaggatccacaggacccaaagcggcaattttctccccattatcgttaaaaattcgtccgagagtagctcggccgactggaacactgagaggacttcccgtgtcaatcacttccattcctctcatcaacccctctgtagcactcatagccacagctctaactccattatttgctaataattgttgtacctcacaagtcacatt

SEQ ID NO: 21336 - DNA, 455 bp, Zea mays
  Clone ID: cC-zmle18900076d06a1
ttttcatcatttatcaaacaccacatgtcattcattggtatagacaaaatatctagggtttcgtgcaaactgttaactggcacacacagcggtggcatgagcacattgcagatagcaaatcttattcggcggtactaggagttgtagggtgtaaaacacaagaggctgagacggcaggaggacatgtagagtggacacgctcaacgagcttcgacggcttggtttccacctcggttgatgattttctcgacgtactccttcctagccgggagatggtcatgcggacgattgtatggtgtccagacaggctcacccacaaatagacgcattgccttgatgtagttgtcactatccaacgtaaagcgatgatacattcctgcaggcaaaacgatcatgccccctttctttaccgctacacgcgatcactgatcatcttggtccctcacatcaaagac

SEQ ID NO: 21337 - DNA, 306 bp, Zea mays
  Clone ID: cC-zmle18900076d06d1
ggagggaccaagacgagcaggggatccgcggagcgttaaagaaagtgggcatgatcgctttgccggggggaatgggggatcgctttacgctggatagcgacaactacatcaaggccatgcgtgcactcgtgggcccccctgcctggacaccatacaagcggccgcatgaccatctgccggctaggaaggagtacgtcgagaaaatcatcaaccgagggggaaaccaagccgccgaagctcgctgagcgtgcccactctacacgagctgcggcccccgtacccccgtgcgctcacaccctacaactg

SEQ ID NO: 21338 - DNA, 399 bp, Zea mays
  unsure at all n locations
  Clone ID: cC-zmle18900076d07a1
ttttagccttcaaaactttaacaagtcgagtttaacacgggagtcggaagttctgaacaaaaagctaaagcgcataaattaggccttctaatgaaggacccatttctttgatgtaggaagttctccgcagcagcacagtggcctcttcaacggtacttgatgaaaccaatgtccttggcgttgctgcgaaagcactgcctgcagcacatgagcccgtacttcctgatcagaccgtgagggttcgcgcagacccggcagacgcgggagccagggccgtagttcttagggtgcgagttccaaacgttggagtggcccatcgcgtcgtgctccttgctcctcctcttccttccgtcacggnggcggcggcggcgcgatctataactagtccggacgcgtggg

SEQ ID NO: 21339 - DNA, 420 bp, Zea mays
  Clone ID: cC-zmle18900076d08a1
gagattaatctaaatcaatatattgatgggttctaggaaacacatgtcggtatgagggcaccattgtcgagtacatctcatatgtaatctaaaagatggcacctccaacgatgggttgctgcaaggcagggttcatcaaagagaactggttgtatggcagcaattgttgttgctgctgcaggaaggtagcgaccaatgggttagccactgccaatggattaagtaactgttgtcgctgttgtaggtacgcagcagagtttgacacagccagttggttgaatggaagcaactgttgtaagtaggcagcagggtttgccacagctagctgagtcagagctggtacaatttgttgcagcaactgttgttgtaggtacgtaggtgcattgcccaccgcgagcgggctagaaccggacgcgtggg

SEQ ID NO: 21340 - DNA, 447 bp, Zea mays
  Clone ID: cC-zmle18900076d09a1
tttttctttaagatttacttacaataaagcctgacggggggaacgggatccatccatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtaggagatgccgtagccgccgccacggttgtcaccgacgtagccgccgtcaccaccaccgtagccgtcgccggcaccgtaggcgccgccaccgccgtagccggcaccgccatcacggtgcccggcaccgccagagtcgtcgcctacacggccaccaccgtacccaccgtcgcc

SEQ ID NO: 21341 - DNA, 270 bp, Zea mays
  Clone ID: cC-zmle18900076d10a1
gcccgccgacgacaaccggtttctcctgctgctcatcgtcgtcacgcccgcggtcgggggggtgctcttcaacatcctccagccggcgctcaaccagatcaaccgcatgaagtccgactgagctgctagctggcaacaacaccggggacggcggagtgtgcgtatcagcggctggacggttgtaatttatagcgtgaagcatggttggtctacgtgccttgttttttccatcttcgaatcttgagcaaatgcagtacatgtacagctccc

SEQ ID NO: 21342 - DNA, 220 bp, Zea mays
  Clone ID: cC-zmle18900076d11a1
cggaccccaggggcgaccggtgaattcttaaccggggcctggaggcataccagcaaaccctatccggagccggagaggagcctggcgtaaccacgggaaaagcggtatccagcgtgaaagagtgatcggcttacaagtccacacaggcaaaagagacccaccgcctaaaatgcaaagccgggggcgcccagggagcgaaacaaccaacacacagggagcc

SEQ ID NO: 21343 - DNA, 513 bp, Zea mays
  Clone ID: cC-zmle18900076d12a1
ttttgctttttttttttttttttttttttttttacagggggaaaagggcacgagttttagttcagcgacaaaatatttatttatccaagttacaccagatggagcacaacggaagagctgtatagctggaaggacccaaaaatcccagcctagcgtccacggaactaaacatcaatagcttgaccctcaactatcgtacctcagcctagttcacattatggaaggaatcgatgatggcgtcggcaagataatcacacttagccagggacagcccagctaaggagatccgcccatccttggtcatgtaaatatgccatttatccgtcatgttgtcactctgtgctttgttcaagccggtgtaggagaacatgccaatctgcctcagaatgaaagaccagtccttgccgctcttatccttggcagacaaactgtcgtagagcttttgtcttacattcttgatccgtccagccattaactccatttcttgtttccatttaccaaacatgattggat

SEQ ID NO: 21344 - DNA, 431 bp, Zea mays
  Clone ID: cC-zmle18900076e01a1
ttttattatacaaatattggtttatcatctcgggaagcttacgagaacatcacagtacacgaatagcaactgtaaaatgtacagaccgagctagcagtttgcaattatttgtaacagatccaagctaaatacattcacattttttttctttgccgccttgccgggcacttccagatcatcgaacctgtcaggcggtggcaccggcaggtgtggcggattcacttgtcacggcctcagcctcccagaacgaagtcttcttgccagtcttggaaacagtttgcaggacggcgtcaggtgtcacattgcccttcacggggaccttctgttccatgatgtctacctcgtaagactcgacgcctttcatcttgccgaggacccgcttgacagattcaacacagccctcacaggacatgccaaccttgagcacaaca

SEQ ID NO: 21345 - DNA, 525 bp, Zea mays
  unsure at all n locations
  Clone ID: cC-zmle18900076e01d1
ggaaccacccgtgcggccttggccggcaggagatttccaccaccacctttcgaaccgctttgaccctcctcccctctcgggctatggccgggactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggtgccaccgcctgacaggttcgatgatctggaagtgcccggcaaggcggcaaagaaaaaaaatgtgaatgtatttagcttggatctgttacaaataattgcaaactgctagctcggtctgtacattttacacttgctattcgtgtactgggangntctcgtaagtttggggagaagataaaccaatatttgtatgataaaa

SEQ ID NO: 21346 - DNA, 459 bp, Zea mays
  Clone ID: cC-zmle18900076e02a1
cactagaccgcccgccctctctttttcttttttttttttcttcctcttctttttttaaattgtaaaattttaattattctctttccttatccccacccaaacaaaaaaaaattactcaacaaccactccaaaaaaaaaaggaccaaaaaaaaaaaacccccatcaaaaaaaaacagtcaaaaaaaccccaaaaaaaaaaaaacccttaacaaaaaaaaaaaaaaaaacgaaaaccccccaccccccaaaaaacacaaaaaaacaaaccccccccttactgccacccaaaaaaacaccacaacaccccccctttaacccccatataaacaaacaagaactcaaacaagccggcgaaaacaaaagaaaaaaccacccccacacaaaaaaaattgtaatttccccaaacttccaaaaaaaaaaaaacccggaacaaaaaaacttaaaaagccgggggcccct

SEQ ID NO: 21347 - DNA, 367 bp, Zea mays
  Clone ID: cC-zmle18900076e02d1
ccgtgcggtttgtgtcttgctgctctcgtggtgaactcgttactccagtgttctgcaatattaagcagaagcgattgtattggttgggtcgtttgtcagctaattgaaatgcgatggacatttactagtaaaaaaaaaaaaaaaataaaaaattaaaaaaaaaaaaaaaagacataaaaaaaaaaaaaaaaaaaaaaaaaaaaaaaaaaaaaaaaaaaaaaaaaaaaaaaaaaaaaaaaaaaaaaaaaaaaaaaaaaggggggggccttttaaagggaccaaacttaacaacccgggcctggcaaaggaaaagctttttattgggggccccaaaataaaattcctgggccgctgtttaaaacccctg

SEQ ID NO: 21348 - DNA, 449 bp, Zea mays
  Clone ID: cC-zmle18900076e03a1
aaggaacaaggtcacatcgggatgcttatgtaatgtaaagctgcagcatgtgatcaatagtatatcaccaacaaacacagagcggacggtctaattacaatagccccagagctcagaatcacaaagattcctcctccgcagccataccccctcctgagtaaattagaaccaaaagcctaacagctagggaaaaaatctacaacaattacagcaagttttcgtttcctcgatcccacatcatcgtcatgggctgaatccccaatcccccaagtatagtgcagtgactgaagaacacaccgcccaagttttacatgcaggtacatgctcgtggcagaccagtccggtgcagaatgatcttcagagccatcattgccatgataattgcttgtatgtagacctttctgaatcccagctgccatcaggttcctttctctttggtcctacaactg

SEQ ID NO: 21349 - DNA, 609 bp, Zea mays
  unsure at all n locations
  Clone ID: cC-zmle18900076e03d1
gcggcaggtaaaggaccctttgttcctccagaaaatttgctaagatttagccggagattgggtgggggggttcaggggctacaagtgcatttcgtcctgccgaaccaaggaagattttggagatgcctgttgctgcacgcgacatttcagtttctcatgctgctggtaagcagtctcgtcccacgcttggttttgatttgaatgttgccgatgatcaagctcttgaggaagatatcccacagagttctgcacaaactacctgttctgaatctggaaatacgagaagtcgagatggctcttcacgaagcgctggtattgaattcgatctgaacagagctgatgaagttgcagataatggccaatttgtgccaagtgcttcgcacagagttgaagtgccattgttgtcaacaagatcgttacatggagttgtctctaatgctggcctgaatagctcgagggactttgatcttaatagtggaccaggtcttgatgatgttggcactgaagctggcccaaagagcctaccttgtaaaaatacaagcagttttcaattcctaccacacgtgcnccgtaagatgaatagtgctgccatgagtaatatatcaccat

SEQ ID NO: 21350 - DNA, 445 bp, Zea mays
  Clone ID: cC-zmle18900076e04a1
agatcaaataacttatagatcggtatggatttcctcacttccaattgagggcaaattgttctggtgaaaatacaacaatttgtgaaaagcactgaacacagcattcataatcctgtttctgacatgcactccacaccaaagggtcggagtaagctcaagttgcctcaggtaaataaagcttcttagtacttcatctttaaaacgataccagctgtgcaaatagggtcctgctggtttcatatgtccatcaatacgatctgccgcaagttatgaacccctcagagaattctactcattcgagccgttccatcttccataggccatcatttagatagtgcatattgtcaacaccaattcctttgttgatggtccttatgtcttttgctgacatctctgtatatccaattgcccaggcgtgtcgttttcctttagccattatagcact

SEQ ID NO: 21351 - DNA, 506 bp, Zea mays
  unsure at all n locations
  Clone ID: cC-zmle18900076e04d1
gttcctcgatttttcaatatacgtgttggtccttatatgccaaccctgcgtcttcgggatcagtagggggatatcatgaaaaagttcccagtggatacaggtgctatcaaatttgttctatctggcgcaaacataatgtggcctgtgttgactgcacctggtggtgccttagacgacgaagtcgaggaggaaacaccagtggctataatggctgaaggaaaacaacacgccctggcaattggatatacaaagatgtcagcaaaagacataaggaccatcaacaaaggaattggtgttgacaatatgcactatctaaatgatggcctatggaagatggaacggctcgaatgagtagaattctctgaggggttcataacttgcggcacatcgtattgatggacatatgaaaccagcaggaccctatttgcacagctggtatccgcttaaagatgaangactaagaagctgtatttacctgaggcaactgggagctactccgacccttt

SEQ ID NO: 21352 - DNA, 380 bp, Zea mays
  Clone ID: cC-zmle18900076e05a1
agctgaacaaaaagcgtgcgttcgggaaccaaaaagcggaaaatctttatccaaggccatcattggctttaataaaacttacaaatcctactttagtcatgctcctgccctgaaagatatgtactactaccaacttagtggtgccaacacggataataagcgttctactatactgactaccacgaaaccgcatcctgatatacaaaaatgtgaggacggccaggcaaacatgggtaccgcttacacacgggcacggggatcaccggtgcaggtactggcatttcgtacccttcccgcattggccactttcggagcgtttacatagccccctctgggactgccctcttgacgagggtcgtgaccaaccaccactgccatgg

SEQ ID NO: 21353 - DNA, 533 bp, Zea mays
  unsure at all n locations
  Clone ID: cC-zmle18900076e05d1
acccgggcgggaggaccaggcttagcactagaagggagggcttatggggcattttcacaagcatcctgacccgggacgcaaaggggcacaaaacctgcaggatcgcagcgaccaacaccatacccggaggggagcacaaaacccgcagggcggccacagtcaagcacatgaccagaggcgactggaaaagcacatggctggcaacgagacacgagcgagacccaggggggcacaaaggcagcagggcggcaacccacacattcctgtacagagcggagtgcaaaactagatggctggcaaccaacaagttcatctgcgcagggaagcagaaaagctgcaagctggcagtcgtcggcgcgagacagctcaaagatcgcatccagtgccagcgaaaacccgacattgccttctagtcaccaagcgacgacaccaacagggaggcactcggtggcaaagagacagggaagcagnnacaagggcgctgctgggtgggacgaggctctggggaactcttccgaagcattccaagagac

SEQ ID NO: 21354 - DNA, 420 bp, Zea mays
  Clone ID: cC-zmle18900076e06a1
cttcttgggtttggatttttattttttttttttttttctatcataccctccaaaacattttttcattaagttacaagaggaaaaccaaatacaatgcaaagcatactaatggtgaggacaatccatattctggaacccaacataaacaaaagaatacaccttatctacttaacaaaccctaaatctctgcttgcacgcgtaccctactcctgttctccggtccatcactcaccctcaggcctagcatatatactcaactacctccatttgcataagcttagcagcaaatacctgaaaccccggaagctgttcatatagactgcaccccaaatatagggctccaacagaccgccaaaactgactccgtgatccactgcggcacctaactggtcaactgaatcaacccacctgtggcgaaaa

SEQ ID NO: 21355 - DNA, 556 bp, Zea mays
  unsure at all n locations
  Clone ID: cC-zmle18900076e06d1
cgacagggccggcaaccggcgccatcgatcgatcttccggaaacttttctctaccgatgtctggagggggcgagggggataataagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgtgatgctctggctccttgtgccattgctgagggacatccttagcctttattagtggtatggtttggtactttgntctggcatcactcgtttatctatccctaatacatgcccgcatgt

SEQ ID NO: 21356 - DNA, 147 bp, Zea mays
  Clone ID: cC-zmle18900076e07a1
ttttgatttttctggtaacacaaatacccataggggtatggggatcacacacatatatgtatagcttaccccttgatcttactggcctgtgcctccatccattatctagcttacatgcagggcgcgcaatcactcatgtatatacta

SEQ ID NO: 21357 - DNA, 229 bp, Zea mays
  Clone ID: cC-zmle18900076e08a1
gaacatacatggggcaagggaacaacatattatacacattacagacgggtacaacacagtggaggatttttgacagttccaatggaacgatttacccatacacaaaggcggtccccacttaataatgtattcaacaaaacaggggtgttaattatttacgcttaacacaattattttgtagagagtgatgcttcgtcagaggaagaaaggaaagcccttttgtgattga

SEQ ID NO: 21358 - DNA, 159 bp, Zea mays
  Clone ID: cC-zmle18900076e10a1
ttttaactttgaacaggctggtagtactgctagtgcatgggaagagcaggcaccattttgcactccatctccagagtgccgatgctatgcacgcataatttccaaacttcccgcgttacaacatcaaccattgtagtaaccacggtattagagggcggc

SEQ ID NO: 21359 - DNA, 297 bp, Zea mays
  Clone ID: cC-zmle18900076e11a1
aggggaaaggggcaaaaaaaaaagttttttcagctccttcaaattacaaatggtttctatttgcgttctgagttccatcgacaatctactagtccagcgcgtatctcaacacattcggtaaatggccaataattattcgaaccaaacaactaaacaaaatcgcccccctacactggccacccacttgatgcaacccaatactacagttgctttggtctcaaaggaagaaccccccgggggtttcccccttttcttaaacggaaaggaccccctgcctacccccggcactggcagctc

SEQ ID NO: 21360 - DNA, 407 bp, Zea mays
  Clone ID: cC-zmle18900076e12a1
gggtaatgggagaatttttttttttttttttccccttatccctttttttttttttatttttttaagggaaaaaaaaccaaaaaaaaaaaaatcccgacccctgggggaaccccagggaaaaccccgaaaattccaacccggccccttaggggcaccaactttccctaaaaaaaagctaaaaaaaaaacgggctaataaaaggcaaaaaccttccccggggaaaaaattttttccttcaaaaattcccaaaaaaaaaaacccggaaaaaaaaagggaaaaccccgggggtcccaaaaaagggccacaccccacaaaatatgctgggggctcacatccccccctttacaatgggaaaacaccactgccccaaatcttaaaaaaaaaaaaacgcccacccccccccgaaa

SEQ ID NO: 21361 - DNA, 399 bp, Zea mays
  Clone ID: cC-zmle18900076f01a1
gcaaagtaatgcttcataaattggtcatgatccgttgatccataccgctcattaccgccattcacgaactccggcaatgggccaaccctcatgttctggcgagggtacaggaacagcgccgccgacattctctctctggttgggtgtaccacggccctgtgctcaacgctggtgaattttccattactcaggatctcaagaaagtcgccgacgttgacgacgagggcgccgtcgatggcgtccacggcgaaccacctgccgtccttcctgacctgcaggccctgcacgccgttgctggcctgcagcagcagcgtcaggccggacgcgtcggtgtgtggcgacaggcccagcacccggtccgacgcccgccggcacggcgggtaggtagttcacccgcat

SEQ ID NO: 21362 - DNA, 608 bp, Zea mays
  Clone ID: cC-zmle18900076f01d1
cagccgagggaggcctttgacacgctttttctggccgacgcgccccgggtccttctgggactccgtggactcctactccctggaagcttcgaggctagcgtaccgcctgctggagctcatggccaggggcgtcggggccgccgacccggcgtcgctaagacgcgtgttcgaggggcagacgcagggcatgcgggtgaactactacccgccgtgccggcgggcggcggaccgggtgctgggcctgtcgccacacaccgacgcgttcggcctgacgctgctgctgcaggccagcaacggcgtgcagggcctgcaggtcaggaaggacggcaggtggttcgccgtggacgccatcgacggcgccctcgtcgtcaacgtcggcgactttcttgacatcctgagtaatggaaaattcaccagcgttgagcacagggccgtggtacacccaaccagagagaaaatgtccgcggcgctgttcctgtaccctcgccagaacatgaggggttggcccattgccggagttcgtgaatggcggtaatgaaccgtattgaatgacggattatgaggaatttatgaagcattactttgcaaaaaaaaaaaaaaataaaggg

SEQ ID NO: 21363 - DNA, 509 bp, Zea mays
  unsure at all n locations
  Clone ID: cC-zmle18900076f02a1
ttttaatccactgccgtatccatcaccaggcgctgaggtttttcatgaccaacaacgtgacggtgcaagggctcaaggtgcagaacagcccccagttccacatacggttcgacagctgccgcggcgtggtggccagcggtctatccatcagctccccggcgctgagccccaacacggacggcatccacgtggagaacacccaagacatcctcatcaccaacacgcggcgtgtgcaacggcgacgactgcctgtccatcggctcaagcaccctcaacatgcactatgagaacgtcacctgagggcccggcggccacggcatcagcattgggagcctgggcaagcagggctcgtgagcgtgcgtggccaacgtcacggtgcgcaccgccgtgatccgccactccgacaacggcgttcggatcaagacgtggcatggcggctccggcaccgactcctccgtgtccatccanaacgtgcgcatggacgcggtgcggaaccccatcatcatcga

SEQ ID NO: 21364 - DNA, 487 bp, Zea mays
  unsure at all n locations
  Clone ID: cC-zmle18900076f02d1
ccgtgcggcattggaggctgctgttatcgtcgaggttccttggcacgccttctatgaggcacggcaccgggggcaccgtaggcgtggcggtgctgccgtacaccttccagcagaaggggtcgtcgatggtctcgccggacgcggggagcagctcgacgtcggagagcgtgatgttggtgcacggcacggcgtcgctgcacccgaagtggatgggcggcgtgcgcgggtcgtaggtgccccggatgccggcgtaggagacgccggagacgaagacggccgaggtggcgttctcgcagctcttggagaggcagcagtactggtcgatgatgatggggttccgcaccgcgtccatgcgcacgttctggaaggacacggaggagacggcgccggagccgccctgccacgtctcgatccggacgccgttgtcggagtggcggatcacggcgttgcgcaccgtgacgttggncacgcacgcccgcgagccctg

SEQ ID NO: 21365 - DNA, 421 bp, Zea mays
  Clone ID: cC-zmle18900076f03a1
agatacaaaggggggggcatgattgatgaaacaaatacaccccccaagattacactacacgactcccaacatgaaatggaaagcggaagcccgtaccaactcggtgactgcgtacaactcatatttataacatacgtttctttgggcgaataatcagattattattctttaaggaaagaaccctatcacccgagctggacctttcttgagagaaagaaccctgtccgtatgcttggtacaccctgcaatgctcggactctgggttgaccttgcaaaaatccttcataaggtgcaacgctgccggccgacgtggtgcctgtccccttgggcgtcaccaggagcgcccaatcaaccacgcgttggctgtacccccactcgttgccgcaccaggcgacgaccatgaccgtgctttggcccatga

SEQ ID NO: 21366 - DNA, 515 bp, Zea mays
  unsure at all n locations
  Clone ID: cC-zmle18900076f03d1
tgcggccacgcgtccgtgggcgaggagttcggaattttcaaggggatttttgacgacgacgcactcgtgggccggctaggggaggctgctggacgcgtcccaccgcgacctccggcgggcccgcgcggcggcgctgaacatcgtgccgacgagcacgggcgccgccaaggccgtggcgctggtgctgccgcagctgaaggggaagctgaacggcatcgcgctgcgggtgccgaccccgaacgtgtgcgtggtggacctggtgatcaacaccgtgaagactggcatcacggccgacgacgtgaacgcggcgttccgcaaggccgccgccggcccgctgcagggcatcctggatgtctgcgacgtgccgctcgtgtccgtcgacttcaggtgctccgacgtgtcctgcaccatcgacgcctcgctcagcatggtcatgggcgacgacatggtcaaggtcgtcgcctggntctacaacgagtggggggacagccaacgcgtggttgatctggcgcacc

SEQ ID NO: 21367 - DNA, 599 bp, Zea mays
  unsure at all n locations
  Clone ID: cC-zmle18900076f04a1
tttttgttccaagatgatctttatttcacacaggcatagtattgtacataagttacaacaatgaacaatcatgtgtctctttacaataaattcagacatcgttagaatgttaaacattggaatggaggtatttttcaaaacagtggacattggagaaatgtattattctttgtgggtgagcattgtacaaatctgacatccctcttcagccaagcatcaattcatctagaacttctcctagtcttttcaaagatctgctcagggatcagtgtgccattgccattggccttcttgatctccatgttatccttctggtagaacccaatgcctctcagagcatatgtaatgaagtcattgaatccaatggcgatggcagcctctaccttagccccataaaccagactcttgattcgggagagatgaactacaccaaagcacatttccaacatcatccaaatctcttcaagcatcatactctaagttagaagattgcaaccaacaactaagatcaagcaatgaagaaggcagccataactcccactgtacaatattcacatttnggtattcaactatggacatcatttatactacaccacaca

SEQ ID NO: 21368 - DNA, 514 bp, Zea mays
  unsure at all n locations
  Clone ID: cC-zmle18900076f04d1
gggcttggggcacgccactggaatgttggagggatttatggcgttaagttcggacgggacatctagggatctatgaaatgtacaaccacgatgtagagcatagagtttctaaagttgggtaagctgcttggctgttctatagaaatttgtatcaacatcaacatagatttttagtcccaaacaaattggggtaggctagatttgaaacccaacaagaagtcaccaaaaagagaaagagagataaaggggaggggaaaagcttttgagagaactaaaagagaaaatgcctaatcacggttcgggcacgtggatagcttctttccaagcatttctatccaaacacaactcctttgggtgtgtggggtgatattagaagcttcatgttaggtgtttgatactttcttgaatataggatctctgcgtgtggggtgtagtataaaaaatgtccatactnnnataccaaaatggggatattgtacagtgggagttatggctgccctcttcattgcttgga

SEQ ID NO: 21369 - DNA, 294 bp, Zea mays
  Clone ID: cC-zmle18900076f05a1
tttttataatgataaaataagaacggtttcaagcgaagtcagttttgcagtgcacttgatattcttacagctccgaggccgtcagaaagcaattaagcggcctcacgtcaggcatgcatctaaagctcgaaccaacaatagggacaacaacaccgtggcacgtacattaattatataccaccccccggccctgcagctgcaacgcgggcgtgctcagttgtggcagaccttggcggtgggcatggtgacgcagatggccgcgtacttcttcttcgcctcgggcccacgcgtccg

SEQ ID NO: 21370 - DNA, 308 bp, Zea mays
  Clone ID: cC-zmle18900076f05d1
gaaccacccgtgcgcggacgcgtgggcccgaggcgaagaagaagtactcggccatcttcgtcaccatgcccaccgccggggtctgccggaactgagcacgcccgcgttgcagctgcagggccggggggtggtatataattaatgtacgtgccacggtgttgttgtccctattgttggttcgagctttagatgcatgcctgacgtgaggccgcttaattgctttctgacggcctcggagctgtaagaatatcaagtgcactgcaaaactgaattcgggtgaaaccgttcttattttatcattataaaaa

SEQ ID NO: 21371 - DNA, 500 bp, Zea mays
  Clone ID: cC-zmle18900076f06a1
aaaggcaacatacgttttttcaacagacagataaacatgacgctgatgtttgaatacatggacattgtacttattcaactacaagcatgcccatcgcttattacaatgctagcaataaagggtacgtcgaaataaacagggtgcccatccagcactgatgactaaaatagtggtggcaaagaaatgagtagcggtggggaaaattctcatacatggtctcaatctacaacttccgtaccttataaaccatttggcagccattattgtcttacacaaaatctacagcagttcaccgtgcctcatcttctaggttgcggaacccagtggtaaggtcgtcgtacagtttcttaaacttgccgaccaaagcttcttcgccttctgcaggatcctcgaacttttgggatactaggcgataaaatagatcccccaaccgatgctttatgacactgtatgttatcttatggccgtcaataccagcttgccggttcacagcctgattt

SEQ ID NO: 21372 - DNA, 560 bp, Zea mays
  unsure at all n locations
  Clone ID: cC-zmle18900076f06d1
ggccgtgcgactggaattacaattgctgagtatttccgtgatttgggctacttcttcagtatgatggctgacggcacctcccggggggctgaggcattgcgtgacatctcagggcgtttggctgaaatgcctgctgatagtggttacccagcttactgggctgcacgttgggcatccttttatgaacgtgctggtaaggtaaaatgtctgggaagtccagacaggaatggcagtgtcacaattgttggagctgtctctcctcctggtggtgatttttcagaccctgttacctgcgcaaccctcagtattgttcaggtcttctggggtttagataaaaagctcgctcaaaggaagcatttcccatctgtgaattggctcatttcctattcgaaatactccaaggcccttgagtctttgtacgagaaattcgatccagatttcattgatattaggacaaaagcacctgangngntgcagagggaggaccatctgaatgaaattgtgcagcttgttggtaaagatgccctggcagaatctgacaagattacgctggagacaga

SEQ ID NO: 21373 - DNA, 212 bp, Zea mays
  Clone ID: cC-zmle18900076f07a1
gattacaagtttagggagagagtattatacctcatcggagtgattacaaaagattacaaaagaaagtgattcaaaagaattacaatttgaaatgttataaagtattcgtaaatttgaaaatacatgctaccttaagggacaatcctcattaaagaaactatagaagggatatacttatataagaaggccgagcccaccggcacttagcacca

SEQ ID NO: 21374 - DNA, 199 bp, Zea mays
  Clone ID: cC-zmle18900076f08a1
ggtaaggaactcgcgagttcgcgtatggtcatggcctttgcaatttcatgttacagtgtagggtatgtacacgtattgacgcctaacctctgcttggctggacaacaatcgccacaatcttccacagagttcatcctgcctgttgtgaacaaaaacagcatacaataggcacagatggatagatcgtcctaaaagaaac

SEQ ID NO: 21375 - DNA, 476 bp, Zea mays
  Clone ID: cC-zmle18900076f09a1
ctccccccaaaaaaaaaaaaacaatggggatatccaccttttaaatatatttttttaccacccgattaaaaaaaaaaaaaccttgggtccactaaccaaaaaaaaaaaaacccccccccaccaaaattataggggctttttcaaaaaaaaaaaaattaacaaaattttttttttttaaaaaaatttctgccataaaacaaaaagggatggccttttttttaaaaaaaacccacctcacctggggggaaatataacacccctaaaaaaaaaaaaaaatgttggtaataaaataaatatttttaaaaaaaaacatcctttaactccaaaagttgtttttaaaaaaaaaaaaaaaaaaaactctcctttaaaaaaacaccaaagagccccctttttctcctccaaaaataacaaattttctgtggataacacattttttttattcttggtataaaaaaaaacctgttattctctttttt

SEQ ID NO: 21376 - DNA, 248 bp, Zea mays
  Clone ID: cC-zmle18900076f10a1
ggggaaagggcagtttaaaacaattttatttaccaattgtccaaataacaatggtaggttttgacgtactagtcacgtttgccgttaaagctgggggggtttattccgtagttacgaacaggaattatggatacaagcgggcatattattcctaaccactctcacttttgacaaaaataaataaatcgggggtaaattgttgagctatttttgggaaaaaaacttttttatttttggagggggggaac

SEQ ID NO: 21377 - DNA, 393 bp, Zea mays
  Clone ID: cC-zmle18900076f11a1
tttttttttttttttttcctatttaatctttggggtttggggtttttttttttttttttattcccttttacccatcacttttttttttataaataaaaaaaccggggccaaaaccctgggctcccccaaaaaattccgaacccaacctaaaagcgaaccaactttcctaaaaaaaaacccaaaaaaaacagggcaaaaaaaaggcaaaaaccgcttcccggggaaaaattatatcccctaaaaatcccaaaaaaaaaaaaacccaaaaaaaaaaaaaaaccccccgggcccaaaaaaggggcccaaccaaaaaaattgcgtagacccaaacacccccccttaaaaaaaaaaaaacacttcccccaccccaaaaaaaaaatccccaaccccccg

SEQ ID NO: 21378 - DNA, 390 bp, Zea mays
  Clone ID: cC-zmle18900076f12a1
ctcccccccccctttcccctttcccccccccccccccccccctggtccccggcccctttttattcttattttcacaccctcccccttctaaaaaaaacaaaccacaaaaaaaaccccaccacaaccacaaaacccaaacccatcacgaaacaaaacaatcaaaccccaaacccccatgaatacaaaccccaacccaaaccccaacccctaacccaaacccccccccccaaaaacaatcctcgcccgacaaaaccaccccccccaaataaaactccgcctccccacccccatctaaaaaaaacctcctacccccccccccctaattaaaaacctacccaaaccccctcaccaatcattaccccccccaaaaaaatctcccaattcacctaa

SEQ ID NO: 21379 - DNA, 403 bp, Zea mays
  Clone ID: cC-zmle18900076g01a1
gggaaaaaaatgaaattttcctcaatcactccgaaataaaaccattgtttacagaccatatagaacctactttctttggtggtctgagttcaggaccagcctttgaaagggcatgtcaggtcaggtgacacccatgctcactgaaatgtgggtccaggaaggtacatggcagctgaacccaagcctaaccattattttttttgtcataaagttacagattcggcattatattattgcactctcctcactcctcatgggcggcgcccttggggaggttattcaggatgtaaagagaggcaaaccacaagaaaatgcacatcgagtagctgaggaggtccagccccgtggcgattggcaccattttgttcctttgaacatttttaccagcaggatcattacgatg

SEQ ID NO: 21380 - DNA, 538 bp, Zea mays
  Clone ID: cC-zmle18900076g01d1
aaccacccgtgcgaggacgcgtgggcggacgcgtgggtagaactatttagcgctcttcgccgtcgcggggtcactgggcggctccgggctgtgcttcctcaatggctgcgtcttcatcaaagaggcataccaggtttactggtcgagctgcgtcaagggggtccatacgggacagatggtcctcaaagtcgtcgaggccatcgatgtgtatcttgctggaacggtcatgttgatatttgggatgggtctctacggtctcttcgtcagcaacgcttccgtgggtgttcgttctgaatccgaccgtgcactgagcggatcgtcgctgttcgggatgttcgctttgaaggaacgccccaagtggatgaagatcacctccctcgacgagctgaagacaatagtggggcacgtcatcgtgatgatcctgctggtgaagatgtttcaaaggagcaagatggtgacaatcgccacggggctggaccttctcagctactcgatctgcatcttcttgtcggctgcctctctctacatcctgcataac

SEQ ID NO: 21381 - DNA, 415 bp, Zea mays
  Clone ID: cC-zmle18900076g02a1
ttttgatgtaaaggaactatacgttacacaagaggtgaaatctgatctggacaaaacttgctttgatatctccaaaaaatggaaggcatggcactagtttgtaccaggccaaaatgctcagaagaacaagatcgaatcagaatgtgaccaatatacatgttaatttctgtagccaacaccaaaggagaaatctgcttgcttgcctatcattaaaggcggactcaagccgtataggtcccagaggggagtccactcggacgccaacaccataaccaaagccactccctggctttgcacgagctccggctgggtcaccatgaactttaggaccagaaccaagatcactaccatagtcttcaaagaccacgccttgcagaggaccaaacatgcggcatgacacttcaccactacctac

SEQ ID NO: 21382 - DNA, 520 bp, Zea mays
  Clone ID: cC-zmle18900076g02d1
cccgtccgtgtagaaacaatacttactatgggaatcatgtttgatgtcactttaatcccacagccagttggggattctaatggggtaaaccttgtgatgaatcttgttgaacgcccttcgggtggattctctgctggtggcggacttacaagtgggataacacatggacccctttctggacttattggcagctttgcatattcacatcggaatgcttttgggaggaacaagaaattaaatctctctttggaaagggggcaaatcgattcaatatttacattgaactttactgacccttgcattgatggagacaacatgagaacctctataactgctatggttcagaactctaggactcctggaacactcggtcatggtggtgatcatcctgaccatgcgcctataacaattggacgtgttattgctggcttagaatatagtccaccattcagacccaactggagtgggacacttggcttaatttttcaacatgctggtgctcgagatgataaagggaatc

SEQ ID NO: 21383 - DNA, 416 bp, Zea mays
  Clone ID: cC-zmle18900076g03a1
gggggggggacactggtaaccagttacataaacaggtacatggtacataaaccagttacataaatagatagatggatatcatcattatggccctttattttccctttactttaatatatgggggcgcaatcctcctgcgctctttcgaaaaaaaaaaaaagttacataaacaggtacatggttcacaaatccccaatggatcgaatgatatacttttaatgaggaaatgggacaaagctcatttgacaaatagctgtttggcaacactattaaaaaacttttaaaagggggcagcctcctcctggagctgcttaaccttggggaggtagacaattatcgcctcatccttcgatttgcctttaacagcctttcaggcatcccacttggccctgtccttttggtaaaaaatgcccgga

SEQ ID NO: 21384 - DNA, 516 bp, Zea mays
  Clone ID: cC-zmle18900076g03d1
ggaaccacccgtgcggaccttgcctgagagcacgagcaatgagaacatttctgatcctttacgggctctacaagcaagcgggggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattccatccattggggatctgtgaaccatgtacctgtttatgtaactttttttttttttcgaaagagcgcaggaggactgcgcacccatatattaaagtagagggaaaataaagggccataatgatgatatccatctatctatctatgtaactggtttatgtaccatgtacctgtttatgtaactggttaccagtgtcat

SEQ ID NO: 21385 - DNA, 429 bp, Zea mays
  Clone ID: cC-zmle18900076g04a1
acgggaggggaactgacagcccaaacaaactattttccataaaaaccacatccgacattaactaaatatacacatggagaaaccataaacggaatgttcagcgcaacaaatgcatttacaacgtttattcagcttcgcgatggaaagtctggcggtgctttattcttattcctcggagcaaacagagtacaaacagtcggtgctctcggcgacaataatgaaccaataggtagtttgtacataggggatgaataccttaaacaatcaatttgacaaaaacaggcggagttccttatggctgcagtgcaagcgtgcaaccggcaaccattacatagaagcagccgtaccatcggcagatgagtcgattaggctgcagtctggccaaaaagaagcttccggatctctggcaatttcttgcggaaaacaact

SEQ ID NO: 21386 - DNA, 573 bp, Zea mays
  unsure at all n locations
  Clone ID: cC-zmle18900076g04d1
gaaccacccgtgcgcggacgcgtgggcgattgcctcctcagcaacttttataccccttttgcggcggtgccggagcgagcagagcagggggagggcctgtcggatccgccgccgtcaagatgaatgacgccgatgtatccaagcagatccagcagatggtgcggttcatccgccaggaggccgacgagaaggccaacgagatctccgtctccgccgaggaggaattcaacattgagaagttgcagcttgttgaagctgagaaaaagaacatcaggcaagagtatgaacgcaaagagaagcaggttgaagtacgcaagaaaattgagtactctatgcagttgaatgcttctcgcatcaaagttcttcaagctcaggatgatctagttaacaaaatgaaagacgatgccatgaaggaacttctccttgtcagccacaaccaccatgaatacaagaaccttttgaaagacctaatcattcagggtttgctccgtttgaaagagccagcagtattgcttcgttgccgcaaggatgatcaccatcatgtggaatcagngctgctttcaggaaagcatg

SEQ ID NO: 21387 - DNA, 603 bp, Zea mays
  Clone ID: cC-zmle18900076g06a1
ggccgcccccccccccccctttcctttcccccccccccccccccccccctttggtttgtttttatttatttttacttttcctaccccccaccccacccaaaacaaaaaaaccctaaccctaacccaccaacccacccccttacccgaagccaatccccctaaaaccaaaaccaaaacaaaaaacccccccccccttaaaaaaaaaaccccgaccaaaaaaaaaaccctaaccccccaaaacaaaaaaaaaaaatgaaaaaccaaaaccccaaaaaaaaaccccccacaacacccaaaaaacccccaccaaaatacctgggggggagaaaaaaccccccaacccaaaaaaaaaaacgcccccccccccccccaaaaaaaaaacacaaacccctctggcaaccagaaaaaacaaaccccccccccacgcgcataacacatcccaaaaaaaaaacccccccttacattacaaaaaccccccaaaaacaaaaaaaaaacttttcctaaacacccccctccttaaaaaaaaaaaaacacccaaaaaaactaccccccaaaaaaaaaacccttcttatgggaaaacccaaccaaaaaaacacccaaaaa

SEQ ID NO: 21388 - DNA, 134 bp, Zea mays
  Clone ID: cC-zmle18900076g06d1
gcgcggacgcgtgggaaaaaaaaaaaaaaaaaaaattaaaaaaaaattaaaaaaaaaaaaaaaaaacgggaaaaaaggggaaaaaaaaaaagaaaaacacccaaaaaaacccaaaaaaaaacagaacacagcgg

SEQ ID NO: 21389 - DNA, 399 bp, Zea mays
  Clone ID: cC-zmle18900076g08a1
gggcacagggttttttttttttttttttttttctccttttcctacaaacggggacaaaaaaaaaaccaaaaaatacaagggaaaaggctattatcccccaagccccactttaaatggtaaaaatacattaacaaacaacccggaaggggggggagggcatccccaaacaaaaacgggggggggggaaaatttggacaaaaaaaaaaaaaaggggtcccgacacccccaaaaaagggggaaaatcaaccctcaccccatgaacctgaaaaaccaaaaattcaagccttacccgtaataaatcttttttgcccaaccaactttttaacctttacaagccccaaaaaaactttgaccccaaaaaaaccccaaagggaatataaaaaggctccttggacccct

SEQ ID NO: 21390 - DNA, 429 bp, Zea mays
  Clone ID: cC-zmle18900076g11a1
ttttagatttttttggagatgctgcgtaagggggttcatgttggaccaagagactgcccaagacagtgaacacaacaattcttccttgccgattgaaccctggtacggtaagtaatttacatcatggtacaaactggaaccagtgcgcgctcacgtgcatccgaacacctagatatccgcagcggtggccggtgggcggtggcgcctccaccccctcacttgccgggcacaaagttggtggcataggcccatgcgttgttgttgacggggtcggcgaggtggtcggcgaggttctcgagcgggcccttgccggtgacgatggcctggacgaagaacccgaacatggagaacatggcgaggcggccgttcttgagctccttcaccttgagctccgcgaaagcctcagggtcgtcggcgaggccgagcggg

SEQ ID NO: 21391 - DNA, 372 bp, Zea mays
  Clone ID: cC-zmle18900076g12a1
acacagtagtagtagtatagatacgggggagctatttagcttggcacgcgtatagcttgcgcgtgcatatataattgcatatatatgagcaccatggttcgtgcatacacatatatgtgtgcggtcgtaggagtaggatgcgttgcatgcagtaggctcacgctcatcagatcagttcagaggccaccgtagcggacgtcggagaacttggacttgagccacttgacgctgctgcggacggtggtcttgatccggccctgcgtggcgaacacgttgtacgccgccacgcggtgccgccgcttcgcctccgggtcgtcccggccgctcggcccgttgaagctgtacaacttgccggcctgcccgggcccgccg

SEQ ID NO: 21392 - DNA, 396 bp, Zea mays
  Clone ID: cC-zmle18900076h01a1
gggttgggtttttttttttttttttttttttttttttggaaaagaaagggggccctaaattggatttacaaaaatggggaaattggttgaaaaaaaatttggggggggggggaaaaaccgttcaaaaaaaaaaagattgttggcacgtgcaggcttggggccggaaaaattttttttgggggtacaacaactggaaaaggaggacacggggaacgaacagaagccaaaccctgggaacacacacatgatggttatccaaaaaaaatgaggagagccaacaaacaaaaaccacaagggcaaatttaccacaactgaaaaaaccccccggcaaaaaagcaacaaccccaagggccttttaacgcttgaagaggtgcctgaccttggtccacgcctttt

SEQ ID NO: 21393 - DNA, 437 bp, Zea mays
  unsure at all n locations
  Clone ID: cC-zmle18900076h01d1
ggagcagggagtcaagcgctaaagaggccctaggccgttgttcgctctgcatgcttgcgtggtctttctcacgttgtggtaggactttgcgcttgtggctttctgtttggttgcatctacttatttattttggatatacatcatgtgtgtgttcctagtgttttgcttctgttcgttcgctgtgtcatcctcttcgagttgttgtagccacagaaagaaatcttccggccgcaagcctgcacgtgccaacaaactctctagtctggaacggatgttcaccgcacaccgaaatttttttgcaaacaatttccacatctttgtagatgcaatatagggcccgcatgactatcannnntntnnnnnnnnnnnnnnanntnntnntnnnnntntatgnttttttgatatanntattaaaaaaaaaaaaaaaaaagggcggc

SEQ ID NO: 21394 - DNA, 343 bp, Zea mays
  Clone ID: cC-zmle18900076h02a1
aggaaagccatacgacgcactttattggttatcaaacatgttacatcgtttaccagtctgaagaataacaccagagggttcatcgaccccaaatacagtttcctttcaagagagagctactctgctagttcatgtgccacctgtgcgtttgtaaattggacacagcattctgggagcagtgcacggcatcctcgtgaaaaatgagaagaaaaaaaaggatatttcttcactgcctccgtctcctttcatctccggtatacgtatagctggacaagacacacatctatacagatcgcatcactggtaaacttgcacagagtaaatgattacacgtccagctctt

SEQ ID NO: 21395 - DNA, 341 bp, Zea mays
  Clone ID: cC-zmle18900076h02d1
gagctggacgtgtaatcatttactctgtgcttttttaccatttatgccatctgtatagatgggggtcttgtggagctatacgtataccggagacgaaaggagacggaggcagtgaagaaatatccttttttttcttctcatttttcacgaggatgccgtgcactgctcccagaatgctgtgtccaatttacaaacgcacaggtggcacatgaactagcagagtagctctctcttgaaaggaaactgtatttggggtcgatgaaccctctggtgttattcttcagactggtaaacgatgtaacatgtttgataatcaataaagtgcgtcgtatggctttcct

SEQ ID NO: 21396 - DNA, 360 bp, Zea mays
  unsure at all n locations
  Clone ID: cC-zmle18900076h03a1
ttttattttaattataagtctattagttctcggactagtacatgtgtttccacccacgcgtccgcccaaacggntanatgaacaattagnttttttctgtaacgaatgttcatataattaagaacaatcttgcctgcatatcttttatttggttacgacaacttatctttttttttccgttgctttatttaacgatcaatccgggtaccatgatatgattttatcaggaaggcatatcatcagtattcacttgcgagctcattttttggtgtcagcttccgcgaatcgtgcctggaggaggtggggaaactctcctatttggtctgtgtccgggatgaccttcttgtctacttctagcgc

SEQ ID NO: 21397 - DNA, 526 bp, Zea mays
  Clone ID: cC-zmle18900076h04a1
gtgaggaagaaactttgagttgatagtcacgagatttgcggcctcgttacacatttgccacaagctaccatagatattccatatcattcatggcaaaagtatcctgagcacgcccgtgcttgataaagtttgaaatgggtttacagggaacatattggtaattctggctttgacaacgctcaatcgaattgctgatccaactcataaccaaaaactctaacatgacattcacggaaagagactccttaagccgtggacgccttcttcagcttggcgagctcttgcctgatagcaccgcccctcttaatcttcgccagcatgactttgaacctatcaaagtcattgagcgatgctctcctcttctggacaatcagcttcttgccccatgagctgttctcccacttggtcttcacatcagcttcctccatcgccttgatcagggctgtcttcttgggacacgtttgatgtcaatcttgatgtcagtaagtgagagccgcttgacgttcacctggcacctgaccatatc

SEQ ID NO: 21398 - DNA, 533 bp, Zea mays
  Clone ID: cC-zmle18900076h04d1
tgcggatatggtcaggtgccaggtgaacttcaagcgttttctcacttttttgacatcaagattgacatggggcgtgtccgggagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagcgttgtcaaagccagaattaccaatatgttccctgtaaacccatttcaaactttatcaagcacgggcgtgctcaggatacttttgccatgaatgatatggaatatctatggtagcttgtggcaaatgtgttacgaggccgcaaatctcgtgactatcaactcaaagtttcttcctcac

SEQ ID NO: 21399 - DNA, 451 bp, Zea mays
  Clone ID: cC-zmle18900076h05a1
aatcagcaaaacggacatgagcattgcaaacctttttcataggtgcacaagttacataattgacagacaacaacagcatcgaatttgtaagccaaattctgcaaaaagatcggaattaaaacaagctgagcagagcgtgtgcaaccatgggctggctggctggttcctctcctcaccgtcgtcctcccttccccttgcccttgctcaggaagtggtggcgcttcaacctcttcttccggatcaccacgtcggtcttgatgttctccgagaacggcatgccgaggaggaccagcaacctgaacgcctcgttgtccgtcttggcgctggtgacgatggacacgtccatgccgttcttctttccgcccacctcgtacgggatctccgggaacacgccctggtcacggaggccaaggctgtagttgccgtgcccgtcaagctgttggggttgaca

SEQ ID NO: 21400 - DNA, 177 bp, Zea mays
  unsure at all n locations
  Clone ID: cC-zmle18900076h05d1
gggcccgtgcgnatgaaccttgggctgcctaggaccatggactttctgggtgttttccccaacagcttcgacgggggcggcaacgggagccttggcctccgtgaccagggcgtgtccccggagatcccgtacgaggtgggcgggaagaagaacggcatggacgtgtccatcgtcacc

SEQ ID NO: 21401 - DNA, 547 bp, Zea mays
  Clone ID: cC-zmle18900076h06a1
tttttataagatgcaacatatcatatatatattatttagtattcaacccggtggctaatttgcaccgccgccgccgctggctttgtacactatattcatgatcctaatctagaattgcatcaggaacgagcatgttcctcatcccctgttcccaaaacaacacagggaaagcaatatgatcagaacccagatagagggaacgcttcgccatcgaggctcgagaggtcgtcactcgatgattcagtcctcgcgatctggtctgtcttgcaggcacctagctcatcggagagcctttcgcacagctgtctatacaacgtagagtctccgtgggatttcctaagctctacgacatataatgatggaccgagctcaaacacctcggtgcacaccaacaatgatgacgggttcctggaacacttgctattcttcaagaccttgagcttgcctgcccccctatggactttgaatcccatctccatgacaacgctctcgatcttgtcaaatagatccttgggtgggtgcgtcgaagtgaaccgaatctttcttt

SEQ ID NO: 21402 - DNA, 356 bp, Zea mays
  unsure at all n locations
  Clone ID: cC-zmle18900076h06d1
gaccgagaccacaagccagagaangnccgcgcctttcggaaggtttaccatcaagagcgctgacttgggcctcaggggtctacctcaacatctcgggagtgacggacttctgcacacaacatgtggcagccccaactacatagctcctgaggttctgcaaaacagaggctatgacggctccttgtcacatctctggtcttgaggggtgatcctctacgtgatgcttgtcgtctgccttcccttcgacgacaggaacctcgtccttcctcatcagactctcttcaagggatactgctatattctccatctgttatcttctgtcgcgcagtaccttcttaagaggatcctgccaccga

SEQ ID NO: 21403 - DNA, 431 bp, Zea mays
  Clone ID: cC-zmle18900076h07a1
acaacacgcagctggggggaattgggcaaacccaagtacacaacatccagaccgaccgtgacttttgacttgggaccaaaataaagcccgtacgtaccacgtcctacacaagcagcaacactcactgccagagtcacgcgatccaccttaatagagcacacggaccttgaccaggcgatccaccttgaaacaaacttttggtaaaagcaaaccagaacccaacacacatgccaacgctagctagcttctaatcgccgcccacggccaggacacgctgcgactgcgaccttaattagaggagctggtcctgtgctcgccggcggcgtccgccttgtggtctgcttcctcacctgagctcttgtggtagccggctatcttgtccatgatcttgcccagcaaacccttcttctccttgccatccgggctgctta

SEQ ID NO: 21404 - DNA, 425 bp, Zea mays
  Clone ID: cC-zmle18900076h08a1
cctacccttgggggagacgggggaaggacaccaggggtcacccgggaaaacccgaccgggacctgggggggggccaaatatcccgaaaaagaaatggaaaaaaacgtggcctaaaaaaaggcaaaaaccgctcccgggggaaaacaggatacggtccaaaatccaaaaaagaaaagaccggggagccaaaaggggaaaccccggggggccaaagggggggggcaaactgccagaaatgggggggggaaaccggccgggccaccagcaggaaaaactgggcccacacgcggtaaaaggaagcccccaaaccgggggaaaggggggtttttctttgggccacagggggggtcttcatttgaacgagggaaacggcaaagcccggagggccttacaccccggggcccaagaagggtggacccaacggg

SEQ ID NO: 21405 - DNA, 503 bp, Zea mays
  Clone ID: cC-zmle18900076h09a1
tttttaaattagaatgcaattgcagtttctaagggaacagggatgggacccaaaaacaaaagagtgaacgcgataataacctagtatctcgtatctactcaacagttcaacttaactcactagtcattacaagaagatcacaacagattgagttggcatggtaatgctctgtcaaacgatatttacagtcagccaggactacgacaggaatgggagttgccaccagttcttataatcaccagccacttcaactttctccaggctctatcgtagaacagtccttagactatttcctatcactaacacataaactcactctacaacgcccattacaaagcacaagcagaacctgcagaccgaagcttataccatggttatgagctcttataccatggttatgagctctttgtccaaaactacttcctacttataaagcaagcctaggttgttggtttgcatgcatattattgcgcctcatcctcaaccccactttcttcttctga

SEQ ID NO: 21406 - DNA, 503 bp, Zea mays
  Clone ID: cC-zmle18900076h11a1
tttttggtttccaacgtcatttatggtgaggtgccatatgggatatatatactgtctcagctgaagggtggccagccaattacagatctgtaggactgtaatgctattggtactaccagtattaggataaggataatgaaagacagctcgacttgcgaagctatgtggatgtgtgatccaccatgtaccagacgggcgaggcgccgtcatgcatggggtacagccgtacaggtgagacccgcaatccatcactggaaggagatggccatctgggccatgaagaggttgatgacgtccaggtagagggagatggctgccaccacgtactggttgtaggcgtgacgcttcagcagcttgttggtgtcatagacgatgaagcccgagaacaccacggtggccaggacgccgtagatggtcatggctacccttcccagcgggaagcagacctggatgatgatgtacaccaacagcacgacgaggcatgcgaacaggaaagggaacgt

SEQ ID NO: 21407 - DNA, 429 bp, Zea mays
  Clone ID: cC-zmle18900076h12a1
ggggggaggagccttggcctaagaggtaccttacttttttgagtgggttcttgggaggaataattcgggtatccttaataatcgtccctgatagaagctaagagctcactttacttaacaacaaattttgatttgctatcatttatctcttttttaatcggacgtacgtacagctagcccgagacatgcattaaacgggggcaagcttcttgtcgaggatcatgtcgtctgtggggaaatccgcctccttccggaacgtgccgcggccgaagtcgaggttgtaccaattggtgagcccctggacgaggtcaaactccggcgttcacccgagttcgctcgttgcctttttcacagacccaaagaagtgctggtctttgaatgggaaggcctttttttttccgaagtcgaattccttggggttgtattgga

SEQ ID NO: 21408 - DNA, 142 bp, Zea mays
  Clone ID: cC-zmle18900077a01a1
ccaagacaccttttgctccacacgaacccacggtgcagctctagcaggcgtgcccatccgacgcaccccatatgcacggatgaaccccatgactgcgccgcggaacaataaccactgcccccacgtaccaacgcccacccta

SEQ ID NO: 21409 - DNA, 317 bp, Zea mays
  Clone ID: cC-zmle18900077a02a1
ccggggccctggggcggaaacaaatgcccattctttttccggttcctttgataaaaccaaacataggttcacagtttaaacttgacttacaaacagtctaacaaaaaatacaacactttgttttaacttgggacacaaaaacctttttttttttttccctttccctttccgctcactgccttaatttaagaaaactgccggagctccggccccacaaaatcggccttggcaggcccaaaaatttttacggggggccttaccttggcccaaaccttaagggcaccatggacagggtcccacaaaaacttttgtttagg

SEQ ID NO: 21410 - DNA, 434 bp, Zea mays
  Clone ID: cC-zmle18900077a03a1
ttttggctttaatggttatatctatccaccaccacgagggcgttcgggaaacaacaacacgacaccaaacataactgtgacagggaaggcgacaaacaccacaagaacaggcgcaaagtaaatccagacattcggttcggcatcaacaggcgtggacggtggttcatcacaacgatttgaacattagataataaacagcacactcacggctcggctgtaacaatgcagaggcaacgtcgcaacggtggtccagtgtccagaaggtacacagccgtctttatttatgcaagcgaatggatatagtagcagtagcggtgaaccagggcaacgcccaacagaaggcactggtgcttagtcatcgtcatggtggccatggtggtggtgctataatgacgccgctttttttcatcatccgagtcgtcatcatctttttt

SEQ ID NO: 21411 - DNA, 488 bp, Zea mays
  Clone ID: cC-zmle18900077a04a1
atgttgaacatcaaagccacaaatcatgacacaaatggcgcgtgtgacaaccaagagtcgaacatgggctgttcctaaagcctccagttttttttaggctcaaaatttccttatagccgctacagatccaaaagaaatgggacagcaggtgcgtgcattagtcagtaggcacaccgcacacgtacatacatatacagcaaacgacgacgacagctgcgtcacccacaagtgcgcacatcacatctacagggtgaaatccagcaagtaaaaaaaaaaacagaggagaggacgacgaggcaaaccagtggagttttaggcgtccccttcctcgtgatgaagcccagcggtggtctgaccactgtctgtcgcgtcttgacaggcaaggtggcccaccctcggatacctctccttgaatttttcctcccaatcttgcaacaccttcagctcatcggcgcttaggccgtccagatccccggcccacgcgttcg

SEQ ID NO: 21412 - DNA, 484 bp, Zea mays
  Clone ID: cC-zmle18900077a04d1
acgcgtgggccggggatctggacggcctaagcgccgaatatctggatttgttgcaagattgggaggaaaaaggcaaggggaggtatccgagggtgggccaccttgcctgtcaagacgcgacagacagtggtcagaccaccgctgggcttcatcacgaggaaggggacgcctaaaactccactggtttgcctcgtcgtcctctcctctgtttttttttttacttgctggatttcaccctgtagatctgatgtgcgcacttgtgggtgacgcagctgtcgtcgtcgcttgctgtatatgtatgtacgtgtgcggtgtgcctactgactaatgcacgcacctgctgtcccatttcttttggatctgtagcggctataaggaaattttgagcctaaaaaaaactggaggctttaggaacagcccatgttcgactcttggttgtatacgcgtgatttgtgtcatgatttgtggctttgctgttcattat

SEQ ID NO: 21413 - DNA, 408 bp, Zea mays
  Clone ID: cC-zmle18900077a05a1
tcctctagaacaaccgccctttctttttttttttcttttttctctttttttttttttctttttttttttttttttttgtaatgggttaaaaaaaaataacccaaacccccccaaaccaaacaaaaaaaaaaaaaaaaaaaaaaaaaaaaaaaaaaaaaaaacaacaaaaaaaaaaaaacctaaaaaaaaaacccctactatcctaaccaaaaaaacaaaaaaccaaacaaaacaaaaaaaaaaaaaaccaaacaaaaaccatccattaaaaaaccacaccaaacaaatacaattcaaactaaaaaatctaaaaaaataacctgtttaattaaaccttcctaataaaaaccaaaaaaaaaaaaaacaaaaaaaatttacaaacaaaaaccccccaccaataatatcctc

SEQ ID NO: 21414 - DNA, 431 bp, Zea mays
  Clone ID: cC-zmle18900077a05d1
aaccctgacatgcttaagtgtgcccgtgttcagctggtgaagaattttaaatttattgctgcctttgtgccaaatgagagttgggtaaactacatcgaggagaatgaccacgtgctgattgctgtgtttggtcgtatggtccatgctgtggtagatattcctggtgtcaggtttcaaggttgtaattgtacttgatgtgtctcttctcgcgctcttcaaggataagatggagaatccaaggtcttacatcactttcgatagtcaagaatggagttaactgacaggctctactatggagttaactgccaaggttttacatcactttcgatagtgaggttcaaggttgtgaagattatcgacagtacctttaattctgagctgtactttttgataacatttctatcgatactcgatagttttgttcccatttt

SEQ ID NO: 21415 - DNA, 415 bp, Zea mays
  Clone ID: cC-zmle18900077a06a1
tttttatgcgatttcttcattgattggaagcatgactatttcttggggcagaggggtcctaaagattgatctcgggtataaagcttgagcatttaagacgtctgtccacccttctttccagcctcgacggggtcgaccttgccgtgagcgaactcgcccttggcactgccgccggatcctgaagagccagtggaggagtcggtgcttccggtgccggatgtagcaccaccctgctttccagcctcatgggggtcgaccttgccctgagcaaactcgccagtaccgacgcgcttgtctggggtgccgtcctgcttgaggcctccgtgctcagtgggcttgtactgctggtccgccatgttgatgatgtatgcttgattgaagtggggagtggttggttgaaattgtacctgttgat

SEQ ID NO: 21416 - DNA, 413 bp, Zea mays
  Clone ID: cC-zmle18900077a06d1
caacaactacaatttgaaccaaccactccccacttcaatctttcatactttatcaacatggcggaccagcagagcaaggggactgagcacggaggcctcaagcacgacggcaccccagacaagcgcgtcggtactggcgagtttgctcagggcaaggtcgacccccatgaggctggaaagcatggtggtgctacatccggcaccggaagcaccgactcctccactggctcttcaggatccggcggcagtgccaagggcgagttcgctcacggcaaggtcgaccccgtcgaggctggaaagaagggtggacagacgtcttaaatgctcaagctttatacccgagatcaatctttaggacatctctgctgcaagaaatagtcatgcttccaatcaatgaagttatcgcataaaaa

SEQ ID NO: 21417 - DNA, 195 bp, Zea mays
  Clone ID: cC-zmle18900077a07a1
aaaataagcaatggggctactggccccatacgaaatgaatgaaccaattgggggttccacttccaccgttgaacttggagctgaaaccaaaacttgaccggtgaagaaatagatccgccgcccgcgcgcgcagcggtttaacgcggtcatgaggaggcggcggacccttgggcggacccctgggcggacccgtgg

SEQ ID NO: 21418 - DNA, 193 bp, Zea mays
  Clone ID: cC-zmle18900077a07d1
cgcccacgcgtctcttccacgcgtccgccgcctcctcatgaccgctttaaacttttgcgcgcgcgggcggcggatctgagctcgtgacccgtccaagattttggtctgcagctgccgagttcagcggtggaagtggaacacactattcgttcattcatttcgtatggtgccagtagcgctattgtttgatttt

SEQ ID NO: 21419 - DNA, 360 bp, Zea mays
  Clone ID: cC-zmle18900077a08a1
gaaaacccaacttcagttaataaaactaaatttcctttgaaacccccaaaccactgggcggtccaccttttttaagggaaagaaaaaaaaggggtttacatttcgtttcacaaaaatggaacctaaacaacatccatttttatttcctggcatttgggttacttttgcgcacactggtcctttttaaagacccccttggcgatcaaataaaaaccccccaaaaactttcggatttccttttttttaacaaggcctttctggtttaaaagggcgggggaacgaaaaacaaaccctaccctttttcccccaaggattaacttattcttgacctttttggaccggaggatgggccccccatta

SEQ ID NO: 21420 - DNA, 494 bp, Zea mays
  Clone ID: cC-zmle18900077a09a1
aacatgggggaggggatgaataatccagtaattgtacaataccgacagtaaactgacgtcccattataaatcctttcagtaatgataaacaaaaggtttcaaacaaattgctcgacacataggttttaacagcaacatattatagccctctggagccgggatccatgtggctaaacatcataacataaagtttttggcagtaagagggagcagcaataattcctccacaaacttttaacttcaaaaatataaagtaacacttaggccagcattcggccgttctccaaatcaaaaacttatttttccttctaaggctcctcgagccatttgacaaacgggtccagagctttcacgaaagattgcctgcccttctggtttgaacctttacggaaccaaagcaggacagtttcttcagcttggacatcttgggcatacagcgttcttatgattttaggaaacagctttatcaacttaacatcctcatagcactgggt

SEQ ID NO: 21421 - DNA, 377 bp, Zea mays
  Clone ID: cC-zmle18900077a09d1
agggaagaaccagggggagaggggtaatgcttcactccgtcaggtcccatcatcgtctgagctttttaatgctttttgcacgattggcagactcgaactggaacttatatacaaagtacagacacagatgctatgaggatgctaagctgatgaaactgcttcctgatatcataaaaacactgtatgaccaagatgtcctagctgaagatactgtcctgctttggttccgtaaaggttcaaaccataagggcatgcatatctttcatgaaagctctggagccgtttgtcaaatggctcgaggaggctgaagagaaacaataactctttgatttggagaacggtcgaatgctggccctaagcgttacttcatatttctg

SEQ ID NO: 21422 - DNA, 558 bp, Zea mays
  Clone ID: cC-zmle18900077a10a1
acttccatcctctagagcggccacccttcttccttttttttctttttttttttttttttttttttttttttttttttttttttgttttttggtttttttttttttttttttttttcccctttcccctttttcttctaatacccccccccccacccaaaaaactctttttccccccccaagaaaataaaaaaccccaaacaaaaaacctttttttcttttggggcgaaaaaaaaaaaacccccaaaaaaaaaaaaaaaagggcccccccccattctaacaaaggggaaacaaaatccccatccctaaaaaaaaaaaaatttttattgccccatttttttccttccccttaaaataccaaaaaataaacttcccggcccaaacaccccaacccctttgccccccccttgtttcaccccaaaaatcccaacccgtcccctaaagcccccccccttccccataaaaaaacccaaaaaaaacttgggcaaaaaaagacaaaacccttcccctctgaaaaaatattatcccccaaaaaaccccaaaaaaaaaaacacccaaaaa

SEQ ID NO: 21423 - DNA, 410 bp, Zea mays
  Clone ID: cC-zmle18900077a10d1
cgtcggtgtagcagcagctattaattttagttttgatttttgaacgaagaactaggtcagggaaaaggtatcattgacagtatgctgaatccgctccccttctgttgaatgagacgggaccccatcgtgttctgtaccggggctaattctttgccatcacacaaagagccaagacgattgttgtaactcgggttatttaaatcccagctgcagagcaaatacacaactttaaacgtgtttcgagcaggctaaaaaaaataaaaaaagaaaaaaaataaaataaaatacaaaaaaaaaaaaattacatttattataaaaataaatctagggcgaatggccaataatagaatcataaaaaaacttgggggggccttttttaaaattcacattttttcatccccgggcttgaa

SEQ ID NO: 21424 - DNA, 548 bp, Zea mays
  Clone ID: cC-zmle18900077a11a1
tcgcgtccagcgggggctggctttccctaggctggtcctccaccgccgcggagggcggggcgaggacggctgcaccgtgctcatcaggcgggggccaccctgactacccgcctgagacgggcgtgtattaccgtggtgatctagcgccccgtctcggtggaggactccgagtgggaggacgacgaagaggatgcctcaccatctgggcggcagtcgggaacagaggaggccagcgaggtccggctcaacgcaggaatcgaggggatgctcaccaggctgcagaaggatagggagcgagctcggccacctccacggactagtacccacgacacacagggccaaagtgacgatgatgcgggcaacagtggcgctcctagccatacagcggctggtggcaggcatattccaagggctcctgagaatggaagtgtccatggatctcattctcaaaatggaacaatagagggcaacagcacctttcagggttcgaacgatgatgcatggcaaacatggacccttggcagggcgacttatctcattttgaagct

SEQ ID NO: 21425 - DNA, 345 bp, Zea mays
  Clone ID: cC-zmle18900077a11d1
tgagaccaaaaggccattcaattaaccggaatgattattttcggccacaccatgtgaaaacctacgccccttgatacgtaatgtcatttccgatcaatgtatatgtcgatcttttcttttaatagtaaactacacttaaaatgaataacccttgcaaggtccatgtttgccatgcatatcttcaaccctgaaggctgtgccttattgtctttgagaatgaaccatggacacttcattctcagaccctgaattgcctgcaccaccgtgtatggctagacccactgttgccgatatctacttggcctgggtcgtggtctatccgggagggcgactcctccttctttg

SEQ ID NO: 21426 - DNA, 536 bp, Zea mays
  Clone ID: cC-zmle18900077a12a1
actaatgtatattatagtattaaaaaccgtggggtccaagggagggccttaatggtaacccgtccacagcaaaagagatcacagtccaatttcaggttcaatttatggccttaccctgccttgaccccacatcattacatgataacaggcttcagcaacagcaacatggcaactaccaaggccaataacaatgcagcaaccactcatcacaggggaggggggaacctgctctgcttacacctgagctgcctcccgctcgcggttccactgctcaatctttgccctccgctccttgctgccttccctaaccgggctccggctccggctcctcgaccgcccgcgtagactgcggctcccgtcgctgtcgtggctgcggagcctctcgctgctcctgcggctgccactgccactacggcagatgtagtagtagtaatcgtcgcggtccctggacctggacgagctaccgccgctgcggtatgggctcgggctgccgctgccccggctgtggcttccgagggagcgatgcaggtggccaa

SEQ ID NO: 21427 - DNA, 294 bp, Zea mays
  Clone ID: cC-zmle18900077a12d1
catcctggtacatttgctctttggacgaaagacgtgactgcctttcttcaaatgccatgccgcacggacgtgctccgctgcacaacaagcgccattgcgactgtgttgaacatgaccacggcgacatgatcacccggctggacccaggcaccccacacccgacggatccaggaggacttcaggactttacagacatcttctggagctgacagccgcagatcaagctcacttggcacctgggccaatgatcggacggtcgtgagtcggagaggacagcgcccgcctgagcctgag

SEQ ID NO: 21428 - DNA, 427 bp, Zea mays
  Clone ID: cC-zmle18900077b01a1
ttttatatttcatcatttattatgtaatgaagagtagcagggattatgggtacatgacgaagggtgagcatccatggaggctagattatagacagacaccctgattttacatgacgaatcgcatgaagcgcatgcattggatatccttagccggagagggcgctggtgttgtagacaaggagggcgccgccgccgaggatcccagcgagggtgacggcccacatcagaagcccagtggttccaccgacgtagacgtcgccggtgggagaccagtcattctcgttgtagattgggctgtatccgtcgacgttcgcgccgaacttgcgcaaaacggtccaccccccttgccctttgccctttctcccgttggcgtcgacgtcgaccgtcaggccacccccaatcccgttgggcttgtcggtcttgatct

SEQ ID NO: 21429 - DNA, 394 bp, Zea mays
  Clone ID: cC-zmle18900077b02a1
gaactcaatgccaatttcggaggttgggacaaatacacaatgtgcagtttttgacattgctggtcacatttgcagtttgaattgcaaaaccatattgccagcattattgccacaacttatatgccatgatctcattgaatgaccgaaattgatgacaagaactagcccatttcaacaacgaaatccccctttcgctggtggcacggaacagcaacgaacgcaccaccacccttggagcaaccactgatgcataaagcaacccgatctctagtacaggtcctcctccttgtgggtgtggatgacgcaatctgccttggggtaggaaatccgttaagaggtgcccctttggcatatttggccgtcgttgaggaaggaccccttcgactggtcgacc

SEQ ID NO: 21430 - DNA, 438 bp, Zea mays
  Clone ID: cC-zmle18900077b05a1
ccttataacaaacacccttttcctttttttctcctccttctctttttttttcccccccccctcttctcaaaattgtaattgtttaaaatttaattaccccattattccccaaacccactttaaataaccaaaataaaaaaacctaatacatcatcttaaaaccaattcacactaattcaaatacaaaacacaaaaattaaaaaaaaaaaaaatataataactaactaaacaaaataatttaaattacacaattctaaaaaaaaaaatcacacctctataaaaaaacctcaaaaatcacatacactaacaacaaaaaaaaacaacctaacattaaatatactttatcaaatctcaaacccaattaaaatttcttaacaatactaatcccctaattctattaaaaaccaccccataatcacaaaaataaataattaactt

SEQ ID NO: 21431 - DNA, 137 bp, Zea mays
  Clone ID: cC-zmle18900077b05d1
aaaaaaaaaaaaaaagaaaaaaaaaaaaaaaaaaaaaaaatttttaaatttttaaaaaaaaaaaaaaaaaaaaagaaaaaatgttaaatttttatacatttttatcccctaacccttttttattttttttttttttt

SEQ ID NO: 21432 - DNA, 404 bp, Zea mays
  Clone ID: cC-zmle18900077b06a1
gtagcattcccaaaaacttttatttagggcacgagcttattggcgtaattcgaacaagaaccgagaggcgggcccctccaaaagccacaatccatgacccttccaacccggtaaccccaaacatacataagggccgcaggcttgcaccaacgggcgtggattcccgcccccgggcggctcaaatagccctggcgaggaaactctccctgcccccggggacctccccggggcaggggttgatgtccccccccaccctggttttgcgccccaagaaaccctggccccctaggtgaccaagggggggggggggggggttggcccccgcccctgaaacaccgttaaccctctcaaacctttcctttaaaaaatgcttttggaccccccctccctgggggcccaaaccc

SEQ ID NO: 21433 - DNA, 525 bp, Zea mays
  Clone ID: cC-zmle18900077b06d1
gccagcgtctccacgctcgggacctgggcacaattcttcatttcgcacgggcgctgcacacaggggcaccaggcgtcggctccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccactgcttcttggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactggttgtgcagggtcatcgtacttggctatcgtacgtgcacgcactcagcttctgtacgaattacgacaattagctcgtgacctgaa

SEQ ID NO: 21434 - DNA, 540 bp, Zea mays
  Clone ID: cC-zmle18900077b07a1
cctcataaaacaaccaccctttcttttttttttctccttttttttttttttttccatcccactattattacaattttgttttttgttttaatattacaaccaaatttaacccctacccaatattacccaccaaaataaaaaaaaaaaaaaaaacaaaaaaaactctaaaaaaaaaaccccaaatttcaaaaaaaaaaaaattttaaaaaaaaaaatattccacattcacttccacccacaaccaaaaaaaaattaaaaaatctacccaaaaaaataccaacttttcaaacaaaaaaaaaaccaaaacaccaaaccttcccaaaaaaacaaccaaaacacccaacccccaaaaaaacacacagaaagcacagcccagaaaaaaacaatccttaaaaacaccaacacaaacaaacccccctcccaataatatcactaaccatacccaacaaatccttttacacacacccccacccaattccctgtctaactctaaacaccccacccaaaacctctcgccctacaaaaaaaaaacacccccgt

SEQ ID NO: 21435 - DNA, 614 bp, Zea mays
  Clone ID: cC-zmle18900077b07d1
gccgtggattttgagagggaggagcccgccaaatgccagatgtctgtttaagctgatgcaaatgcgacaggggccccggctaaggctgttggcttcttcgggaggacattatacaccacattaattctgcttgttgcgagccatccagatgtgtatgagccatgtgatgatttctttgcccttgttgatgcactactctcagacaaagcacaacttttgacactacaaccaaggttatgtatgtaggtagtgtcagatagtggttacgtcgtcacctctattgcaaccatgttttgtacacaatatatgttttatatatggtgcacttggttccgtctctatttcaatttttctcttaccctcttcttttcatgctttttcgtcagacgatgacactatcatgcaaggcccactatcctctttgttgtcctctcatggatcctggtccagtggtggaggctgaggaatcagaaaggccccacatcatggccagtcatcgacgcaacggtggagcttatggctggaagtaatatgaagagtctatattctgacaaaaaatcatctaaaattaaatagtgagataagctttgaatagctgatgtaaaatatggagt

SEQ ID NO: 21436 - DNA, 493 bp, Zea mays
  Clone ID: cC-zmle18900077b08a1
gttatcagtttgcactccttttattcgcaaaagccgggtatggggaggacgcactccactcagcagctatacctatatgttccgttcttctcactggacagtgagagacggagatccttacactgcatgcgtaccattttcacaactcagctgatgtatgttccttcatttacagtgtgatgcatgtgcatgtgtaaccggatcaggctgcggcgacatgactctgttccttgaccacgctctctccaccctgttccagagtctgtacatgtgcaggctcctcttcgttggcctttcccttgccgccatcttccagttccagctctttcagctgcctcaggatatcttctctcttggcatgtaggtcttgcagcttggtgtccaccttctccagctttgctctgagcttcacgggatcggtcgtcttctccttggcgcccttgtctttcttcttctctccacccttgactttcttcttctctttcttctcctt

SEQ ID NO: 21437 - DNA, 537 bp, Zea mays
  Clone ID: cC-zmle18900077b08d1
aggattcatggaaggcataggaagacaagaaggataaagcttttgattttgagggcaagggccaagtgaagggggaaaagaaggatggtgctggagacgacggaggcgaggagaagggcaaagaaaagaaagataagaaggacaagggtgagaagaatgacaaggagaagaaagagaagaagaaagacaagggtggagagaagaagaaagacaagggcgccaaggtgaagactaccgatcccgtgaagctcagagcaaagctggagaaggtggacaccaagctgcaagacctacatgccaagagagaagatatcctgaggcagctgaaagagctggaactggaagatggcggcaagggaaaggccaacgaataggagcctgcacatgtacagactctggaacagggtggagagagcgtggtcaatgaacagagtcatgtcgtcgcatcctgatccggttacacatgcacatgcatcacactgtaaatgaaggaacatacatcagctgagttgtgataatggtacgcatgcagtgtga

SEQ ID NO: 21438 - DNA, 607 bp, Zea mays
  Clone ID: cC-zmle18900077b09a1
gtcatttttttcctgtttcaagctactcttgtcattacaaatttgttgaggcttataagttggattaaataatgcactttcaccaagttgctatcagtatacgctgctacaagctaactctgcgagaaagatgcatcaaatcagccaaaaataaaaaaagatagaatatcaacgttcttgcatgctcgttgaacagctagctatatgagagctttgatgccagcttgttgcatctcacgcagccgccagactgggtaataggattcttcttctggcacctcgtcgctgtccatgagttgcatagcccacgaatagaagacggtttggatggtatcctgtcctccttctgtgacttgtccttctcgatctcgaacacagtatatctgctgtgtttggaagcgtaagataattatgggtgaagatccaaacatctttgtttccaatacatcagcttctgaaatgtgcaagattttgtgatcaaaaaatattccctgtgatgcataagcttctctctctcctttgcagcgctcaatcacttccttggtgcagtagctttttagagtctccgcatcaccctttgaatatgcagataaaactggcttgatca

SEQ ID NO: 21439 - DNA, 622 bp, Zea mays
  Clone ID: cC-zmle18900077b09d1
gacaatctcatctgcttgaccagtagtatccggtgcgtttgcattgttgatttacacaaaagtctcaactttagcggggcagggatatgaaatcgtcaaggatgaactaagctctaactctagcagaaagaaaaaacaccaagctaggcatgcttctgctaaagtagaaaagagtacaagaaccgatttagttcttacgccaacaaaaaagacagtattgggtgaaaaatgggaagaatttaagaataacatccgaggtcacccggtctacagaagagtggatgaatacaccaagcctgttgtaaccaagggacaagaggtagctgaagatgtcagggaaagatgggagacaagtgacaatccaatggttcagaaaattcaagacttgaatgaatctttgcttgaagaaacctcagctgcggtgacattcaaggaaattcggcaacgagacccgtccttttctctttctgatcttgttgctgatgtccaagaaatgatcaagccaattttaactgcatattcaaagggtgatgcggagactctaaaaactactgcaccaggaagtgattgagcgctgcaaggaaagagagaagctatgcatcacaggaatattttgatcaca

SEQ ID NO: 21440 - DNA, 500 bp, Zea mays
  Clone ID: cC-zmle18900077b10a1
aggcacggcttgcatttgcaaaactaggtatgggtcacgggctgtcatttattttgacagacctaaccatgacgccgcccatgctgggaaagcccacgctgggtatacccattgtcggatccgaatcctgacttttgtattgtcgtaagccatagcaaagaaccaaaccactacttcggcgagtagcttatttcttcttggagtcagcctcctcagccttggccttggcgcgcttctcccggacaccgacaaggcgggcctcacagcgggcggcacggagggtcttgtaggcgttctcggtggcctcgtagttgccgatggggccctcctcgaactgagcgacgttcttgatgggcagagcagcggcggtggattggacgaggttgtcagcgctcttggcggccttgacgtcctcggcggaggcgtcaccctgcttggtcttgccgttgcggcgggggaagaggatgaggcgcttcctgtactcctggaggcgctcgacg

SEQ ID NO: 21441 - DNA, 529 bp, Zea mays
  Clone ID: cC-zmle18900077b11a1
atattatagtattaaaaaccgtggggtccaggagggccttaatggtaacccgtccacagcaaaagagatcacagtccaatttcaggttcaatttatggccttaccctgcctgagccacacatcaatacatgataacaggcttcagcaacagcaacatggcaactaccaaggccaataacaatgcagcaaccactcatcacaggggaggggggaacctgctctgcttacacctgagctgcctcccgctcgcggttccactgctcaatctttgccctccgctcctcgctgccttccctcaccgggctccggctccggctcctcgaccgcccgcgtcgacggcggctcccgtcgctgtcgtggctgcggtgcctctcgctgctcctgcggctgccactgccactacggtagttgtagtaatagtaatcgtcgcggtccctggacctggacgagctaccgcggcggcggtatgggctcgggctgcggctgccccgcctgggctccggagggagcgatgcaggtggccaaacag

SEQ ID NO: 21442 - DNA, 593 bp, Zea mays
  Clone ID: cC-zmle18900077b11d1
gtccgacctgcttcacctccgggttccggctacggcggcactcttctttggcaacctgaccacagaaacatctaggcaaggagtcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccgtccatctgcccgacgctgctgctctgcaacatgtaccagcggccggacatgatcaccccgggcgtggacgcgcatggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcaggcggcccgcgccctgcatgcgctgcatggccgctactactcgggccgccccatcatcgccgagttctcgccggtgactgactttcgggaggccacctgccggcagttcgaggagcac

SEQ ID NO: 21443 - DNA, 481 bp, Zea mays
  Clone ID: cC-zmle18900077b12a1
acagcaacagcagtccctcaattatgggctcagggagtcaacattgcaaaaatatgcaccaggttcggcatgcactgtgaaaaatgggatttctggatctaccgcccaatgccctttcagtgggcgagcaggcacctcaagttctccatacagcgcggtcgaaacaaggtaatggacaacatgcacaacagataccggttgtcaggttatcatggtgcgaaaatgtgctcttgaagacctgtagagaccatccaaagcttcctgcaggtgctcatgttccactgttcagggaatatattagatctgaagcacactggcttcctctttcctgaactgaatatggttccataaactttggttgccaagatgaaatactggttgctcacatgaaacaattatccgcattgttcacgcatcgttgaaacaccatacgtgctctaagcttgcaatccaagcagtggtcgcttatcatgtttttcac

SEQ ID NO: 21444 - DNA, 500 bp, Zea mays
  unsure at all n locations
  Clone ID: cC-zmle18900077b12d1
cacgcgttcgatgtggactctgctaattctgtcattggagtttacggtttaatnatgaacgctattgcaagggagctgaggaatgcttctgccccggtagtattcgttcacggtatgtatgtgcttgcaaacattgcggctggaaacgaattgaacaaagaagctgtgatgaatgttcttctgcctcacagagcatatcgcatcaaaccattgtttgcggtgaactttcttcaaagcaaggataaacaattgctagttgccacgctgtggtgccttctgaacttgatttacccaaaatgtgaagcctcatctggtagggctgtcagactgcaaaatgctggagtgatccaacaagtgaaaaacatgataaacgaccactgcttggattgcaagcttagagcacgtatggtgcttcaacactgcgtgaacaatgcggatgattgcttcatgtgagcaaccagttttttatcttggctaccaatactttatggtaccatatt

SEQ ID NO: 21445 - DNA, 418 bp, Zea mays
  unsure at all n locations
  Clone ID: cC-zmle18900077c01a1
aaagcccggaacctctaaagcggccgaccttnccnccccccccccctttttcctttttccccaccccccaacaccccangggccccagggggaaaaatcaaacggggacacccccaaacccccaaaaaaaaaaaacaaaccatgccggggacccataacaaccactcccgaacaaaaataccgcgccacccaaataaaaacaacataaaaaaagcaaccccacaaaccccccccacccggaaaaacaccccaagggcccgagccatgcccacaaacaaaaaaacacttccggcccacgaatattaacccccgggaaaaaagccaccacaaccacaccaccccacgggcggggcggaagcaattacgcccacaaaacccccctgcgcacccaaaaaaacacagaaccacgggcggcccc

SEQ ID NO: 21446 - DNA, 134 bp, Zea mays
  unsure at all n locations
  Clone ID: cC-zmle18900077c02a1
cctcccctcttctcttttttttttcttccccccctccccccngggcaccgnggattttttttacacgggttcccccccccccccctccaccccataatttcccccccggaaccttaaccccccccccatccccc

SEQ ID NO: 21447 - DNA, 305 bp, Zea mays
  Clone ID: cC-zmle18900077c03a1
gcaaacgagaaccggggtcatttttttctcggctcgtttcatatcgggagcaaacaaagggaacaacaggggtaccaacacctaatccaaaggtagaacggacactaacacggtgacagaagccaacggttacaccattcttttgatagataagataaccttggccgaaaccagggaggggccaacaaataaattccttcaaaccgccgccgctcccctccgtatccgccacaaccacctttgggccgaccgccgtaaaccccaccggcttcatagtcggcggcaccaccctcgcgccgaccgcc

SEQ ID NO: 21448 - DNA, 350 bp, Zea mays
  Clone ID: cC-zmle18900077c04a1
atcctctaaagcagacacccttctcccttttcctatctctttatcttttttttttatacacacttcataattatcttgtccccggtttttttttaaaatacaaattataacactaacccattattttcaaaacttaccatcccattttccttacacctataccccttacccacctaaaaaatcctataccaccttttaatcatattaccaccaataataaatatatactttcacaccccctataaatcaaaaaaaaaatcaaaacaaaaattttacccttctccaaaaaatctacaaaaaaaaattttactattttccccacctaaccccttccctcttaatatacatat

SEQ ID NO: 21449 - DNA, 449 bp, Zea mays
  Clone ID: cC-zmle18900077c04d1
gcgctgagctgaggcccaccgttgatatctctgtgcctgccattttcgtttttgtgcgcccggagctccggtaagcttccgagattgttgcagtgagcggtgagggagacacaaagagaggatttcgtgtcccgagttagaacagagtgctgtatgttttgtgcgactgtttgtaagtcaagtctgaactgtgaacctatgtgagcttctatcagaggacccggagaaagcctgggcatctgtttccggaataaaatgggtctttccatggttaaaatataaaatataaatattttaaaatttataaattcattaaaaatttaatttatttttatatggtatggtcgtgttgttttcattctatttttttctcatatatcctttctcttttttattgttggtggggggtgcttcttttaattttctctcttttttttcccttgggtttt

SEQ ID NO: 21450 - DNA, 264 bp, Zea mays
  Clone ID: cC-zmle18900077c07a1
gaaaaccccatttctcctttgcccttgaacaattttttaccttatggaccaaaccgaaaaccacggtgggccaacatgcatccggcaccctaaaggtccccgggggcccctcccttactttccgggaaccaatatgggggcgttggcccaatccttttttttgacggggtcctgaattttgtaagggaggttttagagggggcccttcccggaaaccaaagcctggacaaaaaatcctaacattgaaaaccttgtaaggggggc

SEQ ID NO: 21451 - DNA, 517 bp, Zea mays
  Clone ID: cC-zmle18900077c07d1
gccgatctgcaagtctcgctacgtagcagtgcaataaaaaaaagtttccgttttggcgagcagcaccatggccctgtcctggagggccttcgccggcaaggccgtgaacgtgccgtcgtcgtccgccttcggcgaggcccgcgtgacgatgcgcaagacggcggcgaatgccaagccggcggcggcgtccgggagcccgtggtacggccccgaccgcgtgctgtacctgtgcccactgtccggcgagccgccgagctacctgacgggcgagttcccgggcgactacggttgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccacatctttagcgagggcgggctggactacctctggaacccgagcctcattcacgcg

SEQ ID NO: 21452 - DNA, 459 bp, Zea mays
  Clone ID: cC-zmle18900077c08a1
ttttaacacagttttggttttaatcaaataataataatgggtaaacggggagaggtgataatctggaacaattccatatcatacaataacttggaagacagccccttccactgggcacaggcgcaaagctgataatttgttattatctccttgcaagttcaacatcaggcctgcacatttggcagccaacacaacagtttatctgactgctagttcatcaggcttagactagtaaccacccctcagagcaaggacaagatggaggacagatccaccctcgatgttgcagtcctttgcggtcttgtcatcagcaagctgcttaccagcatagatgagcctttgctgcacgggaggaatgccttctttctcttcaacacgctccttgatcctgtcaatcgagtcagtgggttcaatgtcgatctcgatctctttccaaggagagctttgaccttgatcatg

SEQ ID NO: 21453 - DNA, 195 bp, Zea mays
  Clone ID: cC-zmle18900077c09a1
ttttaaacatgcttatatttaaattatttttcctcacatctcgccgggaagcggacatgcattatctcagacttcgcagtggcgagctcgatcgatatatatgatgactagcatcagtactaaaatagtattgtatcagggacacacgtacggcatcgaccagagcaccatgcatggtccatggatcatatcatc

SEQ ID NO: 21454 - DNA, 176 bp, Zea mays
  Clone ID: cC-zmle18900077c09d1
ccatgcatggtgctctggtcgatgccgtacgtgtgtcccttatacatttctattttagtactgatgctagggagtagggtatcgatcgagctcgccactgccaagtctgagataatgcatgtatgcttgacggcgagatctgaggaaaaataatttctatatatgcatgtttaaaa

SEQ ID NO: 21455 - DNA, 433 bp, Zea mays
  Clone ID: cC-zmle18900077c10a1
cgtcaacatcgattataacgtcaagacaaagggtgttcatggcatcgagtatttcatgggcaacaagtttactgtgccgaatcactaagttcaaattcacactttgatggtactcaccagaaatttattctgctcagagcaagcgcattgctggcaaatgacacaagaaaccagtccctacccaccgcggcaaaatgtgaaatgacgttagccaggaacagccatccttacgccttcacttgaggaggagcatcgccttgaagagcaggatcagatttgacagcatctagtgccttgaagaactcctcaggaagagcaacaggccggtgctgaggaacatgcttaggaattggggtgtcgtcttcaatcacctcacattcgtagtcatcgggaacaccccatggatcccattcaatcattttagcgatgagct

SEQ ID NO: 21456 - DNA, 521 bp, Zea mays
  Clone ID: cC-zmle18900077c10d1
cgacgaaggtaagatgttcctgcggaggattttttacctgtttggggcggcctggcggccctgagagcggggcgcgccttgaaggagactacggccatcgtggttccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgtatcggatgcggtcaggtcgaggagctcatcgaggaggccgatgacgagctcaagctcatcgctaaaatgattgaatgggatccatggggtgttcccgatgactacgaatgtgaggtgattgaagacgacaccccaatttctaatcttgttcctcagcaccggcctgttgcttcttcctgagaattctttaaggcactagatgctgtcaatctgatcctgctcttaaggcgatgctcctcct

SEQ ID NO: 21457 - DNA, 120 bp, Zea mays
  Clone ID: cC-zmle18900077c11a1
ttttagaatcattttactattatcttcccttgctataaactttgggggtactgggatacataactgcatcttcagtttttccttttctattttcctttagctacaccaaacaatacatca

SEQ ID NO: 21458 - DNA, 100 bp, Zea mays
  Clone ID: cC-zmle18900077c11d1
gcaaaggaaaatagaaaaggaaaaactgaagatgcatttttgtattctagtataaccaaagcttataggagaggaggatactattcttttgattctaaaa

SEQ ID NO: 21459 - DNA, 493 bp, Zea mays
  Clone ID: cC-zmle18900077c12a1
aaacaagtccatccaatgggctgggatatggagttaatgattacaaaacagcatgcagattgtacgatgtttattattacaatatgtataatatgccaagattttccacttggacttgacaaacagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttctcgtcggcgaactccttggacagcggcggctggggcgtcaccttgaagttggggtcccttatccgcttcagcgtgtaggcctggaacacgttcagggtggtgat

SEQ ID NO: 21460 - DNA, 576 bp, Zea mays
  unsure at all n locations
  Clone ID: cC-zmle18900077c12d1
ctcctncagatcgctgggcacaaggatattcttgaaggctttccatttttgaagcaagggctggtgctggggaaccggtacatcaccaccctgaacgtgtgccatgcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttttcttcactcacctgcagagtgcaccgcaataatcagcttccggatggtggcgttctgtcagctttggatggaaatgccgaactggcagcgtctgtttttccctatgcatatgtaatttcctggctctttatattcaactcttgttgtcaagcccagtggaaaatcttggcatattatacaaattgtaataataaaacatcgtacaatcggcatgcctgcttagaaattaataattaatatcccaccccataggatggccttgttt

SEQ ID NO: 21461 - DNA, 506 bp, Zea mays
  Clone ID: cC-zmle18900077d02a1
ttttgaattttcgaaattacttgaacatttatgacgagaggggtgtgggggtcacaatacaaattccctcggcattaagttataaacaaagcactgttacatgaggataagcaaatttcatagccaagagagtaagcgcagccaatgcagaccaatgttcaatttctttgtgagcatggaagcatgaacatggctacatcagttcttctcgtcttctgttttgtctgacttgacttccttcttctcttgctctccctggctgggcaatgatgccagcaaatctttaacagatggatcattgggatcaacaccaggaagcgaattaaggatagatgacacaaaccttctgtcttcaaacaccttactcatatcagtgtcactggacatgcttgcatcctggacagacatttgaagagccaacgctaagttagggtcaactgctccagcttctgccatagcggagtcagtcacagttgcacatcctgaagcaccgcccttcattgaca

SEQ ID NO: 21462 - DNA, 496 bp, Zea mays
  Clone ID: cC-zmle18900077d04a1
caggaaaaactgatgctcttgttagtgctggggggaatatgtacaaaacgcccggggtaagtggccccgaccgaggagaaacaacttgctacaccttaactcccatccttttcgcaatttccttgaaggagtaaacgtcactgccccaaagccaggcattgaagcctgcatccctcgctccccataagtcgttcctacggtcatcaccaatgtgcaccgcttcttcaggtttcactcctagcagctcgcaggccttcaagaatattgggggattcggcttttctgctgcaacctcagcagacacagcaactgcgtggaaccagccgtcgcatttcagcgcctgttaaagcggccgaagaccagtgtcgaagttggacacgatggctgttttgacgccagccctcctcaacgccttgaaaacacgtccagcgtctgggtcccatagacgccaggccttctcaagtgtgtaggactggtacagttcctcgaattattg

SEQ ID NO: 21463 - DNA, 478 bp, Zea mays
  Clone ID: cC-zmle18900077d05a1
caaatcatatcatcggggaccaatggatatggggttacaacatatgcaatcggatcaaccaacatgcaggttgacacacttacgtacatgagcacaaagactgactcccaacattgcagagagagatagcaaactgaagaactctgtttctgtctctctgacacacaccacacaatacctatgtatggcagccaggtcggcctcgcttattattgttcaaccaccaccacaagctagatagataataatcatatccatggtcgtcgatcgatgtgatcagcagttgcaggggtcgaacttgcagttgccacctgaggtgcagccgttggcggtctcgacggactccgccgtggcctcgacgaactcgggcgcggtcttcttgtccggggccacgccgaggacgactgtggccttcgcggcggtgctcgtctccttcaggttagggtacttattgccgcactttcagattgagccgcag

SEQ ID NO: 21464 - DNA, 475 bp, Zea mays
  Clone ID: cC-zmle18900077d05d1
ttgacccttgaagacatctttcttctttttcaccacaaggtccttgatgagtggcaagggctcatcaagctgcggctgcgccccaacctccaagtgcggcaagaagtaccctgacctgtaagagacaagcaccgccacacaagccaccgtcagactcggcgtggccccggagaagaaggccgcgcccaaattcatagaggccgcaacggagtccagcgaggccagaccacggctgcagctgccgctggcaactgcaagtgcgacccatgtaactgctgatcacatccatcgaacaccatggatatgattattatccatatagctaaggtgagtgttcaacaatattaaccgaagctcagctagctgccatacatacgaattgcgtggtgtgtgtgaaagagatagaaacatagttcttcacctagctatccatctctgcatgttttgcgccagactttatactcatgtacggacg

SEQ ID NO: 21465 - DNA, 313 bp, Zea mays
  Clone ID: cC-zmle18900077d07a1
tacgccagcttgccatcctctagagcggccgccctatcctgattactcgtcttctttttctcatttttctcatcgagaagcgtaaaaatgagtatctgggggtaatcctatttccccattcccagcaaaggctattgtctgacacttgactcctgaatcttaatgaaccgttctttcgctcaaacaaggtcagcctgcaacttgccggacgggttatctccctcaagactaaccttttgcattgccttcagctcgatcaacctgtcctccatcttcaggtggctggagacatgaaaccttgatctgccctatc

SEQ ID NO: 21466 - DNA, 375 bp, Zea mays
  Clone ID: cC-zmle18900077d07d1
cgcccaggaggactaccttaacgcgccatgacagacctactcctttttcccttttcgtgacgggaacctacggcttcgactgaggaggcattctagaaggcggaatgcgtcagcccatcaccgacaactaactaacgcagactatcgaggcgacatccactcacgtattaactgctgcttcctgctatgtaatccggcgatctgtccatgctgcacatgatgtcggccacatacaacaacctgtgttacgactacgtatatatacatactactaggtgctcgatgccttcgaccgccaagtgcacaaggagaaagaacgacgcctcaaaaaacacagaggcgcgcgctatacaggacacaaacttacgtactcgt

SEQ ID NO: 21467 - DNA, 100 bp, Zea mays
  Clone ID: cC-zmle18900077d08a1
gtgtaccggggaaaacctaaccgaaacctgcatgcttaccacctttttctataatgaggcataaaaaagctggacgtacccatggacatagcagcttcct

SEQ ID NO: 21468 - DNA, 337 bp, Zea mays
  Clone ID: cC-zmle18900077d09a1
attatggaaacaagagttccgggtttagggtacaaatacgtacatccattacataacgattattgcaccatagagtagttgcttgaataattaaactaactcaaagaaaacaaaatgtcatgactatagaaaacactagccatcttcaatttttgcattcgagcgccatccatgcattgcaaaaacttacatcgccaccacctccaaagctcgacatgcatcgagaatttgttggtgcttttcctccttctgtagaagtctccagaatctgaacagtgagtaaccctaaaaataacctgcacaattgatagtattggtttatgatcggacgcgtggg

SEQ ID NO: 21469 - DNA, 358 bp, Zea mays
  Clone ID: cC-zmle18900077d09d1
cgcccacgcgtccgatcataaaccaatactatcaattgtgcaggttttttttttggttactcactgttcagattctggagactgctacagaaggaggaaaagcaccaacaaattctcgatgcatgtcgagctttggaggtggtggcgatgtaagtttttgcaatgcatggatggcgctcgaatgcaaaaattgaagatggctagtgttttctatagtcatgacattttgttttctttgagttagtttaattattcaagcaactactctatggtgcaataatcgttatgtaatggatgtacgtatttgtatgctaaagccggaactcttgtttccataataaaaaaaatctattggccc

SEQ ID NO: 21470 - DNA, 446 bp, Zea mays
  Clone ID: cC-zmle18900077d10a1
ttttaaaaatcattcccaatgagatctcaccattttcctctctttgggtccacgtgaatcaatcaaagaatggcggtacaagttgcatgcgtgcaaggtgcacatcatcagtcatcaccacaggtaaaagatgtgcggctgcatcacgcatttctaacccacccacccagggagtaaccgtagtagtacaacatgtagtgcaaacgtctgcaccagccccagcttttttttcttttcttttcttttcctttcctttctactactaataaaaaataataatgttgtcaccaaccaatccggcgcggcgcctaaccaatccttccccttcccggcactctcaccgtcccttttccttattcattggcctgggcccgtccctcccacccacttacaggtgggccctaaccgtggaatcggcatcttcagctggtcgacctgcagcatat

SEQ ID NO: 21471 - DNA, 462 bp, Zea mays
  Clone ID: cC-zmle18900077d10d1
atgctgcatgtctaccatcttgtgatgccgattccacggtctgtgcctttttgtaagtgggtgggagggacgggcccagggcaattaataaggaaaagggaccgtgatagtgccgtgaaggggatggattggttatgcgccgcgcctgattggttggtgacaacattattattttttattagtagtagaaaggaaaggtaaagaaaagaaaagaaaaaaaaactggggctggtgcatacgtttgcactacatgttgtactactacggttactccctgggtgggtgggttagaaatgcgtgatgcattcgcacatcttttacctgtggtgatgactgatgatgtgcaccttgcacgcatgcaacttgtaccgccattctttgattgattcatgtggatcgaaagagaggaaaatggtgagatctccttgggattgatttttaaaaaaaaaaaaaaagggcggc

SEQ ID NO: 21472 - DNA, 480 bp, Zea mays
  Clone ID: cC-zmle18900077d11a1
aaacaagtccatccaatgggctgggatattggttaaggattacaaaacagcatgcagattgtacgatgtttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttctcgtcggcgaactccttggacagcggcggctggggcgtcaccttgaagtggggtcccttatccgcttcagcgtgtaggcctggaacacgttc

SEQ ID NO: 21473 - DNA, 525 bp, Zea mays
  Clone ID: cC-zmle18900077d11d1
ttctcctccagatcgctgggcacaaggatattcttgaaggctttccatttctgaagcaggggctggtgctggggaaccgggacatcaccaccctgaacgtgttccaggcctacacgctgaagcggataagggaccccaacttcaaggtgacgccccagccgccgttgtccaaggagttcgccgacgagaacaagcccgccggactggtcaagctgaacccggcgagcgagtacccgcccgtcctggaagacacgctcatcctcaccatgaagggcatcgccgccggcatgcagaacactggctaggcggcttctcttcactcacctgcagagtgcaccgcaataatcagcttccggatggtggcgtttcgtcagctctggatggaaatgccgaactggcaacgtctgtcttccctatgcatatgtaatttcctgcctctttatattcactcttgttgtcaaagccaagtggaaaatcttggcatattatacatattgtaataataaacatcgtacaatctgcatg

SEQ ID NO: 21474 - DNA, 475 bp, Zea mays
  Clone ID: cC-zmle18900077d12d1
accaaaaaacaaaaaacggggcgccgttaacaacgccggaacagaaaaaacccgggcggaacccaactaaatcgcctaaaagaacaacccccttacaccagcgggcgaaaaaaaaaaaaggcccgaaccaaacacccttcccaacaaaagcgcaacctgaaaggcaaaagggaccccccccgaagcggcgcataaaacccagaaggggagggggatacgcccaaaaaaaccgctacacttgccaaggcccaaaagcccgcccccatggagaaaattcccttcctatatcgacaaggacgccagccttccccagaaagcccaaaaaggggggcccccaaaaagggcccaaaaaaacccaaacaaaacctaaccccaaaaaaccaagaaagggggaaggcccacaaaagggcccccccccaaaaaaaaccctataccccttaaccgaaataccaccaaaaaaaaaaagccccggtcc

SEQ ID NO: 21475 - DNA, 556 bp, Zea mays
  Clone ID: cC-zmle18900077e01a1
gttgtccgcaatcgcgcaaattatgggatttgggagtacaataagacagcaaagtttccatcgagtcacacaaaccccacatggcaatgccaacacacgccttcaagcatataacagttgtatttacgaatctaccaaacatgagtagcagtccacaggacaatgggtcattgcggctcaacagcataagcctgaatcgcatctgcaaaggagcagacacccatgttagcatacccaagttaggttccataaatcataagtatttcacagcatatagaagctgagttcaagaaatctgggaagagggttttcggccaccaatagtttaccaaacagataagctggagaacatttgcagaggatttatcaactgccataaacagaacagagttaacagaatttgctcaggaagtatgaatttgagccgatgctatttatatgcaagacaaaaaaaaaaactctaccagtgtgcaaaatgcaatgcgtgcctttagaaatattctttgtacacctgggtaagcaatataacagtaaatacacaaacatttgggggggg

SEQ ID NO: 21476 - DNA, 413 bp, Zea mays
  Clone ID: cC-zmle18900077e02a1
ggcttgaaagcggggcttagggggattaccaggcataccactgaaggcccagtatacgcagaaactactcttagcaccaccacacgcgcccgtgcgcacacaacgcatacacttaacacaacacaacacaaacttagactaacagcaccactagcacacatgtacgtttcgtgcgcagcccggaaaataattggaagagctcagctggcaacaagaacaggccccttcaataggcaatcaagaaagaaacttctttctcatgccaaatacaaaacaaaaacaaaatgtttgctacacgatcacgagacatgtgacgcccacaattattgctgattccaccgcagccagaagttgggaatcaacactgcgccatacaactttttaaagcaagggatagccttgaccaacttctt

SEQ ID NO: 21477 - DNA, 499 bp, Zea mays
  Clone ID: cC-zmle18900077e03a1
ctgctgaaccgatgcggagacgggcttgttccttgttgaactcaggctagtacagacaagcaagatgtgtagaataagccgcagctgaccagcgcatgcagtcaagaggtgggcgggcatgcttccatcatcgctgaaatcgccctgcagacttcgcattttgctatgtaaagaacagactacccagacaaggatttgtacttgtagtgcaagagcaacaggatgcaccacagagaagacatttttgctatgtaagaacagactgcccaaaatcttttaataaccaatcaaatgaacggcttgttctgacaaaaaaaaaacatggccagtttgagcacgtgtgcacatccacctcaaagtttcaaacgatttcggggggtggctgtgatgtcctttgaggcaggttgctgcgtccttcaggcaccttggcgccagaggtctttgggaggaagcccttgtcttgcagggacttcactgttttttcaggtacccatgcact

SEQ ID NO: 21478 - DNA, 522 bp, Zea mays
  Clone ID: cC-zmle18900077e04a1
ggatagggtcaaaacatatcatccggggcccccccccaccccctccattttttttcaatctcataatttccctattttccctatcccatccaaattacattttctccatctttctccttccattatcttttaatgctacaccttacacttacatacatttactcctatacttatcttcaacagctccttctcccacattttctcacatcacatctctctttttatttcattctgtataaatataaactcattatactccctctatgcttccctatctccttttattccttcccctttctcgtgatgaagccctattttgttcctaccactgtccttcccttcttgacatgcaaagtagcccacccctctatacctctccttgtactttaccttccaatcttgtcacaccttcatctcattttctcttattccttccatatcccttgccactcttacttaatccctcttgcctacctctgaatttcctacccttcccttatacttcccactttcctatattat

SEQ ID NO: 21479 - DNA, 420 bp, Zea mays
  Clone ID: cC-zmle18900077e05a1
ggaacaaaaaccaatttttcccaacacaacgcgagtacggcaggcaaaacaaaatctttacatttattttaccccctaaaaaaaaaagggaaatgaatggaccagggcaaaggcacattatattggcacatacatgcatacacaaccattaattgaacgtggcgaggagcaaaagcaaacgacgacggttttgaatccattcatccaaagcggaaatggagtggtgaataaattaggcgtaatcctggtccccgacctgctggtatgaaccgccaatgaaaacctctccctatacaaagccagcgaggccgccgtccacaaacgggcccacccactatacccaattttcggctaaatctcccgcggcgacggcggggcccaaagaacgggcggggtttattgaacccccccttaaaggcc

SEQ ID NO: 21480 - DNA, 481 bp, Zea mays
  Clone ID: cC-zmle18900077e05d1
ctcgtttacaccgtgtacgccaccgccgccgactttaagattttctcgctcggcaccatcgcgcgcgtggcggggggcttcatcgtcggcgccaacatcctctccgcggggcccttcagcggcggctccatgaaccccgcccgctccttctgccccgccgtcgccgcgggcgacttcgccggaaactgggtctactgggtcggcccgctcgtcggcggcggcctctctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggctgtgtatgcatgtatgtgccaatatgatgtgcctttgccctggtccattcatttccctttcttttttcggtgtgaaataaatgtaaagatctcgtc

SEQ ID NO: 21481 - DNA, 491 bp, Zea mays
  Clone ID: cC-zmle18900077e06a1
gccaccatatggctgggtgaactcgatcctatcgtcagtcagttgttccatgcatgcagttgggtgcattatgacgttaatatactacacacaaaaaaaaaatgatccactgggcgcatgtagatcaatctgcgtacctaccagtcacatgatctgttctacgtagtaaagttgtatggactacaagtccacatcctagtccattatgcgtatagctcaagcactgcccgctgcgctgccaacgttcgcagaggccccgctgcgtgaggttgaaagggccttggtgctttgacccaccgacggatgggcgtcggcgctcttgttcttggaggcggataacctgctgttcctgagcctgttgaagggccgccagtgccacctgttctgtgacgacttcatgtgacccatcatcagcttttgctgctcccttctgaaggcccttcgagcgtaccaagcaccgcctcgccagcctagcgcgtacccaacaacca

SEQ ID NO: 21482 - DNA, 583 bp, Zea mays
  Clone ID: cC-zmle18900077e06d1
gggcgaaccacccgtgcgcggacgcgtggggcccgcaactgctcgaccgagccttttaccgttttggcgcccgttcgttgcgtatccggcaagggggccggcctccctccgccttgggaggggaaagcggaggaggaagagggagccaagcggtcaagccggctcggccgctcgcctcccaccaaaatccccccgaatccccacccccaagcaacacccagaaaaggcgacaggtgccgaggtcgggggagcgatggttgtgcggcggctgggcggcacggggcgcgcgctgctcacgctccccaacatccggaggcgggcgtccaactcctgggccgccgtctgcgacaccttcttctctaccaagcaagtgttcgagagccaccgcatcgtcttcaccgtcggcacctcaatcgcctccgtcctcacggcttgggccggttattcacttcgccatgtgcaacaattaaagattgaaaggaggcttgagtcaattgaatcatctctgaaggataaccacaaagttgaacatgaagagataaataagatcgtcactttcagcaatattaacgctccatgctgt

SEQ ID NO: 21483 - DNA, 323 bp, Zea mays
  Clone ID: cC-zmle18900077e07a1
attcggtagcgaaatacagtatatagggtatatgtgggtacacactgctgatgcatatgggagcagcaggggcgttattttatgcattcatattcgttacaggcagctaggcaagcagcataactgcatatgcatgcatgcagatgatccgatccaatcgttttagttattagttggggttcacgtagagcccgatcgcgtccaggcaatctccagagcggccaaagaagccagcgacgtggccgttgttcatcaccttgacacggaacggggtgccctcgtccctgccgtacggtccgtaagcgcgtttgttggtgacgaat

SEQ ID NO: 21484 - DNA, 327 bp, Zea mays
  unsure at all n locations
  Clone ID: cC-zmle18900077e07d1
accaacaaacgcgccnacggaccgnacggttgggactttggcaccccgttccgtgtcaaggggatgagcgacggccacgtcgctggcttctttggccgctctggagattgcctggacgccatcgggctctacgtgaaccccaactaataactaaaacgatggatcggatcatctgcatgcatgcatatgcagtatgctgcttgcctagctgcctgtaacgaatatgaatgcataaaataacgcccctgctgctcccatatgcatcatcagtgtgtaccactatatatgttatatactgtatttcgctaccgaataaaaacataaaaa

SEQ ID NO: 21485 - DNA, 599 bp, Zea mays
  Clone ID: cC-zmle18900077e08a1
ccaaacccagcttgatcctctacaacggccgcccttctctttttccttttttttttttttctccttttttttccatctcctttttttttgtatttattttttttaccttaatacttcttcctacctcttcctttcttttcactttacactcatatacctcccatcaaaaaaaaaaaaacaaaccattttcacacctcaacttaaaaacaccacccaccatttcccccataatacatccccctccaaaaccctaacaccccccctcttctaaacattataactaaaccactctccctttaaataaaaacacattctccccacacaacaaaatactattcacaaccctttccaaaaaccccccctttcaaaaaaaactcccccagcaaaaaaaaaataacccctcccttcacaaataggtcttccatctcattgtccaccccccccatcttttcttaaaacaaaaaaccaccccacaccaattccttttctcccttaaaattatttttaaaaccaccaattcccaacacccccctaacaaaccttttaacctttccccccccaaattataataaacttttcttaaaacaaattctcccccc

SEQ ID NO: 21486 - DNA, 600 bp, Zea mays
  unsure at all n locations
  Clone ID: cC-zmle18900077e08d1
gttccggacgcccaagtttcccggatnngtanncnnctgaaaggtaggggcgaacacccgtgcggtcagacaacatcaaatgttgggcacctaaataagctttctattttggctcttatccatgggctgaatggacagggctactcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacatggcagtgcatgaggaggacgaactgcctcctgagaaacttgcgatagcaaatgtgggtcggcaagatgcaaaaaagcatttggaagagcatgtgtcgaatttgatgtcatcaaacatagttcagaccctatgaaccatgctcgacacggttgtcttttagtctactaatagtattgctgtcccaaactgaaacatatccacactatcgaagcacacgtgcgatgagcttgacgccgggtacatcttggttctaaggttcggctttgaatggatttgcctacatttcatt

SEQ ID NO: 21487 - DNA, 234 bp, Zea mays
  Clone ID: cC-zmle18900077e09a1
cctcttccccttttttaaaccacccaacccaaaaaaattcttttttttttaccaccctttaaaaagttaattaaacccttattttaaaaaaaacacctatttttcctcctccccccccacctaaaaattttacctcccccacacaaactttacccttttaaaacccccccccccctggttcccaaaaaactttttacaaaaaaaattttaaatcccccccattcccaaataaaa

SEQ ID NO: 21488 - DNA, 527 bp, Zea mays
  Clone ID: cC-zmle18900077e09d1
acccgagcgcccacgcgtcctatcaaaagcacttgccaggccatctttctactctatccaagtactttggatgtgaggggggtgggcagtccaaatttgatgagaagacagggatttccttggttaatggggctcatgatactgcaaagctggctggcctccttgaggtattcatcaagaagtatgtccaatgttatgggtgtgggaatcctgagactgagattctcatctcaaagacccagatgatatcactgaaatgtgcagcctgtgggttcgtctcagatgttgatatgagggacaagctcacaaccttcatcctgaaaaacccaccataacagaagaagggcggaaaagacaagaaggccatgaggagagctgagaaggaacggctgatggaaggtgaggctgctgatgaggagcagaagaaactgaagaaggatgcatagaagaagggttccaaggattccactgcttaaggcttgaagaaaaaaggtactactgctactggctctgatgaggaccactca

SEQ ID NO: 21489 - DNA, 314 bp, Zea mays
  Clone ID: cC-zmle18900077e10a1
actacctaccataccctcatctttaaacccacctttatacccatttctaatctaacccgacttaaacacacaaaagccatacaccaccatcttctcttggagagagcttatccccttgaaacaacctcctcatccttggccttggcgcactaataccggacaccgacaaggcggcccttatatcaaaaaacacaaaatgtcttgtatgccttctcccaaaccacaaatttgcctatttttccctcctcgaactgaacaacattcttgatggcctgaccatcgaaaaaacactgaactagtttttcagcgctctt

SEQ ID NO: 21490 - DNA, 549 bp, Zea mays
  Clone ID: cC-zmle18900077e10d1
acccgtgcgtccatgcgtccgaacatcctcaacaagaagatctactttctacttttcatacccatactttgtgtcctgggtccagggtagtattgggtgtcgtatactgcctcatcacctggagtgtcggtctccccaagcgagcgcctatcaatggcacgctcctcaagcttctctttccagtcgccctgtgccatggtattggtcacatcactagcaatgtgtccttcgctgctgttgcagtctcatttgctcacactatcaaagctctggagcccttcttcagcgcagcggctactcagtttatccttggacagcaagttcccttctctctgtggctttctcttgcccctgtggtcattggtgtttcaatggcatcccttactgagctttcattcaactggactggcttcatcaatgccatgatatcaaacatctcattcacttacaggagcatttattccaagatagctatgactgacatggatagcaccaacgtgtatgcttacatctcaataatcgctctaattgtttgcatttcacctgcat

SEQ ID NO: 21491 - DNA, 330 bp, Zea mays
  Clone ID: cC-zmle18900077e11a1
attacctaaaccaaagaaactggggcgtgaggggtatctttaacagacaaggatctaccataccttttgcttttgcacatttatacgttcatttattatcacttacattaaaaagggccttcatatcctgaccataccctgatacacaaacggctcgacttgagttgccaatactcacaacattaagggagcattctgtgattggacccataacttccaactaatcttttggcccatcggcttgttgatcttgccaaggatcctgtcactggctattgcacaacctgattcctactattaacttacttagggattccaatttatcatttt

SEQ ID NO: 21492 - DNA, 473 bp, Zea mays
  Clone ID: cC-zmle18900077e11d1
cgggcaacagaacctgagacctcaccaaggacgacaatgttggtttgtcgactgagacgcctgaatcgggcgccgaggcgcagcaaaacagaaataggctcgaacactacccagaggcgactagcacacacgatgccgtcgtctataacacctccataatcccgtggggggcatggatgaagcggatgcaccttactgaaaccgataagctaatctttctatcctccatggattggcaagtgcagggcctacttcgctggacagccatgacgggcataaatccttcttccaccaccatgtggcagacttgtttctgcgaagatagctacctgttctctaaacatctgcggcgagctggcggtcaggaagaaccaggacgaggagtcaatcaagaagcgtgatcgactatgactaccgtcctacgatacggcagcggcaaggtaactggcaagatgacccatccgaagggccaa

SEQ ID NO: 21493 - DNA, 311 bp, Zea mays
  Clone ID: cC-zmle18900077e12a1
ccttaaccattttatctggggggttagggttatggttaaaacacaaggtgctcccatttcctgttcctcagcacaataatacgctcatgtatcatcaccaacacttcctatgaccttatatcctgaccatagaatgattcacacacggctcgcctaatcattcacctgaccacaagaacaagcacacttacttgttataaacccataacttcacacgtatcttttgtcccatggccctgtctatcttgctaaagatcctaccgctgcggatcgtcttgcctgatccatactattaactgacttggggattc

SEQ ID NO: 21494 - DNA, 387 bp, Zea mays
  Clone ID: cC-zmle18900077e12d1
gaaccacccgtgcggccaaccgtacctcaacgcgctcggagacaaagagtttcaacttcttggaaccggacgaaagaattgggtgcggggtctcttgcctaaaaacatagagggcacaccctacaagggctatattaagacatgcccgtcatataaatagcaaaactaactgctggtttgccaaagaaaaaaagaatagagaatactagcctatcgaccactttgacctagaaaactcacgaacatgctgtgcctgtaccaccttcaggcatccacttgaaagtcataaatggcttctgaccaccatgaaacattgtctgctaaagagaatgccgctttcttcaaactaggatgccaggttggaaaaaaacttccacaatatatata

SEQ ID NO: 21495 - DNA, 409 bp, Zea mays
  Clone ID: cC-zmle18900077f01a1
ccttctttttttttttttttcctcccctcccctttttttggggtttgggtgttttttttttggggaactaaaaaattacccccacatataccggaacaacatgcttcaccccaaggggaatgcgtaagtgcagcccatgcccattataagttcccaccaatcaccaaccccaaacaaggggtttgaattccctcccagggccaacaaccttatatctaacaaaacccaaaatgtcccgccaaccacaacaaagaaaatgcccttggacaaaaattttttaatgcaacaaccctgatgcccaactttggggggaaaccaagaaccgttcaaaaaaaaacaaccaatatactcggaataaatttggacccagccctgagccgggtcgtgagccccacccaacccgcttggt

SEQ ID NO: 21496 - DNA, 352 bp, Zea mays
  Clone ID: cC-zmle18900077f02a1
aacataatgagcacaggcttgagggtcaggggacaaacttattcatgatttgtcatacttctgggtagtacgcacacacaacacaaccggtccattattaaaccaacactgacacgaacagcagatacttcgacaacctccatatggagagggcaccatacgacgcaggcacattggcagcttaaacgacccatgacttactgaccaccacggagaccgtgcacaaggtggagggtgctctccttttggatgttgtagtctgctatggtgcagccattcttcatctgtttgccggcgaagatcaaacgctgctggtccggggggatgccctccttgtactggatcttcgcct

SEQ ID NO: 21497 - DNA, 244 bp, Zea mays
  Clone ID: cC-zmle18900077f03a1
gaagcttggatccttaaagcggcctcccttcacaatcttttttttttttttaccgacgccgcccaataaggggggttgggttattttttaataaccaaataacccatggacattattttttttcataaaagagcgattttaaatcacaaaataaaattgttaaatagaaaaaaaaaagggtctgggggcataaaatttattaaacgtttttaaaggggaaaaaaaaccaaattaatagtaaaaa

SEQ ID NO: 21498 - DNA, 498 bp, Zea mays
  Clone ID: cC-zmle18900077f04a1
tttttacatgttgaagtcgtctcatttctccctctaggagagaaggcataatattgagcctcaatactccgcggttatcattcgcggtgctctgccgactatcctaagatcgccttcgcttcctaaccatacatactgtctgtagaccagactcttcacattcatgtcaagcggctagtccagtcaaacacagccttctgcatcaagcttgcctagccttcttcgtgaatcgctcacaggacatgttctggaacgaccatatgacttgatcaagggtcacccatagcttgaagccagcgctgatcgcccaccatattttgcctggaacgggtggcctgaacagtcttccacaccctttaacacaggggccaccccacctgtcacatgttcagcatcgcactcatgaaaagagacgacaccgacaggctgatcccctcttctcactgttccgaacaaaccagccaagatggcacgacagtcaatcgctaattgctggcc

SEQ ID NO: 21499 - DNA, 303 bp, Zea mays
  Clone ID: cC-zmle18900077f04d1
tttttctgcttgcgggacttccatggcccgcaccctgctttctccctgtttaccaatttctcttgccacatcataacgagaccactgtccatccacaaagcgccaaccatacatctatctgtgggttgtcctctgcacatcacaattctgaaggcgccgatacaccattatgcccggaatcgccaatcgcatacaatgtcctcgttgttcttctaacacgtgctacaaaaaccctttagaagctaccagttcacttccagacaacacttcactgccttcctgactatatcgtttactcagacc

SEQ ID NO: 21500 - DNA, 376 bp, Zea mays
  Clone ID: cC-zmle18900077f05a1
tcctctagagggccgccctttctttttcccccttttttttttttttttttttccccttttttttttttttgtttttgttttttttttaatttaccttttctcccaattcccatcatttaacactttttttcacccaccttcaccaccctctacaaaaacaacccttccccaaaaacaaactacaccccttaaccccccacaaaaaaaaaaaaaccacccaaaaaaacaaattctccaaccccaaaaaaaacaccaccttaaaccccaacaacaaaaaaatcactctataaaaaaaccaaaaccaaaaccctaacaacataattaaaataccccccaaaaaaaaaccccctatctcaaaaaacttataccaaaaatc

SEQ ID NO: 21501 - DNA, 410 bp, Zea mays
  Clone ID: cC-zmle18900077f05d1
aaccacccgtgcgcttctctgcgcctaattactgtgaccagatgggcattttgggttcatttattcgcttcacagctccaggaatgaagccagatattgttactttctcagccgtgccacatcctgatgtgaagccgatggcatatgcaaataacttcctcaggatgtttcaatgacagaatataacaacattgtttagcaatttttatcagatgagtctgttgtttgtcagctcccaattcacatttcttgctaggtttaagtatatgctcccttgtacaacaaatcaaatgatgcaagggattcaactgtcgatttacttggatggtacatccatttttgtgcacgagttgtgattcttgtaactatccgtaaagtcttagatcattagattttagcttactctgtat

SEQ ID NO: 21502 - DNA, 345 bp, Zea mays
  Clone ID: cC-zmle18900077f06a1
ctcctccaaaaattaacaaaataaccccaaattccccaccctcctcttttcaaaaaaaccataaaacaacattttttttcccccgcccaaaaaaaaaaacgccccccatcccctcccctggaaccctcccaaattgctttttgggaagcttcattttttaaaccacaaaaaaaaacccttttcaaaacaaggaagtacattattctatcttattctcaaaaaaactccaacccccaacccaaacattatacctttttacaactaaaaccccttcttaaccccttacaaaatacttctctacaaataaaacccccaccaaacccgtgggtaaccccaaaaattccg

SEQ ID NO: 21503 - DNA, 436 bp, Zea mays
  unsure at all n locations
  Clone ID: cC-zmle18900077f06d1
aaaacccgggcggatggcagtttaaactgagagcanataccgacattttttgattttgcgcccaagccggagagcagagggaccgggtgggctcttggttggagttttctccataatacaatagaataatgtacctacttcatctgagaaacatccttttctcttgtttataatattaacttcccaaaaccgtactggaggatcaccagtgagaggattcggtgccttctcttatttggcgcgtaagataaatgttgtctcatggctttcatgagaagatgaaactgactcatcttggtatatatttacatatattgtatataaaaaaacacttttaattttgggtgtgggggggatattatcttactttcctattaatacacattctttgggcggccgttctataagatccatgcttcctttcccctgcattcaa

SEQ ID NO: 21504 - DNA, 467 bp, Zea mays
  Clone ID: cC-zmle18900077f07a1
ggccatgcaatatagtcaaattttgggcatgggatgaaaaattccaacaaaactcaggcactggtaacttcgattgtacctaggaatgttcataaaatttgacagaaattgtcttagacttaaagcatgacaaagtttctaagcaaaactccgctgtgataacttccatagttccacgtccacgtccacccccacctcaaataaatatgagaaaatctaggcagagaatggcttcagcagcaaagataacacagtcctggacaccaatccttcttaagcggacgggatctccacctcgccgtcgtcaatctcctgctgcaggtccttggggtccttgccgtcgacggtgcacccgacgctgacgcaggtaccgaggatctccttgacggtgccggccaattccttggccatggacctgtgcctcatggtcctggcgatctcgacccacgcgttcgcggactcgttgg

SEQ ID NO: 21505 - DNA, 378 bp, Zea mays
  Clone ID: cC-zmle18900077f07d1
acagggccatggccaaggaggaggccgtttccgtttaggagatcctcggtccctgcctcatcttctggtgcaccgtctacggcaaagaccccaaggacctgcatcatgagattgacgacggcgaggtggagatcccgtccgcttaagaaggattggtgttcaggactgtgttatctttgctgctgaagccattctctgcctacattatctcatatctatttgaggtgggggtggacgtggacgtggaactatggaagttatcacagcggagttttgcttaaaaacttcgtgatgctttaaatttgatacaattcctgtcacaatttatgaacatccctatgttcaatttgaatttaccagtgccttgagcttcgttga

SEQ ID NO: 21506 - DNA, 514 bp, Zea mays
  Clone ID: cC-zmle18900077f08a1
ggcaaaaaggatccttggggttggtgtgtaacgacattttttttcccttctacaaagaactatttagctagttcttgtgagcttcctccgctacatctatttaccctactgtctgaaggggaaaccagaaagaatcacacgtttttacaggtgcagcaaggccacaaaaactgcagttcctaaaaccctcgctgtgtagccgccaacgtctaagggtagctgcagggcacctgaacggttacatccacctttcctttcgctttcagatagagaaagtcacaaagcagggggtccttggagaacggtgaccctattcaccgccacttggtgtgcaaaaagaagcagtccttctccatatggtccatccatctaccaataaagtcccaaattctgcctaaactgaaacatgctggcagtggatctaccatccttttggctcctccttcaaatcgatgcttccaagaacttgatccattgtaatgcccggaagcacgaagctagcaagatttttatt

SEQ ID NO: 21507 - DNA, 499 bp, Zea mays
  unsure at all n locations
  Clone ID: cC-zmle18900077f08d1
aacccggactatattattgtatcggatcttgccgggntcttttttaattttcaccaaacgcgnccaggttggagaaaaatggtttgttaccattagctaactgacctctctcatcttgtactgtggcatttcttaagttgtctgggagctgaatctccaaggctggaagatccaacatctgttctcgaaaatttactgtacctgcagatggcagacgatcctaacatgaattttggggcattctcccattcactctgcaaccagcatgtagtttcatttcatacaagcgtagccactagctgctcatgaggcatgccaacatacctggattgttccactgggatggatgccatcgttgggattctaacctcaccttcattggttgttttcactggttcatccaacatgccagcatattccgggcaaagccttacatatggagggccactgtctgtggattggacacacttcgagcttgaaattcttatagatggcatgg

SEQ ID NO: 21508 - DNA, 376 bp, Zea mays
  Clone ID: cC-zmle18900077f09a1
tttttttttttttttttttttttttttttttttttttttggtttttgttttttttgtttttttttttttctttttttttatcatattttttattattatactctttttttttttaatttttttataattatcctttctttttcggacaaaaaaaaaaaaaaaaagaacaacacccctccctttcttttttctttgaacagggtaggtttgtgccatcttttatgccatcttttttcatctcacgcaaaaaaaaaactgcgtgataccccccccccttttttactaaaaaaaaaaacattatttgtatagcccacaaaaaaaaaaaaatttgtatggtattaaaacctccttgtgaaaaaaaaacttgtccacctcg

SEQ ID NO: 21509 - DNA, 564 bp, Zea mays
  Clone ID: cC-zmle18900077f09d1
gggcgaaccacccgtgcgcccacgcgtccgaacatcctcaacaagaagatctacttctacttttcatacccatactttgtgtcctggatccatgtagtagtgggtgtcgtatactgcctcatcagctggagtgtcggtctccccaagcgagcgcctatcaatggcacgctcctcaagcttctctttccagtcgccctgtgccatggtattggtcacatcactagcaatgtgtccttcgctgctgttgcagtctcatttgctcacactatcaaagctctggagcccttcttcagcgcagcggctactcagtttatccttggacagcaagttcccttctctctgtggctttctcttgcccctgtggtcattggtgtttcaatggcatcccttactgagctttcattcaactggactggcttcatcaatgccatgatatcaaacatctcattcacttacaggagcatttattccaagaaagctatgactgacatggatagcaccaacgtgtatgcttacatctcaataatcgctctaattgtttgcattccacctgcattgaatctt

SEQ ID NO: 21510 - DNA, 499 bp, Zea mays
  Clone ID: cC-zmle18900077f10a1
ggaatctatatgcaatgattagggcattaaacagccaagggagcacaaaacatagacattgcagttcagaagcatggaacaatccatagaagaccggaccatgctcccaaaccatccggctacaaaacttagtacagcaaggttacaaacaaaagtatcacagcttgatgattttgagaaatgggacttgtcgctgcaccgcagcaccttacgccttgagcttgccaaagaacctctgcttctcatcggtagtctggaagcgaccgtgcccaaatttggacgatgtgtcgatgaacttgagcttgatctcctccagcgccagccgggaagtctgcttcaggagggactggcggagggtcaccaccctcttctttggacccacacagcagcccttgatcatcaggtagtcacccttcacgataccataatgggggaagccacccatgggagtgatgtccttctcagtcctgtcaaactctgtggaggcatcgtgggtctc

SEQ ID NO: 21511 - DNA, 518 bp, Zea mays
  Clone ID: cC-zmle189002a11d1
cgccgtgggaacgggtgcctcgacgcgcatctgtccagcagagttttgctttcgccgccgccactgcgctggatgggagcgggaggtacaggatcgccgtcggggtcgcaagaggactgtgctacctgcaccagagctgccgggagtgcatcattccactgcgacatcaaaccggagaacatcctcctcgacgcgtccttcgcgcccaagatcgcggactttgggatggcggcgttcgtcggccgagacttcagccgggtcctgaccacgttcagagggacagcagggtacctcgccccggagtggctgagcggggtccccatcacgcccaaggtggacgtctacagcttcggcatggtggacctggagatcgtgtccgggcagaggaacacaccgccgcatgctctcagcatgagcggatactaccacgctgcggcgtattttcccgggccggccatcacaaagcttcacgagggagacctgcagggcttggtggacccgcgcctacagggagaacc

SEQ ID NO: 21512 - DNA, 446 bp, Zea mays
  Clone ID: cC-zmle189002a12d1
acaacgaggccggcactttttactttacgatgggcaacagaaaaggcggggccgggaaacgcctatattctaccttctcaagtacccagccacccagggatacctatcgtatcccctaaacgaatgaattcgtccgtacgttttgctgcagaccatcaatttctttctaccttggtttagcggatgaagaagggggtgaacgaaataggtggtacaagaaggagagctagaggaggagcccagacctacagggatgatgacgatcacagaccacaataagaaggggaaacacatccacaggaacaaatgaaaagagaaagattcgaaggatatgcattcctaggagaagacaatcattaataaaagaacaaggaccgctggtcttcacaagaaatattccaagggatgacttatctttgtaaagtaacaatcgagtttcgttaccc

SEQ ID NO: 21513 - DNA, 604 bp, Zea mays
  Clone ID: cC-zmle189002b10d1
ctattctggacggggaacaaattcgatttaagacttttatttctagttctagagtatcgagaactttttggggcttgggatcaagcttcttccatgtcttgcgtgcacatcacctagaatttgtcgaagatatggagatctatgttaaccatgtggtatgcatgtccagagaagtgctagaaaatctgaaatctctccagaatttgaaaatatatggcatacatagggccaacacttgctctgtgattacaaaattgtgggatgagaatgggtcagctgtgtttccttcatcacttaggagccttcagttagtgcagtgctacctgaaaccatcctatttctccaagcagttgaataacctctcatcacttgagactttgcacctattaaattgtgacaccattgggatgccctgtccaccagtaaacatgtggcacttgaggatactaaaacagttggtcctttataaatgtgattggatcacctttttggaggggtcagaagcattggtttccctggaagaaatggccataattgacttgtaccacttgaaatatgtaccagatttaaacaatatgccatctcttgagaaattgcatttgag

SEQ ID NO: 21514 - DNA, 563 bp, Zea mays
  Clone ID: cC-zmle189002b11d1
cgccacgcgtccgtccatgcatcctaccaccgtaccaccacgcgttcggtattttgtccaagccaccaaccaaacgggagcgggggtagttaaatacactttgaccgacgaattattcataatcactccacgagaggatcatctttagaagctagagaagcagatctcctaccaaacaggccaggacgatactcaaattcccagatcaggaactggatgactgtaagagaaggagagacagatggataacggtggcgctaaaggccaccatctccgacgatgccaacgagcagtttgcctggaacacagcctgaggaggaaggcaaggcaaatgcctgcactgggtgccccaagcaggagatttgcaccaccacccccaaggggcctgatcccgaggaggttgccatcgttgagaggctggctactgagaaacacaaactgccgctttgtccggaaagggacgtgtaggaaaaaacacatctcagcccaacgctggttgccatcgggaaatggactatctgacggccttgtagacataaatctgggggccctaactcctaaaa

SEQ ID NO: 21515 - DNA, 558 bp, Zea mays
  unsure at all n locations
  Clone ID: cC-zmle18900077f10d1
accacccgtncgattgctgacatggtggactatggctacaaattctttttaaatttgtccctgttgatgctgtcttcgggaaggaggagatgattgacatcattggtgtgaccaaggggaaaggttatgagggtgtggtcactcgttggggtgtcacccggcttccccgtaagacccacaggggtctccgcaaagttgcttgtatcggtgcatggcatccggctagggtctcctatacggttgcccgtgctggtcaaaatgggtaccaccaccgcactgagatgaacaagatggtttacaagatcggcatggctggacaagagacccactatgcctccacagagtttgacaggactgataaggacatcactcccatgggtggcttcccccattatggtatcgtgaagggtgactacctgatgatcaagggctgctgtgtgggtccaaagaagatggtggtgaccctccgccagtccctcctgaagcagacttcccggctggcgctggaggaaatcaagctcaagttcattgacacatcgtccaaatttggcacggtcg

SEQ ID NO: 21516 - DNA, 238 bp, Zea mays
  Clone ID: cC-zmle18900077f11a1
ccttaatgtttacccgtccacatcaaaatatatcacagtccaatttcaggttcacttaatggccttaacctccctgacccacacattaatacatgataacaggcttcagcaacagcaacatggcaactaccattgccaataacaatgcaccaaccactcatcacaggggaggggagaacctgctctgcccacacctgatctgccccccgatggcggttccactgatcaaaccctgccc

SEQ ID NO: 21517 - DNA, 527 bp, Zea mays
  Clone ID: cC-zmle18900077f11d1
ccgagcgcccacgcgttcgcccacgcacccgaggacaatgattttcaattttttgaaagcgcaggaaagcgctgagtgtggggctcttgcctaaaaacagagaggggacacaacaagagggctatattaggtcatgctcgacatataagtcctaaaatatgtctgacgttgacaaaaagaaaaaaacaatacagaataagagcctatcgcccactttgacctacaaaaggccgaagcatgtgttgcctgtaccagatgtcaggctccattttcaactcatcaatggctttctgattaccatggaaattggtcctgcttggtgaaattccagcattccataaaccggttggcagctttgaatatgcatgccacaatattataaacgtactctgtgtcgtatataaaatatctatttaatgccacggtctgattaatttgcactgaggatctccctctgttttctgacctaggccttctaacatcttggacttatgcagctttcatctttgctttaatgtacatgtctt

SEQ ID NO: 21518 - DNA, 339 bp, Zea mays
  Clone ID: cC-zmle18900077f12a1
tttctattttctctatgagcctggagatggatcaaggcgtcgggcgttgtttcattttgtgatgaatgggagagagggtatgggacaagattgatcaacccgtcgtgcttacgtctcgttaattatgagagctaccgctcggatttggtgatttgtaatatatgaaccagtgatgaataaatgcattcacttgtacacaattacactttgtaaagatattatggttcaaaaatttcatcttgaaaacctgttgagaccatccaatgtttcctgtttgtgtctatgttctcgtgttcagggaatattatatatctgaaccacactgggtttctcctttct

SEQ ID NO: 21519 - DNA, 140 bp, Zea mays
  Clone ID: cC-zmle18900077g01a1
cctctctttttttttttttcccaaaatagcaaaccaccaaaggaaaagggaatgatatactacgggataccggcacagtaaataacaaaggacaacaatacattgggatttactctccccatatatagatgaactttgac

SEQ ID NO: 21520 - DNA, 354 bp, Zea mays
  Clone ID: cC-zmle18900077g02a1
ttttgtttttgacagaaatcgctaaaaaggaggggacagggtaccacattagcgatctgcatcgctgtgtatttacagttttataactggctgttgaggactggagggtacatgctagcgcctgaataataggcattcaggtatatggttgcctcaacagtgcgctgagccgctagacccaaataggcaaaaatttagagctgtgcaaaattgggcacgagtatataggtctgtagtagcccagcagcagcatggccaactaagctcggtactcgtcaccacaatccccaataatatcgatcaaaggtgtgcccctcttcgacacttcagtgatgatgttcatgtcctcttcat

SEQ ID NO: 21521 - DNA, 280 bp, Zea mays
  Clone ID: cC-zmle18900077g03a1
tttttgtttttttttttttttttctctttttggggcttgggtttttttttttttgaaacaaacaaaacaccccccaatgttttaaactgaaaaaaccaccgagccctctaataatgcaagaggttcatgaacggatgttgaaatgattgaaacaaaatgagcccaattccccatgaaaatttaatttccctgcagtttggacatatctagggtcgacaagacaggggaagatctcctccattcccataaaacccttgttgctaactgcttcaccactttc

SEQ ID NO: 21522 - DNA, 509 bp, Zea mays
  Clone ID: cC-zmle18900077g04a1
atactaataggttaattacatggggtacgtgtatctgtcaaaatacaaatgagaacagtaacccattagtttcaaatattaccatcagatatgctttttccccttgcgttttaccgttttaaaatacgctctacaacctataatcatattaccaccctcaaaatgtttctacctcttcacccttttgaaagcgaaaggatattcaaatcataaatggtaccgaggaccaaaaaatttacagagggcaaggtcaccaggttcccacttaatctgtcacgtagaagaggatttccataaacccttgcaaaagttgagggcggagcctgaagtaaaggtccatataacagaagcaagtataaccagtagagatatgaacatcagcctgccacctctggtaacctgaatactaggggtgcctggttcttcccctgttgcttgctgtgacctgaagctagagatgtgctgaagtgttctgttgataaaagtgttttcttcacctgcagtttgct

SEQ ID NO: 21523 - DNA, 558 bp, Zea mays
  Clone ID: cC-zmle18900077g04d1
ccgtccgagatgcttcttcgtttctacctgggtcatttgacacttttgtttttggagctgaaaatcaatatttggataccgggaacagtggaattcataaccagggatatcaaaatacaaccgaagtaaggacatataatcaggctgctcttactgtgcggagccatatgaagcatgatcatgtagtcttatcctcgcatgcatcaggcactctgaatatccatgcggcaaatgagctacataaccagagctccacatcttcacaatcatggttcaatgcggctctatcagccttgttggactctgtacctagtagtccagcattagctgctgaaatcgaaaacactgttatcaacagaacactccagcgcatctctagcttccgaccacagcaaactgcaggtgaagaaaacacttttatcaacagaacacttcagcacatctctagcttcaagtcacagcaagcaacaggggaagaaccaggcacccctagtattcaggttaccagaagtggcaggctgatgttcatatctctactgggtatacttgcttctgtta

SEQ ID NO: 21524 - DNA, 374 bp, Zea mays
  Clone ID: cC-zmle18900077g05a1
cctctttttttttttttttttttttttcccttcttcattttttctttggcccttgttttttattaaaaataaaaaataacccccatccccaaaaaaaacacccttaaaaaaacccaaaacaaaacatggttaaaaaaaatcctctccgtatataactcaatcatggttaaacaatcactcacaaacgccatacttaattaaattttcctcttacctaaacaaccccccttataaaaaaaaccctctctaaccacaatcctaacattccccaaacctatcaccaaccaaaaccattcacaacatctcacacttcacacaattttaaacctctcacaaaaaaacaaaccttaccatcctcaaaccccaagcgtaaa

SEQ ID NO: 21525 - DNA, 351 bp, Zea mays
  Clone ID: cC-zmle18900077g05d1
accacccgggcgcccacgcgtccgatttaaatttttaaaaaatgtctattttactttttaatagaagagattgtgattggggatctggaataattcgtttggaaattgttataaaaccgtgagaaaatgcttctttttatgtacgtagatgaaaaaaaaagaaactttaatacagcattgctctatttatttaataatatccaaaattattaataatacttacaaaaattttttaaaccaagtctaaatttaacaatattcaaaagtgtactttatgaaaattgtgataataataaataacaaataaatattttaataatgagaaaataaaattactattaatccaaaaat

SEQ ID NO: 21526 - DNA, 173 bp, Zea mays
  Clone ID: cC-zmle18900077g06a1
gggttattgtctccttttcatttaaggaaacaacaacaatttacttgcttaaaacagtcaaaccaacccgatcaaatactatacatccaagaggttccaccaaactggcttctccattgttttctgactccccgcttcgacacaaaacacccaaaatttctccccccggacac

SEQ ID NO: 21527 - DNA, 372 bp, Zea mays
  Clone ID: cC-zmle18900077g06d1
gtccacgcgttctaatcaccacgcacatcgacatcctttacaatttctcccagctcctgatcgagaaggggaccagagacggtgaggagttcatgagcttgttcattgacggccaggccgagctgtttgtcgcttgagatgtcacaaggcttgcggtgcgtatgcttttcggtgttttgtgtcagagcgagcaatcacaaagcaatggagagcccagcttgttggaaccacatcgatgtatagtagttgatacgcatgtactgactaatttgagcaagtaaaatgttactgctctcaataaattatataattaaaataaacaactttctaaagaaaggtggtgcaacactcttatttcataaaatatattgg

SEQ ID NO: 21528 - DNA, 478 bp, Zea mays
  Clone ID: cC-zmle18900077g07a1
ttttgtagcaatttttcatgtgcttattattataagttgggaacgggccataatcagagtccttatgaatccaccagtacaaaactgccccacgaagagtaaaaaaacatatctattccgacgcaaactacagtaggtcaaccagtaaataccactggctgagtacttagaacattgttgtgggtgattcaggttttattcacgaaagctgcgatactatcctcatttcagttgagtaactgcagcgtgtatggcatctgcaagatggggcacagtcctcatgctcaaaccggccatgctgatcctcccatcagatgtcatataaatgtggtattcctgcctcatgaatgcgacttgttcgctattcagcccagtgaaagtaaacatcccaatttgcttaatgatatggctccaatcaccaagggttcctctggatttcagcgcattaaatagttgttgcctcatgttaatgatccta

SEQ ID NO: 21529 - DNA, 523 bp, Zea mays
  Clone ID: cC-zmle18900077g07d1
ccgggcgagctttgagcattgtatgtaaaagagccgatgtatcttttatttttgaaagtcaactcaaacttgtgagtgaggcggatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccataggaacccctggtgattggagccatatcattaagcaaattgggatgtttactttcactgggctgaatagcgaacaagtcgcattcatgaggcaggaataccacatttatatgacatctgatgggaggatcagcatggccggcttgagcatgaggactgtgccccatcttgcaaatgccatacacgctgcagttactcaactgaaatgaggatagtatcgcagctttcgtgaataaaacctgaattcacccacaacaatgttctaagtactcaggcagtggtatttac

SEQ ID NO: 21530 - DNA, 513 bp, Zea mays
  Clone ID: cC-zmle18900077g08a1
ttttcagagtattatgccttgcacatttcaacaatttcggtactgggtgtacacatattacaatactgcttttttgcatctctattcgctcatggtggataatctgtatctagttacccttccacatctcagatttatcactctacatacatacacgatagcatacatacactgtcaactgaaaactcagaactaatttaattgatatacatgtacagaactcttgcttcacctattggctaatttgatctgtttgacactctggacgagtaacagcgccgccacccaccggcgatggagctcatcattatcttgccaggcttctgcggtgcgagaaccaaggcgggttcttcgtgtctgccctggcattcttggccgctttccttggcccggggcagtagaaaaatgatctggggcacctctcacccgtttcacttggagctcttctttccccaccattcttttcgcgatttatcatcatgggtgccggtgccaaccttattaggtttacct

SEQ ID NO: 21531 - DNA, 560 bp, Zea mays
  Clone ID: cC-zmle18900077g08d1
gggcgaaccacccgtgcgatctcaagacccacttagtgtttcagttgctgttttttaacagtttaacattccccctgaaatgtatcgagttgggtacacataattgtttttccgtacaggacaggttgctgcactggaaaatactaaaatacagatgcttcacggaaccctccgtattcagaaacacttccggggtatgcattctcgtcagggatatcaacgactcaagaaagtggcaatgaatttgcaatcatttatacgtggtgaaagagcaagaatacactttgataatcttgtcaagagatggagggcagctgttctaatacagaagtacactaagcgtcgacttgcagctaacatgtttaatgatcaactgaatcatatcattcttcttcagtctgtgatgcgtgggtgcctggctagaaggaaatacaagtgcctgcagaatgaaaaggagttaaaggccagtcacaacatagttcaaggggaaacatggaagaataatgctgactcaagaatatgcccatggatgaatgggcattatcctcatgaaccagtca

SEQ ID NO: 21532 - DNA, 416 bp, Zea mays
  Clone ID: cC-zmle18900077g09a1
cttgggccaaccaagcacgggatagggagcttccacatgcccaaaatacagtgagttttcttgtgccaatcaagcacggcatagttaacttccacatgcccaaaatactgcgacttgcaacatgaaccgaacaagacagtcatatgtagttgatggaaacgcataaaaatccaaccacaccatatttattagcatatggatggatggattgattggcagaacaaaaggggctgcttagtcaccgtgacataggcaactctagatgtcgcggctgcgagcgagctcgaggatatcctcatcactggtgaatgcaaaaggagtggtgggggtcacaagcacggccctggccagagggtcgacttcggggctggggctggggctgggctgctggagctcggcgtcggagtcctgagctt

SEQ ID NO: 21533 - DNA, 521 bp, Zea mays
  Clone ID: cC-zmle18900077g09d1
gccttctccggctccctcccctcccttggggagtccttttcggttctcgtttcccctccctcggagactgcgattgggaagcgggtcacttgaaagccgcggaagggggtctgcacgaggaaggtgagaggagccaagctcaggactccgacgccgagctccagcagcccagccccagccccagccccgaagtcgaccctctggccagggccgtgctcgtgacccccaccactccttctgcattcaccagtgatgaggatatcctcgagctcgctcgcagccgcgacatctagagttgcctatgtcacggtgactaagcagccccttctgttctgccaatcaatccatccatccatatgctaataaatatggtgtgggtggatttttatgcgtttccatcaactacatatgactgtcttgttcggttcatgttgcaagtcgcagcattttgggcatgtggaaagttactatgccgtgcttgattggcacaagaaaactcactgtattttgggcatgtggaa

SEQ ID NO: 21534 - DNA, 285 bp, Zea mays
  Clone ID: cC-zmle18900077g10a1
aaaaaaaacccccccaacaaaaatattctttttattttcccccccttaattaataatccccccccccccccctttttttcaccccctttttcaaacccccaaataaaaaaagcctaaaaaacaaatttttttcccatccccttttcccaaaaaaaacaaggaaaaacatttttatcacacccccaaattgggaaccccccccccctcaatccccaaaaaggcccacccaaaaaaaaaacccctcccaaactttctttttttctgcccccccactcaatataaaac

SEQ ID NO: 21535 - DNA, 519 bp, Zea mays
  unsure at all n locations
  Clone ID: cC-zmle18900077g10d1
gtccggacaagatcgagagcgttgncatttttatttttttcaaagtccataggggggcaggggagctggaggtcttgaagaatagcaagtgccccaggaacccgtcatcattgttggtgtgcaccgaggtgtttgagctcggtccatcattatatgtcgtagagcttaagaaatcccacggagactctacgttgtatagacagctgtgcgaaaggctctccgatgagctaggtgcctgcatgacagaccacatcgcgaggactgaatcatcgagtgacgacctctcgagcctcgatggcgaatcgttccctctatctgggttctgatcatattgctttccctgtgttgttttgggaacaggggatgaggaacatgctcgttcctgatgcacttctagattaggatcatgaatatagtgtacaaagccatcggcggggggggtgcaaattatccaccgggttgaatataaatatatatatatgatatgttgcatcttcttctatttaaaacttttttttt

SEQ ID NO: 21536 - DNA, 464 bp, Zea mays
  Clone ID: cC-zmle18900077g11a1
gacttacatccatattgactcagggccacaggctttaaaaggtgaggtgggaacaaggtcactacacccagaagtgtctgtatcttgtacatcatataagacatcttgtagagtaaaacagcgcatccaccagactattttccctgaccgcacagcacagggacgactctttgtacctaagttacaattacatatagcttacaacatgtggacgttgtctttcgccattgccacccgttggcagagaatggcatggacatcttgaatctttgttctcaaattctctgcagaatatttttgtggacgtacaaattattgttggtctcgtagggacttgaccttcatatagttcacagtatggtacatgagcaacgagtggttttgggcaacttgttcgccttcttatctggttttgatttggctgatgatggttgaacaacaacgtgcatcgtgatagcactact

SEQ ID NO: 21537 - DNA, 424 bp, Zea mays
  Clone ID: cC-zmle18900077g11d1
aagacaattttctcggaaccttccgggctcctctttttcttttttcgtgcccccaccaaaccctagggggagcgcgcagcccctacccgcttccgctcgcgccggcctttggggctctcaccctgagcggtaggaatccgcagggctccggttgggtgccagaagcatccaagtcgttggcgggagaccgggaaatggcggaaaaagagggggcgaaggttggggcggaagagatggaagagcgggagcaggaaggggaggcggaggacgtggaggtgaagtttcgtctcttcgacggctccgacatcggccccgtgcgcttgaactccggcaccaccaccgtctccgctctaaagatcgcgtcgtcgccgactggcccaaagattaacaaattattcccataaactgctagtgatgtaaaact

SEQ ID NO: 21538 - DNA, 484 bp, Zea mays
  Clone ID: cC-zmle18900077g12a1
acccaaaccaaacacccgctatatggttcaggtgaactggtaacaacaaaaggagaaaaccgtagagttcgcgtgtttttaccgttccactgaatctatacatacattggtcatatatagcaacgcagcacttggttacctaggattcacttacacatggctgcaacaatcatatcgcaaatatatgaaatcaaaagaaaggagatggttataaaccaaaccatactcgtatgatcagaacgcacacgacgatgcactagtcaaagctcaactgaaatgagcaatgtcaatctcgtcaggaatcttaaatgtatctgccgccccaaacttcctcctgccgtcctcccactcgtcttcgtcctcctcagcgatatcattgtaatcaccatgactgtcgtgcgccggcgacagtgacgactggtcgttgacgctcttggacctgcacggctcatttgctagcatggtgacctgcccaggtgagaga

SEQ ID NO: 21539 - DNA, 383 bp, Zea mays
  Clone ID: cC-zmle18900077h02a1
aaaaaggggatgcggtttcattgttttaaattaaaaaaaaaggataatccacaaaacccaacacacattggaaaagaaaacgaaaatccaaaaaacactttccactgatatatctaaaatagactaaaagcttccaacttgatcattcaccagttacagaaacacaaccaccagtttatagtattaataacacagtcctccatcgccactagcctaagctatcggtctcggatactgaatgaccagtgtacccgagcctttccgatttcaaatttacagcatcgggcccccctttttggccgctttacttcttggccttacgggacggcgctttccgtaccggggtcgcctcctttttttagggagcggcctttttggcaggg

SEQ ID NO: 21540 - DNA, 482 bp, Zea mays
  Clone ID: cC-zmle18900077h03a1
gccgtttagctaccagggaaccaatcccgtacccgtggtactagcatgttgagccctggtgactgtgactctatgtgctgacagaaaatatttctgaagatgttgtctgttgtgtcagccacctgtaatatctctgtactcaccatttcatgcctgtaaatatgggttatggtggtaggacatatgcttgtttttttggttctgttcttcgcattgtagtgagacttttccctgcttgttaggtccttctcatcccctagtgtgaaggccatgcctccactagtatggctgcactaggaaataccattcctagttacatgaatgggtggcaatatgctggcaattgtgttttaacattagtgccattagctatttcaatgttacagcagggcgtgtttgtgtttgagatattagtatttggtggatttttgtgcttcttattatggatctgggacatttgaaggagaaacattgttttaaaa

SEQ ID NO: 21541 - DNA, 470 bp, Zea mays
  Clone ID: cC-zmle18900077h04a1
ggcaacaacacaggccagtccgggggcaagggttctatggtagagtaacatttacagttcttcctaaacctgtacatatattacagacagttgtgtcaagtttgagaaacacactgcttgttctgtttagctcttcatcacatcatggcatcgcatccatgtacttcctgcagtggtcctcagatgtctccattgattccaaatatgcggaccttgtgcatgtttggcaattttgccacaactagcacaaaaactgccattgtattgaggaaaaacatcggctgcttgtagtcagtcaagtgcgatgcgatcagatacagcaccacaggtaccacagtcaaaaactttctgttccgagtaagctgctgaccattgtcaatttgctcccaccatgtcaatctgctgtagatgccttggtcatcagcagcaaaaggggttcctttcttccaatggaagacgtggtaagtgat

SEQ ID NO: 21542 - DNA, 565 bp, Zea mays
  Clone ID: cC-zmle18900077h04d1
gaaccacccgtgcgtggactcgtgggctcccagcaccgcagcacgacactttcgcgttttggccatcctcccgttcacgtgggcctagggcacgctccaccgcggaaagtaaccccgacatccagcgccgtcggcacgaccaggcctgtccagggatggggcggagaggggagccctactacgtctaagcggcgccgccggtggacgtgaacaagaacacagagtggttcatgtacccgggcgtctggaccacctacatcctcctgctcttcttcgcttggctcctcgtcctctccgtctctggttgctcccccggagcagcctgtacggtcgtaaacctcgcgcacttcgccatcacttaccacttcttccattggaagaaaggaaccccttttgctgctgatgaccaaggcatctacagcagattgacatggtgggagcaaattgacaatggtcagcagcttactcggaacagaaagtctttgactgtggtacctgtggtgctgtatctgatcgcatcgcacttgactgactacatgcagccgatgttttttctcaatacaat

SEQ ID NO: 21543 - DNA, 459 bp, Zea mays
  Clone ID: cC-zmle18900077h05a1
gggcaaatggggggcttggggctgatttgtctcaacaaaatactactgctgcacaagttggggctcactgaaatcaccatcccttggcacaagtgttggaaagcatcacaatcaggatatggcgtccaaagtcccatcacaggagagaaggaatccacaaggaaatgacgcgttaaaatctagccgtcctgcaaacctcctggataaagtttggaccttatttaggaagagaagcaccctggacgagccgcgtggtatcaattcttgccgctctcctccgctttaatctttttctcccacctacgttttttgtagtcgaaccacatttggggcatcttcttcatcagctcaacagtatttgctcgcttcttgggggaaatgctgatcgacttgtggcccttgcgcttggtacgcatctccccggggtgaggattgtagctccagtccttgccggggagg

SEQ ID NO: 21544 - DNA, 540 bp, Zea mays
  Clone ID: cC-zmle18900077h05d1
aaaacccgtgcgctgggagctcggcgcgtggaagccgctcggcatcattttctcgtttgcgcgcccgcctcctcaaggaggggctcggggccggcgaggactggagctacgatcctccccgcggggagatgcgtaccaagcgcaagggccacaagtgcgaccgcatctccgccgagaagcgagcaaatactgttgagctgatgaagaagatgccccagatgctgctcgactacaagaaacgtaggtgggagaagaagatgaaagcggaggagagcggcaagaattgataccacgcggctcgtccagggtgcttctcttcctaaataaggtccaaactttatccaggaggtttgcaggacggctagattctgacgcgtcatttccttgtggattccttctctcctgtgatgcgactttggacgcactatcctgattgtgatgctttccaacacttgtgccactggatcgtgatttcagtgagccccaacttctgcagcactagtactttgttgagacaaatcagctttaagcatgccatct

SEQ ID NO: 21545 - DNA, 385 bp, Zea mays
  Clone ID: cC-zmle18900077h06a1
gggtatgtacacgggggcatggttatacatgattgcatgtatgtaggaatacagccatggttacattacatggcgaggagcggacatcttcttcctccttgtcaactagaagaaaaacgaacgctggccgaccgcccgaactgggtgctgatttatatctacaatacaggggcacccagagcagagcagcagcaacgaacaagagacccgtgctagtagagcttacattttacaggctacagcacaaacacaaaacctattacccttgctgacaaaaccccgtaaacaaaaaatcacttttcactccctttgcccgcttgttgttggggtggattcggcaaccataaccctttagtacgactggaggactcttctttacttcact

SEQ ID NO: 21546 - DNA, 409 bp, Zea mays
  unsure at all n locations
  Clone ID: cC-zmle18900077h06d1
ggagggaggcgatccagtcgtatgagtgaagnaaagtttagttttttagtcgnactataggttgatgggggccgagaccacacctcacagcagccggtcaaagggagtgaaaactgattttttgtttacggggttttgtcagcaaggttattaggttttgtgttcgtgctgtagcctgtaagatgtaagctactactatcacgggtctcttgttcgttgctgctgctctgctctgggtgcccctgtattgtagatataaatcagcacccagttcgggcggtcggccagcgttcgtttttcttctacttgacgaggaggaataagatgtccgctcctcgccatgtaatgttaccatggctgtactcctacatacattgcaatcatgtataaagatgaaaacgtgtacata

SEQ ID NO: 21547 - DNA, 219 bp, Zea mays
  Clone ID: cC-zmle18900077h07a1
atgctgtgtaagttgattcatagggggacggagagaatttcaatacagtgaacacaacaattctaccttgccgatagaaccctgttaccgttagtaactcacatcaaagtacacactcggaaccaacgcgccctcacccaaatcctatcacttatatacccacccttgcgtccgcttatctgattgtctttcaccccctcacttactagtcacaaccct

SEQ ID NO: 21548 - DNA, 291 bp, Zea mays
  Clone ID: cC-zmle18900077h07d1
acccgggcgagctagcttgcgcgctgacagaacaacagcaaccattttaattttcaggcgggcaaacaagacacagggggggagaggcgtcagctgcaactggatgtaccgcgtaaacgaagatcaaatggtacagatggtgatattgcgtgacccacgatacaaaggctagacaatagatcttgcctccgtccatagaagactaagaggagcacaatgagaaggaactcaaaaacggacgacttggggcggcctccatataagagccaatcttacataccatcgcctccg

SEQ ID NO: 21549 - DNA, 77 bp, Zea mays
  Clone ID: cC-zmle18900077h08a1
gttccctgtcattaattaaattaatatttttcccctctaccctccttcattatatacaatacctcccaacaatccta

SEQ ID NO: 21550 - DNA, 253 bp, Zea mays
  Clone ID: cC-zmle18900077h08d1
gatcgggctcatcaaggatcgagcatgccattttctttttgtattttaaaccatcaacacaataaacaggcctatgttgatgataactgtcaaaaggaacattaaatccaatgttctacctggcatgattgctggactgtattggatgatgctgagataaaaagagagaaaaagtgaaacaaactggattcaaattcatttttttcaaaaaaaaaaaaaaaaaataaaaaaaaaaaaaaaaaaaaaaaaataa

SEQ ID NO: 21551 - DNA, 454 bp, Zea mays
  Clone ID: cC-zmle18900077h09a1
cttcttccaatacttagacaagtatattagtgcacaaggccaatttactaatacttagaaacatacctttgctcttgatttgcactttattcatccatggcataaattcacatttaagcacttgagttggcactcaatcaccaaaatacttagaaatggcccaaggacacatttagctttcacctcttgcatcaacacgcattccaaaccagtgtaacaagcatcacaatacaccgagaagggcttgtgcacatcaggcaagactaaaacaggcgctgtagtcaacttctctttcatcgcttcgaaggcctcttgacatttctgggtccacttgaactcaactttattgcctaacaacgctgtcattggtttctcaatctttgaaaacccttcaatgaatcgtcgataatatccggccattccaatgaagctcttgattcctcgaacatctgtt

SEQ ID NO: 21552 - DNA, 389 bp, Zea mays
  Clone ID: cC-zmle18900077h10a1
aggaaagccatacggggcactggattgattatcaaacatgttacatcgtttaccagtctgaagaataacaccagagggttcatcgaccccaaatacagtttcctttcaagagagagctactctgctagttcatgtgccacctgtgcgtttgtaaattggacacagcattctgggagcagtgcacggcatcctcgtgaaaaatgagaagaaaaaaaaaggatatttcttcactgcctccgtctcctttcatctccggtatacgtatagctggacaagacacacatctatacagatcgcatcactggtaaacttgcacagagtaaatgattacacgtccagctttttatgcggctacagctagagggctttggctggtctttattcctttg

SEQ ID NO: 21553 - DNA, 574 bp, Zea mays
  unsure at all n locations
  Clone ID: cC-zmle18900077h10d1
cacccgtgcgccagtggctgctagccgagacaggggatagattgagttaggcttttcagatggcgacgccgtcgtcggggctttggggcagcttctcctccctgcggaccgcctccatcggccacccccgtggcatcgcctcctccacgcccaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcgactggattcatgttgatgtcatggatgggcgctttgtgccaaacatcacaattggacccttggttgttgatgctctgcgtccagtgactgatcttccgttggatgtacatctgatgattgtggaacctgagcagcgagtccctgactttatcaaggcaggtgctgatattgttagtgtccactgtgaacagacatcgaccatccattngcaccgaacagtcaatcagaataaaagtctaggagcaaaggcaggagctgttttgattcaacgactccctcactg

SEQ ID NO: 21554 - DNA, 503 bp, Zea mays
  Clone ID: cC-zmle18900077h11a1
aatgtaagattataacgctattagcggtctggggaacccgttaacaatgacattacaaaatggtacgtcgttacatagtatagcgtgccaggctattttccgtactttaacaaacatttatatccctatataacaactacgtatagagcacagcgccaaaactgtatcaagtcatataccatacaaacgtgtcacttcaacaagttttgagcacttaagaaaggccaccagctgactcggtggacccttcctggtccccgaagatacgtttgcggaagtcagtgaccatgcggggaaggccctcacggaggggaaccttgggctcccagccgaggagctctttcgcgcggctgatgtcaggcttgcgcttgtgcggatcatctgcggtgttcggacggaactcgatgtgcgcctctgggtcgatggtgtcctggaccaccttagccagctccagcatgctgcattcttcaggttgccgaggttgaacggccccatgtgctccc

SEQ ID NO: 21555 - DNA, 530 bp, Zea mays
  unsure at all n locations
  Clone ID: cC-zmle18900077h11d1
acccgggcggaagctcatggaaggggagcacattgggccgntcattttcggtttccctggagaattcagcatgctggggctgggggaggtggtccaggacaccatcgacccataggcgcacatcgagttccgtccgaacaccgcatatgatccgcacaagcgcaagcctgacatcatccgcgcgaaagagctcctcggctgggagcccaaggttcccctccgtgagggccttccccgcatggtcactgacttccgcatacgtatcttcggggaccaggaagggtccaccgagtcagctggtggcctttcttaagtgctcaaaacttgttgaagtgacacgttcgtatggtatatgacttgatacacttttggcgctgtgctctatacgtagttgttatatagggatataaatgttcgctaaagtacggaaaatagccttgcacgctttactatgttacgacgttccactttgtaatgtcattggtaacgggttatccaaaatgctaatagcgttttaatcttactttcat

SEQ ID NO: 21556 - DNA, 556 bp, Zea mays
  Clone ID: cC-zmle18900077h12a1
gagaagggcaaacaccattgccctttcattattgacggagttgaaaaaagaagaagtatctcatcctcgctggattccaggctacaacgaaacactacacagttttacctaccccttggtcttggagcaactaccaacatttcagctaaccagactaaaatctagtgttcactccataaccctcctgttattatttaggaaggctgaacagccgtgtcaatcggtgaactgccatcagcccaccgctgaagttggctccagggccacttaaacttgccaggctctagttggccacaccgtccccatcacaacacgtttccgtggaagtttgatgaaggctcctgctttccgcatccctcctttctccttgagtttacttcagcggcccagctcttaccgatctctgtctggaacttgccggcagtggagagaaagaactcatctagcactttgccatgttctttctcatattccaatgcctgaagaatcatttccacctgaaaaaagatgaaatggcacacacaacacacaaaacacatgataaccaagaataaag

SEQ ID NO: 21557 - DNA, 475 bp, Zea mays; identical to SEQ ID NO: 21474
  Clone ID: cC-zmle18900077h12d1

SEQ ID NO: 21558 - DNA, 478 bp, Zea mays
  Clone ID: cC-zmle18900078a01a1
agtcttcaaattttattaacaggagaggatgcatctggcatgcgggtaaccatgtctaaatttacaccgacgaccaccaccatgtttacattcagatcattaacaggagaggaggtgcatctagagcgagaggccaccggactcctcgtcctcgtcgaggtcagaggtgtagatggtgtaaagggaccagatgaggccgaagacccccaggaggatccaccccagcaggttgttgctgagcccgaggctcagcccggtgccctccgtggacatgcgctcgtccacgagcgccagcgcgggccccgccgacgcggtcaccgcgcccgctgcggcgagcagcgacgcgcctgcgcccttggtgctgactggggccgcgttcttggcatccttggcgtagctgcaccgcaccctttcgctcctcgccctcaacgcaagcagccctgcggacagcgatcgaatgagcacatatgcgtgcata

SEQ ID NO: 21559 - DNA, 619 bp, Zea mays
  unsure at all n locations
  Clone ID: cC-zmle18900078a01d1
agggccgncgaatccactccgccccccgcctcgcagagccttctttttttttctccgcgcccggcaggcgacgncgcgtgggagatccatgattcaaacaaaccactacattaccaccatggttcttgattcattatcattcaccttacaggaggtcccaaaacacattcttcgtgtcatctgcaaaaaagcctcagtcatctcgtgacgacagttggtctgcactggttgagcgacaccggtttctcctgacgacactccttgttcttgccttcctgtgcactgtctatctgtactttgcagtaaccttgggggcatcagatgcttgcactggattgacaggagcagagaggattgagtgccatgcaagatcagtgctgcaacatggaaagttgaaattccgatgaccttggagactcattgatgaagaccaaattattgagttttatatgcacttcggtcacatgacaaaatcttgataccatgtatttgtatatgggggggtggctgaagttattggaccacataatttgctggactggtaaaggcaaatttaatatttacggttgagcttggggaaaccgggtatactggggaaggcccaaattgttcttttact

SEQ ID NO: 21560 - DNA, 395 bp, Zea mays
  Clone ID: cC-zmle18900078a02a1
attatcatcatgcaggggttagttgtaataccacacatcataatgtctctcctcttactgcattattacagatatagatagagagggatgggattgaggatcattcccaaatatcatgaatcactagtagggcggaatggcagcggataccccacacgaggtggtgctgtagctggccacctggtactggtagagtccacccatggccggcatgttctgggccatcatcatggccatggccttgagaccctgacctgccaacagctgctgctgctgatgcatcaaagctgtctcgtacaggctgttgctggcggcagcttcacgctcaagctgcatcatcatatgcagttgttgtgcgacggactgcacgtccatcatactcatctgttgctggc

SEQ ID NO: 21561 - DNA, 503 bp, Zea mays
  Clone ID: cC-zmle18900078a02d1
atttccatgtcacaggactagagtgacacttaaaaaatctgttgttttgttggatttggtgccaccactaagggggggtaacaacctgatatttgggcgtacttgcgttgattctcctggagagatggttatgacaaaacctgacaaccggagacaaagctgtgttatatttccagccatgtggctggttcggggctggccggtatgaggtatatgggtatgtgtacagtgcagcggaagaacccaaaataatgattacagggaaatggaacaagtcactgagctgccaaccatgtgaccaagaaggcgaccctctttcaggcacggatctgaaggagatctggagagtcttccctgccccacagaacgacgggtatcagtacacacactttgcgcacaaaataaacagctttaacacggtacctaagaagctgttggcatctgatttccggctgaagcccgatagatatgccctcgagaagggcaaatgttcaagtctggtt

SEQ ID NO: 21562 - DNA, 308 bp, Zea mays
  Clone ID: cC-zmle18900078a03a1
acctatccaaccttaaattgaaaacaatgaccagaacgaaccaggtcaaaattgtgacagttgtgatacttcataacagatgagtgatattctatgacacatataaaagacattcatataacatatggtaatttatccagagtaccagtaacaaagacaagtaaccaagttcagccaggaaaggcaagatggatgttcttgacaaaccacataacaaattgatgttcttgaccattatccgcagtgattaaagaaggcaagactccattgccaacttcaaggccccgaactaactaaatttttaaggc

SEQ ID NO: 21563 - DNA, 356 bp, Zea mays
  Clone ID: cC-zmle18900078a03d1
cccacgcgtccgcccacgcgtccgcggacgcgtgggcgaaaattttctttttgtacattgacatcgggaagcgcggggggggcactctggtcaccggagggaagccctgcggcgacaagggctactacatcgagcccaccatcttcacggacgtcaaggacgacatgacgatcgcacaggatgaaatctttgggccggtgatggctctcatgaaattcaagaccgtggaggaggtgatccagaaagcgaacaacacccggtacggcctggccgccggcatcgtgaccaagaacatcgacgtcgccaacaccgtgtcgcggtccatccgcaccggcgccatctggatcaactgctac

SEQ ID NO: 21564 - DNA, 455 bp, Zea mays
  Clone ID: cC-zmle18900078a04a1
ttttctcttttttttttttttttttggaatatgaagcatttggtcataacaatataacacacatttcgtatataagttatcgcagtatattggtattatatatttccgttgcaacgcacgggcattcagctagttaaacatatatgatcatatatagatgtctacatggggagacggctagggtgaagcaaattaaacatatatgatcatatatagatggcacgtcggccatgtctacatatggatcagtcatcagtccctgccgtcgaagccgaactttccatctaaaaaggggccggcggcatggaacaccgggccgaaaaacccgttgcctttcttcgtcctcttgtcgccgtcgttgctgttatcgttgatggacacacaaggcatgccgtacacctgcaccgcctgggtattgatgtacaacggcgacctggcgccgtcctggggagccc

SEQ ID NO: 21565 - DNA, 231 bp, Zea mays
  Clone ID: cC-zmle18900078a04d1
gtccgcgcactcatagcttgctccaggacatacgtacgtacatacatctttcttttcatcgctagctagctgacaaccggggggggcttcttatctgtcgccatcaccgccccttccttcacggacgtgcccgctcgtgcaatggtcatcacgaggtccttcaacgtgcgtgcctctctccgcaaggccactgccaccgcccacgtggtcgttgacgacagcgttctgctt

SEQ ID NO: 21566 - DNA, 404 bp, Zea mays
  Clone ID: cC-zmle18900078a05a1
ctccccccccaccttttttttttttttaaaacaaacaactcaacccggaaaggggtaaatataaaaaaacaaaccccccccccccccaacacaaacgagaggcaaacccaaaaacaaacaactctttccttaaaaacaacttaaaaaaaaaccccacaggagaaacaacaacaaaaagccccgaccacaatggtgaaaaagaccgcacgatctcaaaccagaaatgaaaccaacacaaccaccaaccccaaggcccccctcaaaaaaaaaaaaaaaaggggaaaaaaaaaaaacaaacccaaaaaaaaaaaaccccctaaaccaggaaaaaaacaaaggggacaaaaaaaaaaaaatggggacacggacccaacctaaaaaaaccaaaaaactccaaggaaaaa

SEQ ID NO: 21567 - DNA, 378 bp, Zea mays
  Clone ID: cC-zmle18900078a06a1
ctattatctttttttaccaacccacactaactcggggggtgggttattttaaaaatttttcccccccccccctctaatttattataattaaacataaataaaaaaaataaaaaaacaaacagaagaccaaccaaaaaaaaaaaaacaccaaccacaaaaaaaaaaaaattttccaaaaaaaaaaataaaaaaaaatctaccaaaaaaaaaaaaaaaactctcacagtaaaaaaaaaaaaattccctaaaaaaaaaaaaaaaaaaaaaaacctacaaaaaaaaataaaaactcgggggaccccaaaaaatactaaaaaacaaaaaaattcccgaaaaaaaaataccctcctaaaaaaaaaaaaaaacctcccacccaat

SEQ ID NO: 21568 - DNA, 374 bp, Zea mays
  Clone ID: cC-zmle18900078a06d1
accccccccctgcaccccgtggcgtgccacatatcaccacaagctttttcatttttgccaaccgcaacctgaacttgggtgtgggttacattatatcttcgcataagaccaccatctacataactatctactttgggctcttttctctaattattatatctataatattgttcatgactctgtcaattacaattttgatgatgattaacacaagaagaacgtggatgccaataacttgctggaaaactactactacaacatgcgcatcactatcaaggactaaaagatttcgtccaatctgacggtctatgacatttaaaaatatttattactccatttacgcggccatcaactgtctgtactctaaccatttc

SEQ ID NO: 21569 - DNA, 490 bp, Zea mays
  unsure at all n locations
  Clone ID: cC-zmle18900078a10a1
ttttctatcgtttatggangatgtattgaagaacggggttgtgaaccatggagcagtttggaagttttacatgactggaaaaaaaaagggagatgggattgtagcttttatgagcactgctactagtaatgttcacatagcatggctctgtaataatactgttgatcaccacatccaccagcagcaggcaatccggttgccaacgaggaggcagcctcagacaagcacctgagctgcagctagcctagcaatcggaaccctgaaaggggagcaagaaacgtaatccagcccagccttcgcgaagaaggccacagacgaaggctctccaccgtgttctccacaaatgcccaccttcaagttaggcctagctttgcggcccctctctgtagcaaactttaccagctcgcccactcccctctggtccaggacctcgaaggggtcatgttggaggatgccctgagcaagatagacgggaatgaacttttccaca

SEQ ID NO: 21570 - DNA, 485 bp, Zea mays
  Clone ID: cC-zmle18900078a11a1
ttttgtaaacttaagggcagaaaccagaagcaaaggggagggtatcatgatagtaataggatcagatatcacttgtgaaattcacaacggtaaacaagtagaaatcttagcacccaacctttagagatcctagagcataacccaaaaatgctggagtactgtctcggctacacagccaatatagtggaccccagtatgcctgacaagcgaccgatcatgcttcagtctgctccctcaagcgacggatcgtgctcctgacagtgaccgcactagcagtgttcatggtgtaagcaccaccggccttgaccttcccacagtccttgcatccccaaatcccaaccgctttcctcttcacagcaaacttcccacagaactcacagaaatacttggagtgctgagatacctccatcttcttgatttgcttacgcaagctagcaccatacctggttccatatttgccaacaattccggccttcttggttcgc

SEQ ID NO: 21571 - DNA, 474 bp, Zea mays
  Clone ID: cC-zmle18900078a12a1
ttttctctttttttacggggacaatgattaagagggggcgggagccggtcactgcactcacttgcacttgcacagcaaacaagcgccacatgtggttcgcgagtgctcatgcaagagctcacactcggcgggaattacgcgaacatgttgcgtccaggtgaactggaaggcatcgatgcgtatgtattcttgatgcaagtcgtacatgcaatcaagaaatagcaactgtctagagccaaagccaaggattgaaggtttttcttgacctgcccaacgggccatggctcaagcccgtgcaggggccggggcccggacggcggcttctgctggaggcagtgacaccgagcgcagcagctccagggagctcgccaccccaaggaaatgccacaggatggtgttcgctgaagcctgaactaggaaaacatctaaagccaagacagggctttggccagcagcctgataatagggtactgc

SEQ ID NO: 21572 - DNA, 407 bp, Zea mays
  Clone ID: cC-zmle18900078b01a1
cttgaccatttcatttttttcatttacccaataagggggaggcgcagccaaacgtacatctatgacccaagcaaaaacaaaaaaacatcgcagtcgttattcattgttccccgagcaatacaccggagaccgtagtgataaattttaggacaacggaatctaaatttcaaaaccaaagcgacaccacggcggatgctttgtgcagaaaaaaaacagtgggctccctcgagaatgcacatgcttcatcagtttccattccacaggatggtggtctcggcgatcatgccggtgacgacgtaagggtccatgttggacgccggcctgcggtcctcaaagtagcccttgccctccctctcggtgtcgcggccgactcggatggatgcgccgcggttcgccacgccccattt

SEQ ID NO: 21573 - DNA, 436 bp, Zea mays
  Clone ID: cC-zmle18900078b02a1
actgaaagcttaactgaaccattcggaaaatacaattctacagcttgtacaaaatttgcctgtcactactagcaccagtcacgattgaaaacacacaaaaaacccatgtatggcaccccggatgaaacctaatcaatcaggagtttgaggtgttgtagactgtcgttgatttatctggggcatacaaaattacaggcttgcaactaaactaactcctgtcacttttcttcttctttcttttatgttttggtttgatagcatcttttagactcttcggcgatccaatttcatgggactcagactctccagcagccacagcacttgatgtgttcacctcagcattagatgattcagtcattggttgggcatcctcacggctgctggccttgaccatagttggtggatccggcaaatcagaaattttgagggatcttaa

SEQ ID NO: 21574 - DNA, 372 bp, Zea mays
  Clone ID: cC-zmle18900078b03a1
tttttacagttatagttttttcattcattgccaaaaatcatcggttaaaggtaaagtctaaacttgagatggtcccataccaacgtactagactgactgcacaatcggcaggcggcagcttttcctttctacacacacagcacagtactctgcaattcatccacaccatggatcatgctctgctacacattcccaactgagcctgctacagaccaaactctagtagttgcaggcttcgcagtttgctatactgtgcggacaaccacctttattctatagaattcacaagctctggagcttcctgtttccagctgcaaacagagagaccagagtgtgggccaaatctttttgagggggtgttcattctaattt

SEQ ID NO: 21575 - DNA, 503 bp, Zea mays
  Clone ID: cC-zmle18900078b04a1
gtgagctcggatcctctagagccctcgccctttttttttttaatgttacatagacgcgaataaataatgcgtcaggttatacaatcatattcgaggcccaaaagtggcgcaccccaagtagcatcacaacagtgcatttcgtgtaactaaatcataatcgtcttgcataactgatacaatacagtacaaagcttaagcatcgtcaatacagaaacatgcatgggaacgtcccgaataagctatgaaataacagaacgcggccgattatcgcccatgttctgccaaatgggaaccgagcttcaaaaataaggtcttcgcgggcggcggaatctggggaatctcccataaccataaggactataaccatacggcctcatgtaggggtggccatggtacggattgaaacctcgaccgcggggttgcttcattccaggaacgttagtcctcttcggtgccaccttgagttggcgaccgtgcaactctgactcgttcaacttgatagc

SEQ ID NO: 21576 - DNA, 460 bp, Zea mays
  Clone ID: cC-zmle18900078b05a1
tcttttttttttttttctcttctccttttttttgggccacggttttttttttttttttttccccccctttccctttttttttttttttttaaaaaaaaaaaaaaaattttttcccccccccccaaaaaaaaaaagtccaaaagtgcctggggccctaaaacaaaccccccaaaaaaaaggttaaaaaaccccttccccggctttttcccaagtcccaaaaacccccccccccccctttcttaaaaccttcctttggaggggctttaacccctttcccctttaaaaagaaaaaaaacctttggaaaaaccccccagggggaaaaaaaaacccccccccaaccccttaaaaaaacccccctggggagccctccctaaaaaaaaaaaaccctttggacccccccccgtggttggccggcccccttttttcctttttttccaaaaaaaattttttgtttggttt

SEQ ID NO: 21577 - DNA, 621 bp, Zea mays
  Clone ID: cC-zmle18900078b06d1
gtccggagccatgtctgaggagaagcaccaccaccacctgttccacctttgcttggcagaggaggaggaaggcgcctggggcggggtcgactacgagaagaaggagaagcaccacaagcacatggagcagctcggccagctcggcgccatcgccgccggcgcgtacgctctgcacgagaagcacaaggccaagaaggacccggagaacgagcacggccaccgggtcaaggaggaggtggccgccgtcgccgccgtgggctccgccgggttcgccttccacgagcatcacgagaagaaggacgccaagaagcacgcccacaactgatccgtcgcaggctgcctcagccgaagcagcagcacatcgtcgcggttgctgtttcatctgttctcccagcctcgtcttcgtctactgtgtgccgggcaggccttgatttgaggctttgagctaccgatatttgcacggacgtaggaactgtgttggtcctcggcgttcttgtttcaagatcaaaacaggccttcaataagtgggtgtgtgtgcatatatcttttttttaaaatttatctctctttttttggttcgagagatgttctgataatgtgaatttacgtgtgttatataaa

SEQ ID NO: 21578 - DNA, 364 bp, Zea mays
  Clone ID: cC-zmle18900078b07a1
aaaagggaagggcggttttagtatatatatagtatcaaatcatatcatcggggaccaattaatatatggttacagcagatgcaatcggatcaaccaacatgcaggtagacacacgtacgtacatgagcacaaagactgacgccaaacatgcagagagagatagcaaactgaaaaactctgtttttttttttttcacacacaccacacaatacctatgtatggcagccagctcggcctcgcttattattgttcaaccaccaccacaagctagatagataataatcatatccatgggcggcgatcgatgtgatcagcaattgcaggggtcgcacttgcagttgccaccgcaactgcagccgtgggc

SEQ ID NO: 21579 - DNA, 439 bp, Zea mays
  Clone ID: cC-zmle18900078b08a1
aaaacagactcgagcctcattagggggggcaagagttggacaacaagaggccacactaacagctgtcatgaaccctgagacttttaacctacatcaatccttgtaagccgttcttatcaatttaggttcccaaaagcacatggaaaacagataaaatatcatgggaaactatcacaaacccaattcaaataacccaacaacgatcagactcaatcaaccaaactagtttgtcaaccagtatatatagatataacacgcacacaaaaacaacaatctaacgctgaaaatgttaatgttccatttcgacatcatcatccgtcaccgtgaagcaatgcagagcaccaagaacaagtttttctgtgccactccagcagattatttgccctcggaaacaaaaccaagcgaagcctcacctcaactcgcctcctctcgggcgagc

SEQ ID NO: 21580 - DNA, 456 bp, Zea mays
  Clone ID: cC-zmle18900078b09a1
caaaagtgtttcagcatttgggggtggggttttttaatttacaggacttacactacaacattgcgcatacatacctcatttaggattaataataactaatctatggcatcgaggcataacttacactacaaagccaccatcccttgagggataacaactgacgtgcacaagaaactaagcacagtacgtacgggcttaaagaattgcagaaactgcatctcgctgagagctccaaaggcaggaagtcaaacatgacatcaccctgtctttcaacttgccgagcccacataatcgcccataagagactgccatcgcctcttgaatgagctgaaaggagcactttcaccctctgaatagcttagtgctgctctcttcgttggaatcgtattcttaataagccctttatccttccttgcctgacacacttgctcaaaatattcttgatttgccttttca

SEQ ID NO: 21581 - DNA, 562 bp, Zea mays
  Clone ID: cC-zmle18900078b10a1
gtcagcttcgcctcggtttccatttggcttggcaggaggcttgtgggggggggggatgaggagtccccggcagagccggcgccgacggcggaaggggagggcgccgtggccaccaagcccaaggccgagaagccgccgccgatcgggcccaagagaggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgccttggacgagatcctcgaggtgaaatgagtgaggccagtctgctcaaggaccccatgctcctgtgtgatttgtagttgtgaagtgaggctgctgcctagctgctacgttagctgctagcgtcacaacatcaatcttgtaatagcttaatctccacaatcatcatgtaatttattgcatgcttcattcaccgtggactcaataatctctcttgctctaaatcgatgtattcgtttttcttgtgattttgtacatg

SEQ ID NO: 21582 - DNA, 443 bp, Zea mays
  Clone ID: cC-zmle18900078b11a1
ctttttctcttttttttcccaccccatcctttaaagggacttgttttttttttttaaaggaaaagacccaccccgttaaccccattcctccaggtgaaaaaaaacaaaacatgtttgttcacaaaacagcaacaaaacatgtccaggagcaaatgatctttgaacccctcaaaccctacgaaggatctggcgcttccattcccgaacagtaaaaaatgggaaaaaaaaaaacctttgctttgaccacatccacagggaaaaattcccattacgggaaactggcttacattactgtgccggggcgccctgggcttaaaataaaatccccgggaaaagtcccttgctaatgggccggacaccatttcatttttttttcccaggataaaacccaacagctcgtctattttaacaaaaacagcatcccctggggcatttccttgccc

SEQ ID NO: 21583 - DNA, 408 bp, Zea mays
  Clone ID: cC-zmle18900078b12a1
accttttctgttttttttcctctatacttcatactgtgggcggggttttttttttttaaaatgaaaacacccccaccaactttattattatatgtattattacaaggcacaagggcccatacatgcagggaaccaggggcaatatacatgaacaccctttggcccgctcctgctttatcaatgcaaacggtggcatgcatgcaaaaaaccccttgggagaaaaaacccctggaattctggtaggacctatgcatgcatgggcaccatcgatgggcgcgaagggtatattaccccgggggtcaaaaaaaaggctggatcttccaacggtgggtggcgccctcgccccacttccaaaagaccaaggcggggcccacacggacgccgccgtgccacttgaagccggggggg

SEQ ID NO: 21584 - DNA, 473 bp, Zea mays
  Clone ID: cC-zmle18900078c01a1
tttttagatttgagaatttagtcttgatatcacattacgtactgggggagcgtagtgtggcgccatagctagatgcaataaaccttaaagtcctctgaactcgaaaatcctaacccaaaagagcaaatagagcgcagccttctcaaccatcaaacatgacaccattgaaaccaaagatgacactgctcacgcttcaacagcgacccttccagccacttggtccacatcacgccttccctggttggtgatgaggcgtccacccttgggatcgacatcgatgatgcccataatctgcagctgctgcaggatgttgcgtgcaacagcaccactgctcttgcagaagtgtggtgggcgggagccattcctctggcggccaccgtagatcttctgaaagccacccacaccgatgccttgccttaggtagatcttccttgcaatggatgcagccctgatgtattaccagtcaggatcat

SEQ ID NO: 21585 - DNA, 282 bp, Zea mays
  Clone ID: cC-zmle18900078c01d1
ggacgcatactcatactatgctcatccattgatacaagcattctctatctaacttccccgatagagctataagggggcgctcatatttactcaacgctcgaactcaaacaacatgaccacatcaaaaagaagatatataattgctcccttgatatacataactaaatgcataatcttatgtgtacaaatgtacacttatttatattattaacggtaactttttgtatatggcattgttcaaaacttttatttatgatataccacaaaaaaattcactattat

SEQ ID NO: 21586 - DNA, 315 bp, Zea mays
  unsure at all n locations
  Clone ID: cC-zmle18900078c02a1
gcgggccccttccccccccccaaagcccttttgatttttaacacgcagcngctcataanacaggaaaccgttgtactcaacatccagaccgaccccgacttttgacttgggaccaaaataaagcccgtacgtaccacgtcctacacaagcagcaacactcactgccagagtcacgcgatccaccttaatagagcacacggaccttgaccaggccatccaccttgaaacaaacttttggtaaaagcaaaccagaacccaacacacatgccaacgctagctagcttctaatcgccgcccacggccaggacacgctgt

SEQ ID NO: 21587 - DNA, 365 bp, Zea mays
  unsure at all n locations
  Clone ID: cC-zmle18900078c03a1
ttttgacgaatttattctattttctatatnccgagcacagaancgcgactgctacataactttgaccagtaccaaacaatcccctgcaaatgcatggctacaacggaatctcaacacctcgctgcgaatgccatcatactcttctctctttttcgctgtaccataacaattgactagtacacaatttaaccaataaatccttgcagacaaagaagcgggaaaaaaaaagaaactaagaacatcgcattattcgttcgctgtgaactgaataactccatctccagaagacaaaagtgcatagctataaactctggaaggagcaaagccatggctcctaaaagaggagctgatggtcacaagaaagt

SEQ ID NO: 21588 - DNA, 508 bp, Zea mays
  Clone ID: cC-zmle18900078c04a1
cttcgaaacgcacattaccacattaggggctgggtattttcagtgcatcaaacttgtcacacaaacttggcacgcaacaaatgccaaacagagcattatttgcccctataccacattatttcacatcacattgaccggttcacaaccacggtacattagaaaacagggcacgaaggcagaaactcaaacaaatgccacataagttcaggcagacttaactctggtgtaacacacagagcgctaaattatgactcttcagccagagccaacagataatactcaaacaaaactctggtttccatggaagcaggcaaggcatccaagctcaactgcttaagcctcgtacatccagggatgaaggttgctctttcactgtgccacaccttcagggaaccagagagcgatctccttcttcccgttctccacggagtcggttccatggatgacattcctgccgactttcacggcgcagtcccacgaatggtaccgggggctgccttccaggcct

SEQ ID NO: 21589 - DNA, 66 bp, Zea mays
  Clone ID: cC-zmle18900078c04d1
ccacgcgaacaaaagaacaggcccaaaccaacaacaacaaactttatttaaaacacgaacaaaccc

SEQ ID NO: 21590 - DNA, 395 bp, Zea mays
  unsure at all n locations
  Clone ID: cC-zmle18900078c05a1
gagccactagagcggccgccagccgcagacgagcgttttcactaacagccacccgccgccaccgggggcaggggccagcaagacggacaccaccaccccnacccaacgcgggacaaggacaccaccgacgcgcagcgcgcaaaaccgaagccccgagggcaacacgaccgaaagccccggccccacggactgaacgagggcccgcgcccgcacaacctggaagcgagacaggagctgcaccgaacacgacgccgacggacaggaagccggcccacgccaggcccgcaccaatgccggaccgccacggaaacgacgaggcaaaccagacagcggaaaccgcgacgaccgcgagcaagagccccggcgccgacggccaccgaaggggcagcacacgc

SEQ ID NO: 21591 - DNA, 306 bp, Zea mays
  Clone ID: cC-zmle18900078c05d1
acgcgtgcgacagacaccaccacacacacccaccccaaatttaatttatcccctacccacccacaacgaagggaccggcgacaaccaaggagaagagaaagtcagccccaaagccaccgccaaaaaagcggatggacaaagctcgacaacggaacatcctgcccaatctgcaaccacggcagcagagcagagcgccgaatagacatgaaaaaactgattggccaagcatcacgaataaacaggcaagaaaacttcaccacaactgtaaaagccactactgagccaagtgacatatagagcgaacgg

SEQ ID NO: 21592 - DNA, 320 bp, Zea mays
  Clone ID: cC-zmle18900078c07a1
gatcctctagagcggccgcccaccccgcaacaccattttagtttacagccacagcacgggcaccaggggcaggggagcgcgaaaaaaacgagcacaccaccaaccactggaacgaaaagaacgtgaacccgcaaagaacacgcacacaaaccgaaaagggccaccaaggaaaccaccacacggggacccaagtgatcgggacgaaaccaaaacaacgccacaagtaacgaaggcacacgcagggccagacggaacgtgaaaaccccaaccaacaacgaccgcaggcccgccagccgcaaacccacacacaagggaaagaa

SEQ ID NO: 21593 - DNA, 342 bp, Zea mays
  unsure at all n locations
  Clone ID: cC-zmle18900078c07d1
aaaaaaaaaaaaaaaaaaaaaaaaaaaaaaaaaaaaaanaaaaaaaagaaaaaaaaaaaanaaaaaaaaaaaaaaaaaaaaaaaaaaaagnaaaaaaaaagagaaagaaaaaataaaaaaagaaaaaaaaaaaagaaaaaaaaaaaagaaaaaaaaaagagaagggagaaaaaagangagaaaaaatagaaaaaaaagaaggtaaggaaaataaaaaataaaaaaaaaaaaaaaaaaaaaaagagggggggggaggaataaagtaaaaaaatatgaaataaaaaaaaaaaaaaaaaaaggaatataaaaaaagtaaaagaaaataaaaaaattgaaaagaga

SEQ ID NO: 21594 - DNA, 258 bp, Zea mays
  Clone ID: cC-zmle18900078c08a1
attataaacccaactttatttgggggggggggtttattaaatatagagtccacccccaaccattcaaatcaaaaaaaagtgattgagcaaagacaccttgtatgagaggaaaacggctagctgctaaactaaagagtcctgaacaaagagctacttcattaattttatcaaagccggacgtatcttaggcagaaaaagattgggcggacatattattgacaccgaggatatgcaaattgaggaggggcaaggctcaaa

SEQ ID NO: 21595 - DNA, 505 bp, Zea mays
  Clone ID: cC-zmle18900078c09a1
atgcgcattctgtttcataaagggactggcatacacacgtatgagtagagtacttcggaaccccaactgacaatctacctacacagccggggagacgtacaagtaggggtccggtcaactccttcccttcatgattttctattcacaaacagagtttccgttctgtataacccatcgccaagctcaggttaaacatgcattattgatgccaaacagaccatgtaacatttcgtaagggcctcatgcgacaatagggtaggatgcacacgtagcaacaccgcacatgttcttgcccatttccatcttgaagtaaccatcatcaccccagtcagcgccccatgagttcttgatgagccagtaggggacaccatcttcgacaccgtagccaacagccagaacagcgtggttcacatccatcggtgtagttccacaatggtcgctagtgtaaacttcgctcttgtacagcctgaaaccagtgatcacctcgaagcaacactaactgggc

SEQ ID NO: 21596 - DNA, 244 bp, Zea mays
  unsure at all n locations
  Clone ID: cC-zmle18900078c09d1
gaacgaaaaaaaagganaaaaaaaaaaaaagaaaatttcaattaaaaagggaaaaaaaaaaaaaagagggaagggggaatataaaaaaaaggaagaaaaaataaccaataaaaaaaaacaacaagaaagtagaaaaaaacaaagagacaaaagaaaaaaagacaaagaaaggacagaaaacaaagaaacaaaaaaaaaaaacaaagaagggaacaagaaaaaaaaacgacggggaaaagcacaa

SEQ ID NO: 21597 - DNA, 512 bp, Zea mays
  unsure at all n locations
  Clone ID: cC-zmle18900078c10a1
cttgcatcctctagaacggccgccctttcttttcctccctttcttttttttttcccctcaccaaatttttgggttgggtttattttaaattttttttttcccccccccccctccaaatacataatccttccccccccccccatcaccnnggaaaaaaaaaaaaaaaaacgggtttaaaaaaccccccaaaaaaaaaaaacaaaaaaaaaccccaaaaaaaaaaaaaaaacaaaattaaaaaaaaaccaaaaacaaaaaaaaaatttttgggacaaaaaaaaaaaaaagaaaaaaaaaaaaaaaaactcccaaaatgccccaactaaaaaaaaaaaaatctcaaaaaaaaaacccaaatcccaaacaaaaaaaaaaaaaaaacccaaaagtccccccttaattttcctaaaaaaaacaaaaaaaacctccaccaattgaaaaaaaaaaaaaaccccaaaaacaccccaaaattccccaaaaaacaangggccccaacaaaaaagataaccaac

SEQ ID NO: 21598 - DNA, 445 bp, Zea mays
  Clone ID: cC-zmle18900078c11a1
atctccccacatatatttttttaaccccccaaccaacacacggggaaaggggttatttaaaaaaaccctaccctccccacccccacaaaaataatatatttcaaatacaactaaaacaaatacattacccaccaaaaaaaaaaaaataagttaataatatcaacaaaaaacccacaaaaaaaaaccaggggaaaaaaataaaaaaaaaaccaatcaacataaaaaaaaaaccatacacaaaaccaccccaaaaaaaaaaaaacagggcaaaataataaaaaaaaaacctcaaaaaaaacatggaagccgcgtcaacaaccccccaaaatataaaaaaaaaccctttacatacccccccacaaaaaaaaaaaacaacaaataaaaaaaatctctcttttaaaaaaaaacatccaaacagcaccaaaaaaaaattttcacccccccc

SEQ ID NO: 21599 - DNA, 506 bp, Zea mays
  unsure at all n locations
  Clone ID: cC-zmle18900078c12a1
ggatcctctagagcgggcgccctttccctccccccttctcttttttttgccccccccccaaaaaaagggcnggagcaatttcttcaaaggtacagccctatcccactattcacaagtatcactggcagttcgtcaaatttgagcctgctccccatctaatcccccatgttttacggggcaattggaacacttaggaacaaaacgcagcacaaccgaaaagaatagtataagggggggaagggcctacaaggaaatgctaccgccaagctaaccccggagaacctgctctagcacgggcatcgaccaacgagagagccatggccagcatcatctgctcctcgaagctatcaggaacactaacagaatcaatggtggacccagccgaaggggatgaattggcaacaccagcctccactgtaccatcagaatcagcaatactgggcccagcctcgggcacctcggaccactggacattagaattagaatactctggagcctctattgtt

SEQ ID NO: 21600 - DNA, 535 bp, Zea mays
  unsure at all n locations
  Clone ID: cC-zmle18900078d01d1
gcgtncatgagataaagaacttcagcgtccaactgtttacctgtatcaaggtctactgtgtgacttcgtttcgttatattcatgaaaagatgctcaatccctcctccatgaatgatagaggtgtctcatattacctttggtgctgacaaggtttcagaattcttgcaaaagcatgatcttgatcttatctgtcgtgctcaccaggttgtccaggatgggtatgaattttttgctgacagacagcttgtcaccatattctcggccccccattattgaggtgaatttgataatgctggtgcaatgatgactgtccattaaactttgatgtgctcattccagattctgaaacctgctgatagaaaaaacaaatttatggggtccaacaaaatgtgataatgaaagccattttgctttcagcagctctagccccttaaggttctcctgtggatgcctcgtaacaacatcatgctggcgccaagtttgaaggctgccattggcttcctattacaaaaaccaaataattccatacctaact

SEQ ID NO: 21601 - DNA, 503 bp, Zea mays
  Clone ID: cC-zmle18900078d02a1
aacgaaataaaacacaggctaccggagtgggtaatgttcaaaatactacagcatccctttgcttggtatacatgttcatccgtatacagacttctttttccagcttatgttggaagaaccacgatctctaaaatatgcgccgcaataatcaccactacacatctcattcaaaaaccaaaaggagctagccacgcgcaggaatcaaaactaaaaacatgactcaaagaaaagaagcccctcagaaaatgtttctgtatccgcttcctccccctctagcatgttggcgttgtaaaccacaccgctggtcagctagacaaaactaacctgacatatcacccattcacagtgccatgcacgcacctggctgcctgactgaatgggtgcttcatctatcccaagtcatatatgaatgtgtagtaatactcccactatgaagtgatacctctgcttggctgattgttgctaacagaataatttcccatgtaatttgctgatatgtctga

SEQ ID NO: 21602 - DNA, 408 bp, Zea mays
  Clone ID: cC-zmle18900078d02d1
ccacgcgtacacaaaaacagcaccaacacaaaaacacccaattttttttacaaaacgacaaaagagaaaaccgggcgcggggccatacataaaacacacacacccacccccaataacaaaacacaacctcccgcaaacaaaaccatctcgcacaaccaccaccaacacaacaaagcaacacacacaataaccccccacgccacaagcacccgcaacgacactgacgacagaacaaaccgaaacccaaaacaaacacacgcaaactgaaccgcccacacgacacaaaagaacaccaacacagaaaccacaaacacccaataatatccaaccacacaagcgggggcccccaacacaaaaaacaaccaagaagaaaccccaaaaaaaacgccccaccaccaaaacttgaaa

SEQ ID NO: 21603 - DNA, 352 bp, Zea mays
  Clone ID: cC-zmle18900078d03a1
aaacctgtacagcggccgctcgccgtcgccgagtttgtccatgtacgcctccccgccgctgccttccaggcggccgtgtacgttttataccaccatgtcgcccggccacaggacgtctacgacaccgacgcgcatctcgtaataccggatcccgttgggaaacacgaccatctgctcctgctccacatacttggtgttggcctgctgctgcgcgacctccaagcgtgtcttgagctgctccgacacgacgacgacggtcaggaagtcggcccacgccaacccagtaccgattcctgaccgacgagtcaacgacgaggctatccattcagtggagtccccgacgcccgcctgc

SEQ ID NO: 21604 - DNA, 304 bp, Zea mays
  Clone ID: cC-zmle18900078d04a1
cttacagaccgaaacacacacaagggctggggttgaaataatgtacctctccaacccacaccaataaatccaaatgaccatgattacactaaatgtgcattcacaatctcataagctccaaccattaacattatagcaactaactcaataaaagggcactcacctacaataacaccggtcggcacccaaaccctcagctaacgctcagacacgagcataccattactctacacctccgagtccgtacattaaacaagcatgtatacaaataaaaaacatgaaaatcatcgataactccaccaaa

SEQ ID NO: 21605 - DNA, 560 bp, Zea mays
  Clone ID: cC-zmle18900078d04d1
cacctccgcagacctcctcagcccatccaccccttttttttttcaccctgacgacccctaccgggggggggtgactttgtgcgtggataccccttcagcctcagggagggtgctcacaccgccgtctcccacggcctgtggctgaacatccctgactatgatgctcccacacagctggtcaagcccaaggagaggaatgagaggtatgttgatgctgtcatgacaatccccaagggaaccttgttccccatgtgtggcatgaaccttgccttcgacagggatctcattggccctgctatgtactttggtctcatgggtgatggccagcccatcggtcgctactactacatgtgggcaggatggtgtgtgaaggtcatctgcgaccacctgagcctgggagtcaagactggcctgccatacatttggcacagcaaggctagcaacccccttcgtaacttgaagaaagaatacaagggcatcttttggcaggaggacatcattcccttcttccagaacgtgaccatcctcaaagactgcgacaccgtccaaaagtgctacat

SEQ ID NO: 21606 - DNA, 301 bp, Zea mays
  Clone ID: cC-zmle18900078d05a1
gagccacaacttcatctgggaagggggtttatgaacaaagacatgtataaagtacccagcaaattcatggcgactattccaatccatttccacactcaaaagttgcaacaagtccaaggagaaaaagatgatccagacaatgataactcaagagagagtccaccctagaacaacttaaatcgtgcaaggcacaactcctgctcaagtccaagactcatgatcctttctactcaatcacatcatcatcgtcatcaggaaaaggttgtgcagctgctgcagcaagctcagctcggacgcctgg

SEQ ID NO: 21607 - DNA, 195 bp, Zea mays
  Clone ID: cC-zmle18900078d05d1
ggaaaaaaaaaaaaaaaaagagaaaaaaccccaaaaaaacaaaaaaaacaacaagagaaaaccaaaaaaaacgagcaaaacccacaacacaagaacacacccaaaaaggaagaccagccacaaggcaacaacaaaaaggacacaaagaaggaaagaaaaaaacgcaaacagaaaaaaaaaaacaaaaaaaaacga

SEQ ID NO: 21608 - DNA, 388 bp, Zea mays
  Clone ID: cC-zmle18900078d06a1
aacatagaactccattctggggtcgggtaccctaaaaattagcgcccctcaccaaccaaagaaaccaaaaaaacggccaacaccatagtcacctcgtacgttcggataagagctacctgccaaagtacctcataatgatcaacgtgttaagtccttattcctaacaaagcccccctttactcgggcaaacaatgatagagcggacaacgaactgccacaaccatttactaccgaggagcggccctgtgcatacccaccctaacacgaaaaaagggaacttcatggataacttgataatctattcttcaacataaacacccaagctcaaactagagaggaaccctacagtaaatacacccatccgcaggcatgtcctactttactacaa

SEQ ID NO: 21609 - DNA, 464 bp, Zea mays
  Clone ID: cC-zmle18900078d07a1
ttttatattctattaaaaatataactcgattctggggcggattgcgttaaatttagagtccatcaccagccatccaaaccaataaaaggtcgttgactattggcatcttgtatgtttggatggttgctgcctgccaaagttgggcatcgtgaacaacttgctagttcatttttcctgccaaagctggccgtttcttgggcagccaaagattggccggacaacgtattggcacaggcataggcaattgaggaggggcgctgttcaaacgtaccctaccacgaaaaaagggcaccgcatgcacatcttgggagtctattctacaagcaaaagacctatgtacagactatagagcagctgcttctaaactagacctaaccgcatgcaaatgcgacttgaagacagaagccagggcaggcagttttcacagcgaaggacggggatcggaccatgtccatgtccatggc

SEQ ID NO: 21610 - DNA, 365 bp, Zea mays
  Clone ID: cC-zmle18900078d08a1
ataaaaatataacacgatactgggggggggttgcttaaaaaatacagcccctccccaaacactcaaaccaataaaaggacatagacaaatggcaccctggacgtaacgaaaatggctacctgcctaattagggtatggtgaacaaagagctacttcattattcctaacaaaacccgccctttcttgggcagccaatactaggccggaccacatattgacacacacatatgcacttgaggaggggcgcggtgcaaacaaacaccaccacaaaaaaagggcactgcatgcacaacatcctagtctattctacacgcaaaagacctatgtacaaacaatagagcaacctcgtactaacaaaaccgaac

SEQ ID NO: 21611 - DNA, 221 bp, Zea mays
  Clone ID: cC-zmle18900078d10a1
cccgaacgaacacccacaagggggagggatacccataaggactcatacatagagcatccttggaaacccacactcaggactgcgacgcctagccgggcacgaaaacatgacgatcaggcacacggattaaggtcggggacacatcataaacaaactactgtggtctaaaagtccaaattatatgggataccaactccttgtcctcaagatgaacgacggca

SEQ ID NO: 21612 - DNA, 320 bp, Zea mays
  Clone ID: cC-zmle18900078d11a1
ggggagcctctagagcggccgccccccccccccccccatttattttttcaaccaacccacacacacaaagggaaagggtaaaaaaaaatacgggaacgcacccaacccaaggaaaagaaaaaacaggaccacgcacccaaaaaccaacacgaaaacaacaagaaaagacagcagaaaaaaacatgaggacaaaaaaaaaaaaaaaacacgagcacaaacaacggaaaaaaaaacaggaaagaaaaaaaaggaagacaagacaaagacaacccccaacaaaaacagaaaacagcaagccccaagcaccacccacccaaacc

SEQ ID NO: 21613 - DNA, 422 bp, Zea mays
  unsure at all n locations
  Clone ID: cC-zmle18900078d12a1
ctccctcntaaagggaaagttaatttaagactctgatttattgcggtggcctccatttacatccactccacacgataaaataaaggcgtcaccatttgtagcaggagtagtagagaccaaggacaacgagagcccactggtgaccggttgccgccgcggctaggaatctccacacggcacgaccggaacgtgcctgtccctcgaccccatttctcgcccgcttcctccggcccacttgatccctgcccacatgtcctcagtcctcactggccgcacgtctctttttttttgtgtgtgtgtgcgttgtaaaaacaccagccctagaactttatacacgtgctcaaaatctcacttggaggctgcgacaacacttgtacacaaacagcaccgatttctacccacgcgtccgcccacacgttcgg

SEQ ID NO: 21614 - DNA, 570 bp, Zea mays
  Clone ID: cC-zmle18900078e01d1
ccgcactcatcgatctacacacatacatagttccttctacttttcgttgtcaaacatggggaagcctgcgaagggcggggagtggtgtggatacgccggcgatcgtcggcatctgagggctactccggaccggctgattcaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggacatctccgggaccacgggcccagcctacaacattgacaatctggtcaagtctctcaaattcgtcaccaacaaacgcgcttacggaccgtacggcagggacgagggcaccccgttccgtgtaaaggtgatgaacaacggccacgtcgctggcttctttggccgtttggaaattgcctggacgcgatcgggctctacgtgaaccccaactaataactaaaacgatggatcggatcatttgcatgcatgcatatgccgtatgcatgctgcttg

SEQ ID NO: 21615 - DNA, 228 bp, Zea mays
  Clone ID: cC-zmle18900078e02a1
ttctcttttctcttttattccttcattttacctttcggcaaatcgtatttttttaattccccaaaaccccccttccccttactattccaattaacaatctataacacacaaaaaacccctcctaaaccaaccccccatcaaactctaaacaaacatcacttaaacactttatacacatccaaaaataatccctagcatacaaaaatacaaccttccaactaaactaac

SEQ ID NO: 21616 - DNA, 434 bp, Zea mays
  Clone ID: cC-zmle18900078e03a1
ttttatggaatcaaataggacctaaatataaaagggggacggggtgaggtttgtacgtcattgatcaactatcatccatgcacagcaacctagcaatctagcatacagcgtgtattggtcaatatatatgatccaaattaatatgtgctacctgctctgcagatgcatgacctcaatccacatgcatgtacatatatgtgcgcgtggtggagaccacgacgacacattttcaacatgtagataccagcctgtcagtgttcgcttctaaagctttgccgatggcaggccaatttgtttgtcattaactatgcttgggcaggcaggccgtgacgtcaaattctcctgtaagaagggctccacctgattgggagttccccacacaagataccccttgatcttaccaaaaacgttgatagcagacagggttgccattc

SEQ ID NO: 21617 - DNA, 385 bp, Zea mays
  Clone ID: cC-zmle18900078e05a1
acattcccaaggctgaggttttacaacataaaaagaattgccattattacaagacctgatagtacccaaagtgcataacttattacaattattggaagggtgaagcctttccataagatgtatacataaacattctaagcttcaaggccttcacatgaagtaactaaccaaaagataagggaataaaacttctccatagagcagaccaaccctagatcacgcacgcaaccggccccaaacaaggtctgccatgtcgagatcattcccagcggcgttcaccggcggtaccgtggcgttcccaatgagacactgatggccggggagagttaacaccgacgtgaacatgaaccacaacactcacacgatgcactctcgctagaactca

SEQ ID NO: 21618 - DNA, 349 bp, Zea mays
  unsure at all n locations
  Clone ID: cC-zmle18900078e06a1
aaataaaaataaaacccngggaagggattattttttttaaaaaggaggccccactcccacacaaccaaaaaaataaaccgtggataacatattgccaccttgcaggacaggacgcttgctgactaccaaagtgaagcaacctgaacaatttgcccgaaaatcaaaactgccaaaatcggtacggacttggagaaaaaaaagaaacgccgggctacaatatgacacataaacacccaaaacatgaagggcatggcccaaacgaaccccaacaccaaaaaaaggcagggggaacaacattggataggcaaccttaaaagcaacagacgtaacttcaaattttatagcagcg

SEQ ID NO: 21619 - DNA, 292 bp, Zea mays
  Clone ID: cC-zmle18900078e07a1
aaataaaatataactcggggctggattttttttattaaaatttacaccccatccccaaacaaccaaaccaacaaaatgacgataactatagacactcttcatgaaaggataaatgctacctgccaaactacggaatcatgaacaaagagcaactacattattcctgacaaaactggacttaatcttgggcagtcaaagattgacacggacaacaaacttgacacaggccatattcaaattgaggcaggggcacaggtccaaacgataccccaccaccaaaaaaaggcaccgc

SEQ ID NO: 21620 - DNA, 449 bp, Zea mays
  Clone ID: cC-zmle18900078e08a1
aaataaaaatataacccgggcgtggggttatatagacaaaaaataacaccccatacccaaacatataaaccaaaaaaaggtgaaagactaatgccaccactcacgaacagaaaataccagcctgacacattaagggaacatcaccaaagagcaaatgaatcagccataccaaagcaagtcacttattgggcaaacaacgatctgacacgaacaaaacaatgccacgccagctacacaaatgaagaggggcacgctccaaaagaagcctaccacctaaaaagggcaagggatgcataacttgtgagcacattcacaaccaaaagaggtagcacaaacactacagcacctttaagaagaaaaacgcagcccactgcagatgctaccagaaaacaaaaacccatgtcggcagtgcacaaaggggaggaatgacattagaccacttccatgtc

SEQ ID NO: 21621 - DNA, 145 bp, Zea mays
  Clone ID: cC-zmle18900078e09a1
ctctttttttttaaataaaaatttaactcgggcgaggagttttttttcctaaaaattagtccccacccccaaacattcaaaccaaaaaacagagataaccaaaaaacacctcctacgatcggataataataacctcccaaaatac

SEQ ID NO: 21622 - DNA, 147 bp, Zea mays
  Clone ID: cC-zmle18900078e10a1
gggggtgggttttttttttttttcttttcatcctcgaccgcaataacatggtagcaccaaaaccaaaagcaaaaaaaaggcggtccagtttatacaacccaaaaccattaagcatgaaccttaacccacccgtccccggacgcctgg

SEQ ID NO: 21623 - DNA, 478 bp, Zea mays
  Clone ID: cC-zmle18900078e11a1
aagaagaagctccctagctaggggagaaggacgggtatatatctggtggcaatggtcacctcacctagggctgctctgctcggggtcaggatcagccacacacgtacgtacgtacacgcttctattgtctccaatcacatcaccggaaaattttcttctttttttctgtaacaatcacatgactccgtcgtcgcaagaacaacaagggtggcatggcatggccaaaggtgttttcgtcgacatcacagcaggctctctcgatcacatcttacaccgtgtagttctgctggatggcgtccatgtccaggcccttgagcttgaccaccgactccacgtggcccttgagggtgttgagctcccgcagcctcgcgatctcggcgcgcctcttggcctgctccgcgatctcggacagctcgcggtagctgttcttgtcgtggaacaacgtgctggtggcggcctcctgccgctggagcccgtg

SEQ ID NO: 21624 - DNA, 448 bp, Zea mays
  Clone ID: cC-zmle18900078e12a1
tttttttttactctacaattctataataaggaaaggtttttttttattttacttactaaccccccccccaaaaaaaaaaaaaaaaaactttgttcacaaaaaaacaagcaagagctcacactcccaaataattactcaaacaaaattcgtacaaaaaaacacaaacaaaaaaaaaaaaaaaaaaactcgaaacaaacaaaaaaaacactcaagaaataacaatataaaaaaaacaaaaaaaaacatttaaggactaaccccacagacaaaacaaaacaaccttccacgcccgcccaacggccaagccccccactgaaacaactcctgaatgaaacaaaaaaaaacccaaccgttcctgggagcaaaccacccaaaaaaaaagggacaaaaagtacacacccggaaacacccaaaaaaaaaaatatttatgccaaaaaaagacaatgcc

SEQ ID NO: 21625 - DNA, 286 bp, Zea mays
  Clone ID: cC-zmle18900078f01a1
tttttaaaagttttaataccgtatcacttaaggtttgggggtaggcgcgataacattgaaccgaccgactatcacgaggtccaaaaaaataaccaccacaaaagtaccaaccaaccacaaataaagtttaagcggacacaccgcaccaactgacgataactctcggcagcaactgggccagccagcaactgcagcacactcaagactgacaacaaaccgcttagtccacctcctcgatcttggggccagggccgccgctgccggcaggggcgtcctcgtccatgcc

SEQ ID NO: 21626 - DNA, 327 bp, Zea mays
  Clone ID: cC-zmle18900078f02a1
ttttgaaacttatgacacacatgcatctcgcaccagggatcaaggcacgtatttacaccctctcccatccgaaagacaatgaagttgcatagcatagccgttgagcttagttgccggggacgaagttggtggcgtaggcccatgcgttgttgttgactgggtcagcgatgtggtcagcgaggttctcgagcgggcccttgccggtgacgatggcctggacgaagaagccgaacatggaaaacatggcgaggcggccgttcttgagctccttcaccttgagctcggcgaaagcctcggggtcgtcggccacgccgagggggtcgaaac

SEQ ID NO: 21627 - DNA, 324 bp, Zea mays
  unsure at all n locations
  Clone ID: cC-zmle18900078f02d1
cgaagaaacnaaagaacggacacctcaccacaaacaacattttttttttataaaaccaggacaaaagaacccgcanggggcccattcgaaaacctgactgaccacaatcccaaaccataaaacaacaaacccttggccctactcaaacaacgttcattcaccgcaagtgaaggaggcgccgaccaagacctataagtgtcctaatgcatgagagcacacgctggttttcgcgtcgtaccatgacagaaactatctgttaaaccaaaaaggaataatagagttcaaaaaaaaaaaaaaagggaggacgttttacaggaaccaaac

SEQ ID NO: 21628 - DNA, 361 bp, Zea mays
  Clone ID: cC-zmle18900078f03a1
ttctcttttctctttttaataaaaattatataattcaggaaaagagatacattttacatggtttataattcctaaataagattgacataagtcataaaacataaaaaatatgtaatatctataaataaaagttacataattcataaatgttttttaaaatttctagttttttttgaatttttaaaactttagacatcaagatgacatagaccaataaaaacatgacatgtagcagcaggtaggcaacagccaacactatgacaaatatcgttctgtacccatcggatgatagcgtcatccaccgtgtgatggtaccgtctaaggctgtcaccgctgatgtcattatcaatcggtattgtat

SEQ ID NO: 21629 - DNA, 230 bp, Zea mays
  Clone ID: cC-zmle18900078f04a1
agagcggccgccccccccccttttttttataaaacacaaaaaaaacccaagccacgggggaaataaaaaaacaagaaccccccacccccaaacaaccaaaagaaccaaaagtgcataacacacaacacccattcacaagggaaaacacaaaacacaccaaaaaaacacaaacccacaaaactgcaaggaaaccacacacactaaaaccgcaaaagaaaatgggaagaaaa

SEQ ID NO: 21630 - DNA, 219 bp, Zea mays
  Clone ID: cC-zmle18900078f04d1
acccgtccgcccacgcgtacgcggacacatccacaacccaataaatttttcttttttagcagcacattacccacccagggacggattgcatgacagctatcaagaccactcctccagaagtaagaacaaaaatcgtgatcatcgtttcacaagaaaattctatgacaacagaaggtgataacggacttccctatgggaaaaattgatctaacacgcatg

SEQ ID NO: 21631 - DNA, 276 bp, Zea mays
  Clone ID: cC-zmle18900078f05a1
ttttctttataatctttttttttttggggttggttttatttaaaaataagtacccccccaaacccagaaccggaacctgaaggacaaccaatataccaaaaaagaagtcacaaaaaaacatggcgaaaaaaacaaaatagccgatcccagaaaaaaaaagagaaccgatcaaaattcaacacaacaaacaacccggaaaaaaaaaaaaaaaaccctgaggtcccaaaaaaaagaccaaaccaacaaaaatggcaaagcgcaaactgccccctatac

SEQ ID NO: 21632 - DNA, 440 bp, Zea mays
  Clone ID: cC-zmle18900078f06a1
ccataaaatgggttggcaccataatcttgtctcgtccaccaaatcaaaaacacaaaaggatctgttttgccaaacaatttacaaaaaaaaacaccggctcctgcgaaggagctgctctttcaaagaaacagagccggagccgttttaagaggagccggagacctgccaaacggggcctggccttaatttcacagattggtcagaaacaaaacctaccacatgaacataggttaccacttcacaactaatatttacaagaaacaacagaaacaaactagaagaccaaatgaccccacacacatgtaagcctccactccgtttccaaccttcaataactcactgtacaccatcacggcagctgctggaggctcagcttcttagcatccgatgcaggatctgaagtgcacccctcttctcataagttttgagcttttcttggg

SEQ ID NO: 21633 - DNA, 326 bp, Zea mays
  Clone ID: cC-zmle18900078f07a1
ctcaaacagaagataaaccggggagggggggattaaacaaacagacccccccacccccaaacatagaaacggaataaccgtggaaagcggacgacgccacatagtgacccaaaactgaagcctacagaacatagagagaactcactcgaagggcaaggaactcatgtcaaagacagtgaggcgtaaagcggaccaggcatgatctacacgaacaaagacttgccagcaagctcaagaaaggaaaaagggcacgggccaaaagaacaggaacacccaaggaggagccggggtggcacaaaatttgaacactgggactaaaaaaaaga

SEQ ID NO: 21634 - DNA, 256 bp, Zea mays
  Clone ID: cC-zmle18900078f08a1
aaataaacaataactcgggggtggggggtttagccaaaaacgaagcccccacccccaaacattgaaaccaacaaacggaggatgacgaacgacacctcgcacgagcggaaagctgctacctgccaaacaagggagtactgaccaaagagcaaggaaatcaagcctgccaaagccggacgtaaatcggccagccatgatctgacacgaacaaagcattgtcacaaggcaaaacaaaggaggaggggcaaggttcaaa

SEQ ID NO: 21635 - DNA, 505 bp, Zea mays
  Clone ID: cC-zmle18900078f08d1
tcgacaacccacccccccaaaccctaaaccaacgagcttttctatcttgctccgcctccatcaaggagcgcgcgattattactactgccagcagccccccgtcggcgtaccgccgtagcaaggctacccggcgaaggacggctacccgccagcggggtacccgccggccggctaccccccgccggcgcagggctacccgccgcagggctacccgcagcagggttacccgcagcatggctacccgccgcagtacgcgcagccgccttcacagcagcagcagagcagcgggccttccttcatggaaggatgcttggctgccctctgctgctgctgcctcctggactcctgcttttgacggaaccatccgtgccgggttcaacacggctgcaagtgaagcaaccagcttacggaagagctggaactgggccgtgctattttaactttgttctgcgttatcgccctcttttctattctttattttgacctctctctctctctgaaataa

SEQ ID NO: 21636 - DNA, 172 bp, Zea mays
  Clone ID: cC-zmle18900078f09a1
aaacaaaatctttaacttgggggtgggtgttttttttccataaaattagggcccacccccaaacattcaaacggacaaacagggggtggggaaagacaactcccctgatcggatattagctacataataaagtaacgagtcatgaacaaagtgcaccgaaatcattaatacc

SEQ ID NO: 21637 - DNA, 341 bp, Zea mays
  Clone ID: cC-zmle18900078f10a1
cccaccctcctttttctgggtaggggaaattttttcttttttttcgcccctaccccccaaaaaaaactctattcccgtcacgaaccaattatactaactcacacaaaaacccatcgcgcccacctaacaaacccaagtcccaaaaccctggccaaaccccaaaccaccaacaaacaaaaggcacccccgcaaacacaaaccggcgtgaaaaccccccccccggcggtctaaatctccctgaagaagaaattctccctccccttcaggaactagtcgggccaggaggagatatcccccttaaccctggcctgccccaacaaaaaaacgaagccctcccggaa

SEQ ID NO: 21638 - DNA, 508 bp, Zea mays
  Clone ID: cC-zmle18900078f11a1
agacatatccatttatattgggggtcagggatctggctagtttacagcatctggtcgcgcaagcagtgcggaacctgggatggagtctcctggcgtgctacttttatttacaaggaaaaactcctatacatggtagatctctttgctgctactcagaaacaccatgcccgggcacatctacatatttacaagaggctgtggcttccgagcatgggtatctgcgctcctaaatcttcaacatgccttccaacacgcgaagaacatcagcgcgggtaactatacctattactttttcgtcctggtttacaactggtaatctgtggatcttcttcttgagcatgagaacagcagcatccatcacggttttgtcagacgatagtgtgatagctggagatgtcatcacttccgatatcttcgtcttggacccatgagaggctcttgcccggtcgttcttgacgatcaccccgacgcatctgaggccgctgtcgacgaccggaagccccgacac

SEQ ID NO: 21639 - DNA, 377 bp, Zea mays
  Clone ID: cC-zmle18900078f12a1
agaagaagggaatgttactacggatggggggttggacacatacatcatccaacaaacttcattatcgaattacaactaataagccatctaaaagagggcaccaccaatgacgacatgatggtagaaggcatttgcctttgtacaaccacggtgcacaaaaggccacaattgtatggcttagactaaggctgaggccttagccgcaaactggtgcttaaaaggcagtaactgacgctgcgttaagaaagaagcacggattgctgcacatcgctggctacatggacatagcatttgctgctatgaataaacacagggcatcaaagctgaccagtgtataaatggaagaaccaggggttaatgatagtatgccactgcta

SEQ ID NO: 21640 - DNA, 185 bp, Zea mays
  Clone ID: cC-zmle18900078g01a1
ctttttttttttttttttctcccttcctcttttttttccgggaaacgtttatttttttttcctctttccccccctccccctttaaaaaatcccaacaaaagtgtttaaaccaaaaaaaaaaaaaccaccacaatcttttttgtcaaaaaaaacaaaaaaaacccccccacccctgggttcacccg

SEQ ID NO: 21641 - DNA, 547 bp, Zea mays
  unsure at all n locations
  Clone ID: cC-zmle18900078g01d1
aggacacacccgtccgcggacgcgtgggggctacccaccatgagactactgcttttcttttttgaccatggagcagntcaaggccgggggcggtgctctcaccggccgagaggagcgctacgacaagtttgagggtgtaccgaaaaacattcgtggcgctggtggcattggcgctgctgcaggtctcgcccacaagaccacttcccacggccacgagcacgcccgtcacggagactatgacgctacccccaaccaccacagcgatgctggcctgagggagggaggtcttactcacaactttactactaccggtacacacaacccccttgaccgtaacaactacggcgagggcagcgccaaggacttgactggtagccacttcaacaccttccacactgaccgtggcgttgccggccaaggcaacctgaccggctcttccacccagggaggagttgttggcagctctgttggtgaccgcaatcacgacggcaacattgatagccaggaacttatggaccctgcacccagcggcaatcacggtgctaca

SEQ ID NO: 21642 - DNA, 270 bp, Zea mays
  Clone ID: cC-zmle18900078g02a1
cttgcatcctctataccggccgcccacaccacccctctttttctctctcaccgagaacaagaaaccaaaaccgccaccggtaaaaatttactaccccacacacaaccaaacccccgaaacacccatcaatacgccactccaacggacacaaacatacaaacctaaaccgctaacataaactgcgctcactgcatcataaacaaataacccccctcatatccccaccataccacatacatccaaaaacacgcacacacgggaatgccacca

SEQ ID NO: 21643 - DNA, 506 bp, Zea mays
  unsure at all n locations
  Clone ID: cC-zmle18900078g02d1
tccgaaatcaatatacagccgagaccgaaacttgtggcaccttatcttttagggtgacatcctggaggacccggganaggagccaaaggaagatatgtatatgatgtccattgctccagaaaatgcgccctcgaaacctgagtatttggagattggtatcattgctggtgttcctgtttcaatcaatggccgagacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctggacagggagaccatgcagtggaaggacattattgccctcaagtacgccgagctggtctatgctggccgctggtttgacccgctccggccgtcctttgatgccttcatggagaaggttaccgcgacgaccactggtt

SEQ ID NO: 21644 - DNA, 379 bp, Zea mays
  Clone ID: cC-zmle18900078g03a1
aagcttggaacctgtacagcggccgctcgccgtcgccgagtttgtccatttacgcctccccgccgctgccttccaggcggccgtgtacgtttgataccaccatgtcgcccggccacgggacgtctacgacaccgacgcgcatctcgtaataccggatcccgttgggaaacacgacctcgtgctcctgctccacatacttgatgttggcctgctgctgcgcgacactccaagcgtgtcttgagctgctccgacacgacgacgacggtcaggaagacggcccacgccagacccgcaccgattcctgaccgacgagtcaacgacgaggctatccattcagtggagtccccgacgcccgcctgcttttgctcttccgcctacg

SEQ ID NO: 21645 - DNA, 417 bp, Zea mays
  Clone ID: cC-zmle18900078g04a1
aactaatgctggggcgggattcaaatcagcttacacctttcaacagttgagtaaatatggggcagaatgaagaaatacactagcatttttttcctgcagattgtatctttctaacttccaatactccctggtacatggccacacgcacagttaccaaaagctgtcccagcaaaaacagcaggggacccttttgggtttccaggaaacaaaagcttaaaaggattcatcagttcctaggggcataaagccttttttgtaaacttaaaagtaatggcccgaccagggacacacaaggtttaaacggaatgtcgccatttgaatcccaagcagccgcaaagtttgccctgtttttggcaaagggggctttctttcttaacaaactacatggtttgaaaccaactttacaacacctttgtt

SEQ ID NO: 21646 - DNA, 482 bp, Zea mays
  unsure at all n locations
  Clone ID: cC-zmle18900078g05a1
gccattatgtcttataattggggtcggtactcatgcaacatgtcatacaggacaggaaccgctttgacaaaaaccaacacattccctatcttccaaggttcttttcttctacctcatcaaataggtaaaacaatataattcattcatgctatattggaggcaaaacccaactcccgacaacacctgcgacttcatgcctaccaccagaggcggtgggagcaagagcccaaatgatccaaccggctgaccttgaagactgaccacttccatgcagcaccactggtgatgcagcacaaggactgaccctgctgactgggactgacatgacaaacacctgagaccagaccaatgggaccgaaccaaggttttggaggacgacgccactaccccaactctgactagccccaaccactaggccaaggcacaatggcacagccgccattccaaatgggcatcttcagncgaagttgaatccacctgat

SEQ ID NO: 21647 - DNA, 266 bp, Zea mays
  Clone ID: cC-zmle18900078g05d1
ccgagcaacacaacaaaaaaaccacaccaccccaacaaaacttaatttttaaagacaccaacacaaaaacacgccggggcgccgaaaataaacaaacagacggaaacacacccccataaaaaaaccacgcacaacccgtcacaaccaaaaaaatgattccaaaaccacaagacattaaaacacgcacaaagagagaccgaacacaagccaacaacacaaagcaaacaatgacgcacataacaataacgaacttgacccacaaaaca

SEQ ID NO: 21648 - DNA, 181 bp, Zea mays
  Clone ID: cC-zmle18900078g06a1
gggttgggttttttttttttttttggccgcttggaaaaaaaaattcattcccattaactttttttaccaaacaattagggggagtacaaacaatcactcaccctgttttttttcaccaacccaacaacaacaaaggttaggggcgaactggttttacacccacccctccccggaccccggg

SEQ ID NO: 21649 - DNA, 534 bp, Zea mays
  Clone ID: cC-zmle18900078g07a1
cttttcttttctcttttttttttttttgggggtgggttttttttatttttttttcttcccccccccccactaaccataacaaaaataaaaaaaaacaaaaaccaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaataaaaaaaaaaaaaaaaaaaaaaaaaacttaaaaaaataaaacaatccaaaaaaaaaccaaaaccacaaaaaaaaaaaaaaaaaaaaagaacaaaaacaaaaaaaaaaaaataaaaaaataaaaaatgacaaaatcaacatacaacatttcaaaaaacccaatacatcaaaccaaaaatccaaaaccaaaatctcatcaaaaaaaccaaacaaaaaaaaaaaaaaataaaataatacaaataaaataaaattcgaaaaaaaaaaaaacgcttacaaaagaaacaaaaaattaaacccataaaaataaacctggccaaaacacataaaaata

SEQ ID NO: 21650 - DNA, 437 bp, Zea mays
  Clone ID: cC-zmle18900078g09a1
cttctcttttttcttttttttttttttggtttgggtttttttttggattggtggatcataaaaccgtgaccaacccaaagagagagagagagagacgactaaaaatttcaacccgaaggccactttgggaatttttttacaccaaacatacacccacgcaagagttttacgaaaaagcccatcctggagcccggaaaggcctggggacccctacattggcttaaggataggatggataaaaaattaaagggacagtatttccaaagcgcatgccgttgtcttcctcaagaatgcgtaaggctggctgtcacacaacaaaaccatttttttgggcttggctttgcaacaaaaaaatccaccctttcaatcctgggggccttggaaggggactcaagggcttggccgttcccacccttcttttaaaatttggctttggt

SEQ ID NO: 21651 - DNA, 382 bp, Zea mays
  unsure at all n locations
  Clone ID: cC-zmle18900078g10a1
gcgggncagaaaccagggggggggcgataagaagcaaacaatccaaagttcccagcacgacctcatattacaaactcgtatttactgacgaacaaacgacacatcacacattaaggccaacagcagcagatgataaaccacgggaagcacagataaaactagggtagggaagggggtggaataactcacatgccacgccccatggtctgctccatgggcggcatcatgacaaagacggagtgcccattgttgaatccagggtggggaaccctgcggggcagctcgcgaccctcctggcagagggcgcacgggtggcaaaagtagtgggtcgcaaggtcacaggcggcctctaggtgctcacgcctttccttgtccttgaccc

SEQ ID NO: 21652 - DNA, 327 bp, Zea mays
  unsure at all n locations
  Clone ID: cC-zmle18900078g11a1
attccactcctcttgtcaggggtnggttttttttgcacacactttcttacaaaaaccgggggctatgtttatttcggacaagtaaggcaactaaaatcttgggcccgtggctgggaagcaaacaaaacaaaaaaccctcgggcggccctcctaaaaaactctgggaagaatacttcatgagcatatgggacacctaaagcgaccgtgcaaccatgaaagggcaaaaaagggaacaccggctctaatctctgtagaaacacatcctcaagggcgcagtaaaaaacaaaagggcgagtatcctgtgatgcagcaaaacactgaaacatg

SEQ ID NO: 21653 - DNA, 335 bp, Zea mays
  Clone ID: cC-zmle18900078h01a1
tttttcaaatttaagggtagaaaccagaagcaaatggggcgtcgtgatgatagtaataggatcagatatcacttgtgaaattcacaacggtaaacaagtagaaatcttagcacccaacctttagagatcctagagcataacccaaaaatgctggagtactgtctcggctacacagtcaatatagtggaccccagtatgcctgacaagcgaccgatcatgcttcagtctgctccctcaagcgacggatcgtgctcctgacagtgaccgcactagcagtgttcatggtgtaagcaccaccggccttgacctttccacagttcttggattcccaaaat

SEQ ID NO: 21654 - DNA, 264 bp, Zea mays
  Clone ID: cC-zmle18900078h02a1
tttttaggtgtgtttgcccgtcaacaatctatgtcgcgggaagggccacaatacactatgcagccaaattgatacaaaaggacactgaacacgggaatccaatattacatgtatataaatagtgagccatatacatgagggctttttaacttcaatgaatctcgagaccaaatccaggactggcgtcactataatccagagtttgggctaccggtacacctacaaaaattttaagaggaatttcagtattgctgcctaagtggc

SEQ ID NO: 21655 - DNA, 352 bp, Zea mays; identical to SEQ ID NO: 21603
  Clone ID: cC-zmle18900078h03a1

SEQ ID NO: 21656 - DNA, 557 bp, Zea mays
  Clone ID: cC-zmle18900078h03d1
gtccgcccacgcgtccgacctgctcaaagtaaatttaagcttctttactttgagcaagaagttaatggaggttatggacgggctttgcaggaagatagtcaaaagactggcaaggtaacatcagcaggcatgtatttcttgcatttccaggtgtatcgtatggactcaacagcgaatgcgttggcaatggccaaagatcctgaagctgccttctttaaaaggttggaaggtctccaaccctgcgaagtttcagctctcaaatctggaacccatatatttgctgtatatggtgacaattttttcaagccagctagctatatgattgaagcgatgtgcgcaaagagttatgaagacacaacagagaggctgaaagagatagaatctaaaattctagctaagcgaaatgatctgcgtcaatttgaaactgagtacagaaaagctttggcacgatttcaagaagtcaccaacagatatacacaagagagagaagcggttgatgatatgctgagagagagggacaatatccattgctcgttcacaactgaacgaactttggc

SEQ ID NO: 21657 - DNA, 366 bp, Zea mays
  Clone ID: cC-zmle18900078h04a1
gggggaggggggggcaaacataatcagtaaattatccggggcaaaccaccacccgcagtcaacaagagcgctggcccatataaactagatatcacactccagttgtagtttgacccatatgccataacaggcaaaccggtcaagagttcaaatgctttaaccacactacgactgaaagatacttactacacacgcggcaaccacagggggcaccatgtttttggaacaattacagactggccaggcattatttcatggataagcaagcaggagcatgtacgaaactgctccaagcttaactggggcctaaggaaagcgcttaaccgctgaagcccccttacgagctggaggcctcaaaggtatctt

SEQ ID NO: 21658 - DNA, 289 bp, Zea mays
  Clone ID: cC-zmle18900078h04d1
cgggcggatccgcatgcccgcggcgtgcgcggccaggatcttccttctgacgcgggagctagggcacaagggcggcggggagaccatccggtggctgctgcagcagtcggagcccgccatcatcgccgccaccggcaccggcacggtaccggcgatcgcgaccacggtcgacggcgtgctccgcatccccacgcagtcctcgtcgtcctccagcccctcgtccctcaccaccgtggtcgacggcgacgaggcgtccgccaagcgccgccggaagctgcagccgacgcga

SEQ ID NO: 21659 - DNA, 413 bp, Zea mays
  Clone ID: cC-zmle18900078h05a1
ggggggggaacagtcattagcatcaacaagccaccggcaagaacaggtctgagattcgctacacggccttgcaggcaccacaaagccacacggtcaaatcacgttactgaatcttttatgtcatgttctgtaccaacaatgggtgtgtgttctcgtttgaagatagaaaagggaacggcaaaaaaatgcctgcaatttggacggggcgcccatccgaacgttggaatcctgtaggctgcgatccaacaacagccagctcttcttattccggctgcctataacttcgccggcgagaaggcgatatgtacaggggaccttcgacatttacatggggggatggatgatcctcgtgctgcaggtcaagcggctgcagtcctgaaaggtgggctgtccgacttgagaaaccggaaatg

SEQ ID NO: 21660 - DNA, 500 bp, Zea mays
  Clone ID: cC-zmle18900078h05d1
ccgggaccaggaacagggtgtgcaccattccgtgcatttgtttatgttagggctgcacaggctgcagctgaaccaacggccccggttctgttcttcttcggctgtagaaaccaagaaaacgattttctatacaaggatttctggctaactcatgcgcaggatgagggggtgttgtcctcgaaaaggggtggtggtttcttcgtcgctttttcccgggatcagccgcaaaaggtctacgtgcaacacaagataaaggaacagagttcaagactgtggaacttattactgtccgatgcagtgatctacattgcaggctcttcgacgaaaatgcctgccgatgttacagctgctctagaggaggttattttgtaaagaaggtggtgtcaagcaagcggatgcatcgaaatggctcaaggatctagaaagggctggtagacttaacatcgagacatggtcatagttgtgatgggcaagaaagtacatattatttattgttgctg

SEQ ID NO: 21661 - DNA, 552 bp, Zea mays
  unsure at all n locations
  Clone ID: cC-zmle18900078h06a1
cgacggccgtttggctctctcgcctcgccgaacccgctgggccggggggcgctgcagagccacggcccagaccttccaggggggcgccgccgccagctacgcccgcgagatggagcgcctctccgccaaggagtcattgctcctcgcctttaaagatgctgggggtttcgaggccttagtcagcgggaagaccactgagatgcagaggatcgatgtcaatgagcgaatcgttggacttgaacgcctgaatcccacaccgcgccccacaacatcgccgtttctggagggtcgatggaactttgaatggtttggtgatagtagtcctggagcatttgcagcccgtcttttgtttgagaggtcacctacggctgttgcacactttatgggacttgatgtgctgatcaaggatggatactccaagctctcatcaaacctcaagtttgtaaacacgataccaagcacgtttttactgactactcaatnngtctgtgagggccccatcangatgaaagaggaatatgttgagggccttatagagattcccagaatcat

SEQ ID NO: 21662 - DNA, 460 bp, Zea mays
  Clone ID: cC-zmle18900078h06d1
tccggccacacgaacggtagaaatcatcaaacatgcgtatatatatatatccggccgatactcctctctagctggaccggatgtatgtggtgtggtcctcggttcattccactccaacgacgatcagcgacgcgaataaatgtgattactctgctctgcacatgaatggattgggatgtaacctgatcaacttctttttacctgattggatgcatcattcaaagctcaaaaagaaaaacagcaacacaagaaaaaagaaacaaaaaaaaaagaaagaaaaaattaaaacaatccgatggggggccctacaataggagccaacctaccataccgggggacgcgacgacaaacttcttttatagggttacctaaaataaaagcacgggccgaacaaatacaaccctctaactgggaaaaccatgtcgaaacccaacttaaacgccttgtaccaaaatcccct

SEQ ID NO: 21663 - DNA, 452 bp, Zea mays
  Clone ID: cC-zmle18900078h07a1
atatcaatgaatctgatagggcatggggatatatataaacatcttgtatgtattttttcgcgtgccgcacgtgcactgccactagtacacagaataaaagactatcaatgcacggcagaccactgtgatttttcattacattttttccttttatgaagcaacgttattacagcgttagcgctagacataaatcatctgagttctgagagacagtggagaaacatgctctgagtggctacgatgtccccgcagctggtaccaactgcgctgcatcgtagcatacaaggccatcccacctcattttctttggacagtgaagtggaagcccatgggttctcgatactcaccagttccatggcaccggaggcagtaattcagtccactaccaccacaaattcgacaccattgtggccattcgccgttcggaagcatggccacatcggcatggtttg

SEQ ID NO: 21664 - DNA, 486 bp, Zea mays
  unsure at all n locations
  Clone ID: cC-zmle18900078h07d1
ccgcggacgcgtgcggtaagtgggaacactatgcgatatgcacctaccatttatactgccatgcactggacactctgacacgcaagggagccgattgtgctacacgtattcagggaggggggtgactcaccttgcatgagtgagtgatcgaggagcgcacggtgcgactggacacagaactcgtgccgaacaggngaggcacgaactctcgagcggaatcgggccgcgcaccgcctacctatggcgaggaggcagacggttctacaagctaatcgaccctcgcctggagggcaacttatcggtgaaaggcgcgcaaaaggtggcgcatctagcacaccagtgcctgagccgacacccccacgcgcaccccctgatgagacaagcggaggaggagctgaatccgcagcacaacctgaaggacatggcgagcgcctactacttctttcagaccatgcatgccgagcggatggcgcactcgagcagcat

SEQ ID NO: 21665 - DNA, 366 bp, Zea mays
  Clone ID: cC-zmle18900078h08a1
ttttttttttttttttttttttttttttggggtggggttttttttactttacaaccagacctaacccaaagaggcatggaaatcacactattcatagggaaaaaaaacgctgaaaaattggccttttcaaacaaaaaagataaaaagccgccaacccaaaaaaaaataatggggaacaaaccccaaaggaaaaaaaaaaaacctcctaaacagaccaataaatgccgggggaaaaaccccaaatggggaacaaaaacggaaaattcaaaccccgggggaccttaatcccaaagaacacctgaccagtcccaaaaaccccccccaaaaaaaaaaccccttgaaaccgggccaacaaaaagtccccct

SEQ ID NO: 21666 - DNA, 473 bp, Zea mays
  unsure at all n locations
  Clone ID: cC-zmle18900078h09d1
aaaaaaaaaaaggaaaaaaaaaaaaaaaaaaaatttattttttatnaaaaaaaaaaaaaaaaaaaaaggggagggaaaattttaaaaaaaaagggcgggccccccccagggaccaaccnaaccaaccccgccaaagccaacgaaaaacgccacaaaaggggcccccaaaacaaaggccccggcccgcccctaaccaccgcgggccggggaaaacccgggcggcacccaaccaaaacgcccgggaaaacaacccccctttcccagttggccttatttcgaaaaggccccttcccgatgcccttcccaaccattttcccccccaaaaggccaaggggcccccccccttaacggcccattaaacccccggggtttgtgtggttccccccatatgggacccttacccttgccagggccctttagccccctccttttctttttttcccttccttttttcccccggtgcccggcttttc

SEQ ID NO: 21667 - DNA, 421 bp, Zea mays
  Clone ID: cC-zmle18900078h10a1
ttttttcttttttcttttttttttttttggggatgggaattttttatttttttttttttccctccccttggggtttttttttttgggaaaacgggccattaaaatatttttgggggtttttaacctgaacaaaaagacccgggaaccccatgcccgcaaaaaaaaagccccggaaaaattttaacaattcccaaggcccccaaagccgtttgtccccttcccaaggcccaaaaaggaaaacaaggatttgaaccctttccccggtatatgtatgggcacgtttaaaaaaaaaaaaaatggccttcctttgaaggggggaaaaggttataccggtttggccccccccccccagggtaaaaaccaaacctttttcgcgggcgggacaccccaaaaatggcaaaaaaaagggttttctttgaac

SEQ ID NO: 21668 - DNA, 421 bp, Zea mays
  Clone ID: cC-zmle18900078h11a1
ttttctctttttttttttttttttttttggggtaggtaaaattaatttaggactctgactcatcccgggggcgtccatttacatccactccacaccataaaataaaggcgtcaccatttgtagcaggagtagtaaagaccaaggacaacgagagcccactggtgaccggttgcccccccggctaggaatctccacacggcacgaccggaacgggcctgtccctcgaccccatttttcgcccgcttcctccggcccacttgatccctgcccacatgtcctcagtcctcactggccgcacgtctctttttttttgtgggtgtgggtgttggaagaacacgagccctaaaactttatacacgtgctcaaaatctcacttggaggctgggacaacacttgtacacaaacagcaccgatttttacc

SEQ ID NO: 21669 - DNA, 471 bp, Zea mays
  Clone ID: cC-zmle18900079a02a1
ctctttttttttttttttttttttttttttttgggagctgtgggttttttttttttttttttttccctttctctttttttttggggaaaaaaaaagaaaaaaaaaatatcacgggggcccaaaaaaaaaaggggtccaggagaggcaatcggaaaaaccaaaagggggggggaaccccggcccgacatggacaaaaaaacgggcccccaaccgggggagggggaaaggcaaccggaaaaccttggttttttttttttaaaccaccccaaaaaaaacctttttttggggccccactggggcccgtttattattggtcaaccccccccccaggggaaaaaaaaaaaaaaaaatccccggggccgccaacgaggggaacaacagtggggggggggccccttggcagtgccaccccaaatggagccgggggggggcttcccggaaccccccgggggcttaaaaaaaatggggggg

SEQ ID NO: 21670 - DNA, 437 bp, Zea mays
  Clone ID: cC-zmle18900079a03a1
attaccggctcacccaaaagtatttggtcgagggaagtactgcggttcctttattgtccatacaagcgtatctacataggcatgcagtgttctgttccatatagatcgacgactgcatgcgagccaaatattggccacgcgacccacgacggagcaccagctcagctggcatggtccagtgtcgccacctccagcaaggcagcaagagcaggccggccggggaacgatcacttgatgaggatgcatctggtcggtgcaccctcggctccgaccagcctgagaggtagacagtgcagcatgtatatccccgcctcgatgtcgtccagattcaggctctcaacagggattatatccggggttttgaaaaagaccacgtgggcagagatcaggtgatcaaatgatgccactgacagaccgtcaactccaactagctttat

SEQ ID NO: 21671 - DNA, 356 bp, Zea mays
  Clone ID: cC-zmle18900079a04a1
ttcttttttttttttttttttttttttttttttgggggttggggttttttttttttttttttttttaaaacgaacaaaacattcccaatttatttttggagggaataaccaaacaaaacctttggtggatgggcaaaaaagccacggggcctgtttttgcctgggcacccccacaaaaagccaggggggggcccccccccaaaccatgttttttggggttatggggacaaatttttaggccctattttttttcattttaggctctaaattcccaaaaccaaaaactaaaaatttatggtaatggggggcttttcccctttaaagacctaaaggaaataaacccgggcccggggggg

SEQ ID NO: 21672 - DNA, 216 bp, Zea mays
  Clone ID: cC-zmle18900079a05a1
ttttgtttttatcataagattttaagcagttagagagttgggggtttattatggactgcaaaaaccaaaaacaatgggctcaaccgacaaagattaggcttgttgcacgggcccaaactcatatcggcgaataaatagcatcaaaggggctcattgaacaggggagatagcatctgcgcgttcaccggaggaataccaggttttcaggtgacgggc

SEQ ID NO: 21673 - DNA, 374 bp, Zea mays
  Clone ID: cC-zmle18900079a06a1
ctcttgcttttaatgattcattcattcagtagggggaaggggatgagatctcatacatagttgattcagagtacagacataagacatcatcagaaattcataatgcagcagcctatgaccaggcccttctcttgagtcagtgaccccccttcctcgcgcaagcaggctgacaaatgttggaacactagccccacagtggctggctgtctgacgcaaacaccactcgagaagtccgagatgcatcgcacccggcctcttttattttgggatcgccgcagccagcataattattattagggtaccagctagtagtttctttcgttcgttcaccaagggaggatcttccagcgctggttgtcgcccggacgcgtggg

SEQ ID NO: 21674 - DNA, 170 bp, Zea mays
  Clone ID: cC-zmle18900079a07a1
ctcttttttttttttattgatttattcaaatggggagttgggggtatattataaaccgtaaccaccctgagaatacgtggcaacctgcatgcagggggcataatggagtagaccctactcatttcatggtacagaaggcacctcactactccagtgaatgggggggatgc

SEQ ID NO: 21675 - DNA, 175 bp, Zea mays
  Clone ID: cC-zmle18900079a08a1
ctctgtttttttcataaaaaattaatcaaatggggagaagggggtatattaaataccgcatccacccagagcaaacgtggcagcacccaaacaaagagaatcaagcaggggacgctaaacatatcaacgtacacaaggccccaaactcccccaagcaacagggggggggactaaa

SEQ ID NO: 21676 - DNA, 227 bp, Zea mays
  Clone ID: cC-zmle18900079a09a1
ttttgagtttatcataagaattttatcagatagagagatgggggtttattattaaccgcaaacacccaaagcatacgtcgcaacatcctatgagtatgcttgttgcacgggagccaactcattttgactaacaaatggcatcaaatgcccccattgaaaaggggagatgggtttcgttcctgcaccggcgaaaaagatgacttttcaggtgacgggcatctgccatt

SEQ ID NO: 21677 - DNA, 383 bp, Zea mays
  Clone ID: cC-zmle18900079a10a1
ccttcttttatttgatttttgaaaacagacaaaaacatacaggggggaggggggttattatacaccgtgaaccccaaaacccataatgaaagggcgcaaaaggcaaagattaagccagaagtacggaaccaaacacattaggacaagtaaaaaccttcaaacgcgcccacagaatgggggagatcaatcaagatacctggaaaaaggaagactatcaggttccaggcgacaggcaataaagggaaacgagcaggatcaacgctgaccagagaagtccaagtcgaggcacggactggaaacacggtaaaaaccgtggcagggacgaaaaacttgctgggaacgttcgaacccaagcaatataggcagtagtccccacccgtggg

SEQ ID NO: 21678 - DNA, 334 bp, Zea mays
  Clone ID: cC-zmle18900079a11a1
ttttcagttcacccaacgaacggaagcggtccaggggatgatgtttggtcatgcaccacgccacagagaaaccatgggcccaaaaggccatgaacacggccccatgcacggacacagactcatcaggctgagcaactagcgatcatctgtgctgaccgcacaatggagaactcatacgcctggaagccggcggggactcacttattatggttacggccccacgccatgctggcttgatgctgtgatatccatggcctgcgggcgaaggcatgagcacatgccggggtcacgcttgtagctgccacctgagctgaatccgtgggcggtcacaacg

SEQ ID NO: 21679 - DNA, 534 bp, Zea mays
  Clone ID: cC-zmle18900079a12a1
acgagttaacatatcaaggggtcggtcagataaccaataaggttgatccgttgatgggcgaaaccaacaccaacactaattgacaacaattataaattttaaaacatagtcagattgcagaacttcctaccactcgtccactacggatgaatattacgaattcgaacacccacaaatgtaacttccacaaaaagcaagcatcgaacagatgcaaaccatactacggagccactcccagtagcagtaaacagagaatctaggccctttcaccacggatcctcctagccagctgaatgtccttgggcatgatggtcacgcgcttggcatggatggcgcacagattagtgtcctcgaatagacccaccaggtacgcctccgcagccttctgcagcgcaagcaccgcatggctctggaaacgaagatcagtcttgaaatcctgggcaatctccctgacaagcctttggaacggaagcttccttatgagcaggtcagtgctcttctgatacttgcggatttcactgcacagtcagggag

SEQ ID NO: 21680 - DNA, 357 bp, Zea mays
  Clone ID: cC-zmle18900079b02a1
attcataccatgcatataaacatatttccttttttttattcatgcccggaaaaagggcattgcaataaccttcttacaaaaaaaatcaatgatccactaatgacgggttggaaatacctaccatagggacttttacattacttacacccgtggaaaccgcgcaacatgcccagtaacaaagggtttttccattatatacaaaaactgcatgctgggaagcccggcaggaaacaaaaatttcaaaacttacaggaacaacacgggcttgctgtgtaccataccataccccgtgtgttctggcccgagtcgtcttactggtacaaactcggcacctcccttggccaccccggaagaaaa

SEQ ID NO: 21681 - DNA, 331 bp, Zea mays
  Clone ID: cC-zmle18900079b03a1
ataataagaagtccggttttaggggatatggggtatcaaatcatatcatcggggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataacccacgcgtccgcggacgcgtgggcggacgcgtgggcggacgcgtggg

SEQ ID NO: 21682 - DNA, 443 bp, Zea mays
  Clone ID: cC-zmle18900079b04a1
ttctttttttttttttttttttttttttttttttgggttggggttttttttttttttttttttcccttttccttttttttttttttttttttttttttttttaaaaaaccaaaaaccccccaaatttttttttccaaaaagccccccaatttaatatttttccaccaccggtatattaacaggggggggggggaaaccttaaaaaaagccccaggaaggaataatacaaaaaccccccccggggccccccccccggggggagggggtaaaaagcccccaaccccttcaaaaagggttaaatgcccccccacttttggttaaaaccccaaaaaccccccttttgtggcccaaggggggattgtaaaaaaagcccccaagctccctttgggggtcagggggttaaaaaaccttttaaacaccccccccgctttgtggtttccccg

SEQ ID NO: 21683 - DNA, 218 bp, Zea mays
  Clone ID: cC-zmle18900079b05a1
ttttgtttttaccatacaagcttaagcagtgagggagttgggggtttatcatgaactgcaaaaactaaaaacaaaggacgaaaaagacaaagattaagcttgttgaacggaaacaaactcatcttggcaaacagacagcatcaaaggggcccactaaaaaagggagatatctcccacggctaaaccaggaggaaagatgattttcacgtaacgggcat

SEQ ID NO: 21684 - DNA, 445 bp, Zea mays
  Clone ID: cC-zmle18900079b06a1
ggggaaaacaatagccggtgggaatagggatgatttatcgggtccaatcaaacatacgtcgaaggtgttccactccatgggcttaaatgcactaaattgcaaaacgttccctattcaaaaaggatgccggtttcttgcgccccaggtcatgatttacatgatcaaaccgggggcgcgtaactccaatggattacttcacctatttacgggggtcttcttttccctatttgaaaaatagcttagtcactacccactaggggtacgttgcaaaacaagatcgcaagcagaaacccaactatattcatcatcatttggtttccttgggcgccacatgtggctcggtcccatttagaaaaacggggtggttctattttcttatacctgagagtccggcgttttcttcttacaattgggacgagcctttatacttttgagaacacttttt

SEQ ID NO: 21685 - DNA, 156 bp, Zea mays
  Clone ID: cC-zmle18900079b07a1
cttactaattttatcaaatggggaagtgtgggtatattatatacgggctaaacccagagcatccagggcaacccccatatagaacgcagaaaggagagaacgcaacacactttaacgtgcacatggtcccaaactccaccttacaacaggggaggg

SEQ ID NO: 21686 - DNA, 237 bp, Zea mays
  Clone ID: cC-zmle18900079b09a1
ttttgtttttaccatacaatcttaagcagtgaaggggtttggggtttattatggactgcaaaaaccaaaaacaatgggctcaacagacaatgattacgcctggtgtacgggcacgaactcatattgataaacacatagcatcagaggggcccacagaaaaggggagataggatccgcgccttaaccggaggaaaagaagactttcaggtgacgggcataggcataatgggatacacg

SEQ ID NO: 21687 - DNA, 321 bp, Zea mays
  Clone ID: cC-zmle18900079b10a1
ttttgagtttaccctactattttatgcagttaaggggattggggttctttatggactgcaaaaactagaaacaatgggcgcgaaaggccatgaatacgcctgttgtacgggcaccgaactcattttggttaacaagtagcatcaaaggggctcattgaaaaggggagatgtgatccgcgggttaaccggaggaaaagatgattttcaggtgacgggcataggcattaatgggatacacgctgtgcgtccgcttgccggagggggttaagcctagggacggcatgtaaacatggtgaaagcggcagcgtgtgacaaattgtt

SEQ ID NO: 21688 - DNA, 475 bp, Zea mays
  Clone ID: cC-zmle18900079b12a1
ttttaagatttactccttcctttcttttttttatggatcggggtttagttcaaaaatgatcgagctgacgacaaaaatatccgaaaacggaggtagcgcgtatagagctcagaaaactttctatgtagctaactctctctttttttcactcttcactgtaatagtatacatcttgtccaaagaatcgcatgctgctacattggaagcagcatccgccttggaccattggaaagaattacatttaaccctctccatacatacatggtactacttcgccagcttacgttcttcagtcgacgtaccccactcacgctaatcagaggtggaggctggtcaggtcttcaggcacagcccctccccgagaaaaatgaagaacacactacacgctctatactccctgtcaatcggatttttgtgcagaggtgctcgttttcgactcagcttggtagtagaccacatctccggtatcactgac

SEQ ID NO: 21689 - DNA, 470 bp, Zea mays
  Clone ID: cC-zmle18900079c01a1
ctcttttttttttttgcatgcatgcatcattaggggtagtgggagtgatggatcgttacacgctgcagaagcatgcgcttagtcgttatttgcagacgataataagtagatcgatggagtagtgatcgagcaacacacacgtgacgacgtttgctcttatttacttacacgcacgcacgtgtacggcgctaggggccgtatatatatcgagttctgcatgcatatctcgatcgatgggatgatcagtcgtttcagtcgcagtagtaggagtagccgtgcccgtgcccgtgcccgtgcggcaccctgtgctcctgctgcctgctctcgtagtgggcctccttctgctcgcggtgctcgtggtacgcgtagccgccggcgcccagcgccgccgccgttgccacgccggcctcgatcttgtgcctctgcgcgttcgccgggtccttcttcgcacggtgcccctcgtacagagc

SEQ ID NO: 21690 - DNA, 444 bp, Zea mays
  Clone ID: cC-zmle18900079c02a1
atgggatatagtagggggtctgggtaacgttgataaaatatttgctttagaatacaaatttatagtagtatgagtgcggacacgctcaatcttgtcgaaacaagttacatccatctgagtaacaaagggattaaaccccaaaaggaaattcattatcataaacacgccgtgagatatttgaacataaaagcctcgctccctgttcatgacaattattcgctggatccatcatcatctttgctaccgagggttcgtattatcgcttccaacaccttgatatcgctatctttcttcgcaatctcctcttgcttcagccgcaactcctccatgtgcagctgaaacactctcgcagtgttctccagttccttggtgacctcctgtgtgcgtaactctgcagctcgttgcgcagcttcggcctgtcgtttatctgtacgagctcgagct

SEQ ID NO: 21691 - DNA, 477 bp, Zea mays
  Clone ID: cC-zmle18900079c03a1
ttctttttttttttttttttttttttttttttggggggtgggtgttttttttttttttttttccccttttcccttttttctttttttttttttggtcttggccccacaaaagggcaagaggggtcccccccaccaagggggggggcctcaaaaaaaaaaccaggacccgggtctaccaaccaaccaggtccccccgggggggggcccaaaggggcccccggccaacccttttaaaacgggtgtccagggcgcccggggcccccccccccccacgggggccccaattgcccgtccaaaggggggggggaaacaccgggggaaaaccccaaaaatttcctcttccttcttggggggcaccaaggagtgggggaacccccaacaaaaacacggggggggggaggcattctatgggccccgaaaaaaaaaaaaatggccgccccgggggggagcaaattttgggggttccgggggaccccc

SEQ ID NO: 21692 - DNA, 369 bp, Zea mays
  Clone ID: cC-zmle18900079c04a1
ctctttttttttttttttttttttttttttttggggttttggggtccactatagcgggcagcatttgatcactaaccattcattgtctgataatacaaccgaattgcaaatagttcatgacatatgctccataattgacttttaacattaaaagggccaagaacacaaatagcaaaactttgaaaatgcaaccaaaaacaggcccccttgttgtcttgattgggaatgatcggacaggggcagtatccaagcccccgacaagcttcttatcggtagcgggggagggagagggtctggttgcgcttccagggggttctccttgagggcctgttcttggggggggggtggcccttgccaccggacgcgggg

SEQ ID NO: 21693 - DNA, 147 bp, Zea mays
  Clone ID: cC-zmle18900079c05a1
acaacaatatttatcggatggggagttgggtgttttttttttactggaacacccctaagccatggccgagaatgctcatgactacgtctgtagggcggacgcgaactcattacggcgtgttcactctattagaggccataacagaaa

SEQ ID NO: 21694 - DNA, 170 bp, Zea mays
  Clone ID: cC-zmle18900079c06a1
cttcttatttttcaaaaaaaaaataaacaaaaagggaaaagggggaattttatatacataaaaaacccaacccccacaacgcaaccacccataaataaaacaatagtacggaagacaacccacaaaaacaaacacacttcaacacaagccaaaacaaaacaagggaaaac

SEQ ID NO: 21695 - DNA, 159 bp, Zea mays
  Clone ID: cC-zmle18900079c08a1
ttatttttttatcaaaaaaacataaacaaaaagggagaagggggtacattatttactgtaaaaacccaaaccaaaccccgaaaactcccaacaaaacacataacgggcaaaaaacaacccactacaacttacacacggcaccacactcctaaacagaaa

SEQ ID NO: 21696 - DNA, 344 bp, Zea mays
  Clone ID: cC-zmle18900079c09a1
ttttgtttttatcataataacattatcatataagggaaagggggtatatcattaaccgcaaacacccaaaccaaacaccgcaacccacaaagaaaacgactaatgcacaggaccctacacatattaacaaacacaaggcatcatattcccccacaaaacaggggtgatgtcaaaaactcctaaaaagaccaaacgagatactatcacgggataggcaacggccataaagggatacaccatgattcccgcagaccatatttttactaggctagagacggcctgcaaacatagtagaaaccaaaggatgtcccccacacttccatcaaacacccctacccgaacat

SEQ ID NO: 21697 - DNA, 533 bp, Zea mays
  Clone ID: cC-zmle18900079c10a1
ttttgatttcagaacacgcttatttgcagtggggggaagagggattggttgttatagacaagcactgcactgcccaagctacatacactcgacataattttgccgaagcatttcaaaatctagctgaaacatatataccttcatttcctcctatggttattgggacttaggttctctgtctgaacttgaacaagatatgggtcatacgtcacgagcatttgcttttgttagtcagaagttatcttttgctcgacggacaactccaagcacccgatcttcatctaaatgatctggaacggacagtgttctcttaatttctggattggaggtccgcaagaaaggattgcattccttgtcccttccaattgttgttggcaccgtgggtatattcttattacgcagctcagctgcatttgcagcatattcctgcaatgctttatttcccggttctacactcaaggcaaactttgcattactcacggtatgttcatgcccacagtatacttttggatcatcaggtagagctgtaattt

SEQ ID NO: 21698 - DNA, 400 bp, Zea mays
  Clone ID: cC-zmle18900079c11a1
ggggtcacttcaaatatagagtaaaaaaattttccgggcgctgttcacaaaggtagcccgagtaataaacagggcggctttaataaagtttaaaaaacgaagtaaggggttgctgttggctccttaagctgggagagccctggggaacttctctctagggtatggttcttaacatattttcagctttttaatcattgggccaacgaatagatgctttcaggaataatgcaaatacatttgcgggcgcccacaaaccggagaaatagtcacagggaaccaaagaaatggggcattcttaggacgagcagcaagacgttttttggttgacgggttgcccgcggatctgcacggtcgctggcctaccgttggccgcggctggttggctggccctcctatcctt

SEQ ID NO: 21699 - DNA, 450 bp, Zea mays
  Clone ID: cC-zmle18900079c12a1
catcacgagcacggggggcggtcttaagccatcagaatatgataacagcttttgataattgggatgccgtttcctgacaccgggcaagatcaacttacaggtgaccatatttgacgtggacggcaaagaaaagaagacaagacggtaacagctaacacagttaaaacctcactgtcaatacaagagttgggtcattcttattttttgttgcagcaaataggtctcaagggaaaaggaaaatcactgaaacaaccatataactcttttaagcatgcaccagctcctgaatgtgtgctaatcagggctcagtgggggtccttcgtctcaaacaagccatcagggccccatgggaactccttgttgcggatgtgcagataggggtacgccggcggctcatcgaagtgggggtggcccttggacaggttgtacgccgccaggagggtgcaggtc

SEQ ID NO: 21700 - DNA, 549 bp, Zea mays
  Clone ID: cC-zmle18900079d01a1
attgagtttatattaattaaatatcttttttttggcattgttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattc

SEQ ID NO: 21701 - DNA, 496 bp, Zea mays
  unsure at all n locations
  Clone ID: cC-zmle18900079d02a1
ctcttttttttttggggcagaatcagcaaagggggggataggcctttgcctttctctatcagtagaaaactatatcagttcgtacatgtataatctgttatatatactgatactgtatgtatctgtggtagctcattcaaagttctagtagccggcatatacagacgcggtgaacatgaacgtatctcgttacaatttacatgttctttctaatcacttgattcagaacagtaaaaagatggaaattaagaaaaggttccgtcactacacggagaagaggtttgacctctatactaggtggaaataggatggaaggaagaggggtggtaaacagtacaggctactctacctatacagccacagagacgtctctctctgatgttgcggtagcgcgcggngccgcctcccccccaaactactcgctgcccacgggggccggcggcgttcgggccgcgccgaccagctcgcctctcacatgacgctgcaggagatgggg

SEQ ID NO: 21702 - DNA, 249 bp, Zea mays
  unsure at all n locations
  Clone ID: cC-zmle18900079d03a1
aaaaaaaaaaaacaaaacaccggccccnggtaaatttaaaaccaaaaacccatacccaaaaaaaaaaaaaaaaataaaaaaacaaaaaaaaaaacaaaaaaaaaatacacccacacaaaaaaaaaacaaaaaaaacaaaaaaccaaaacacaaaaaaaaaaaaacagaacaaacaaaaaaaaaaaaaaaaaaaaaacacaaaaaaacaaaaaaagaaaaacacacaaaaaaaaaaaacaaataacggac

SEQ ID NO: 21703 - DNA, 275 bp, Zea mays
  Clone ID: cC-zmle18900079d04a1
ttctttttttttttttttttttttttcatttagggaagtgggggtttttttttttctttaataaccaaacccatttttcgtatcacccctatattaagcttggtgtacggacaccaattcattttgacacatcgagagcatcatatgtacccactgaatgggggtgatattatttttgataacaccggcggaaaaaagtttttcacgttacgtgccttggcattagtgggatacacctgagttttcgcttatctgagtggtttatttctaggcac

SEQ ID NO: 21704 - DNA, 216 bp, Zea mays
  Clone ID: cC-zmle18900079d06a1
ttttgtttttaccatacaatcgtaagcagtcaggggattggggctattttattaactgcaaaaactaaaaacaaaggacccgaaacaccaagattacgcttggagcacgggaccaaactcatgttggcaaacacatagcatcaaaggggcccactaaaacagggagatatctatcactggttaaccggaggaaaagatgattttcacgtgacaggc

SEQ ID NO: 21705 - DNA, 149 bp, Zea mays
  Clone ID: cC-zmle18900079d07a1
acccatctatcttaatcggtcagggaagtgggggttctttattgactgcaaaaacacaaaacaatggccccaaaaggccatgactacgacaggagggcggacgcaaacccaccaaggcgtacccactgcatcagaggcccacacagaaa

SEQ ID NO: 21706 - DNA, 157 bp, Zea mays
  Clone ID: cC-zmle18900079d08a1
acccaactatcttaatcggtcagggagttgggcgttcttttttgactgcaaaaacccaaaacaatggccgcaaaagcccatgattacgcctaaagggcggacgccaactcacaacgacgtacccacggcatcagaggcccacacagaaaaagggaga

SEQ ID NO: 21707 - DNA, 167 bp, Zea mays
  Clone ID: cC-zmle18900079d09a1
ttttgtttttttcatactatcttattcagatagggggatgggggttttttatgtactgcaaaaacccaaagcattcgtcgcaacagacaaagagtaggcttggtggacgggacccaactcattttgacgtacagatggcatcaaagccgcccacagaacagggggga

SEQ ID NO: 21708 - DNA, 249 bp, Zea mays
  Clone ID: cC-zmle18900079d10a1
ctctgagtttatcatactatcataagcggacagggagttgggggttttttattaactgcaaacactagacatctatgggcgcaaaagactaagaatacgcttgttggacgggaccaaactcatcttggcgtacaggtagcatcagtggcgctcactgaaccggggagaactgttctactcctgaaccggaggaacacatggctttcacgtgacgagcataggcatttatgggatacgacctgtgtttcc

SEQ ID NO: 21709 - DNA, 526 bp, Zea mays
  unsure at all n locations
  Clone ID: cC-zmle18900079d11a1
ttttaccttggaaatgtacattactcagtgaaacggcagcggagttctagatatgaggagatggcaagcataaaccccaattcaaatccgttcccaacattgtcaccaacccaacgcgaagataaattattcactgcatgcaatacgccaagcacatgcacaagcccacatattacagaaccaaatgaggtgcaaacttaagtgcccaatgaccaaaatagcattatgacaaacttagaagccctgttcgatcaggtaatcgccgagcctctccaccaccatattgcattgccctggagtcattggctcatcatagataccgataatcaaggacatgccagttttcttgatagtaatgcctccagtgcccttctttcctcggatgacaactccaggttcaccttggatcaccatgtacttcgtacctccaacaaaaagaccagttggtgcaagagttccaggttcatcaaagtcctttatcatcccagcaacctnctcaggctttaactcggggaagttctcgact

SEQ ID NO: 21710 - DNA, 562 bp, Zea mays
  Clone ID: cC-zmle18900079d12a1
gccggagccccggttggaggttgttgacccagcggaggcggcagctggggccggggcgcctcagacctgcacgagtacgccgccgacacatgcgcatgcacagagaagaagcagggcacgcacaagagagagagaaaagaaatggttaatcaacacccatcgccatagcccatcctacatcaatccatccccacgcacgcatgcatctacatatgcatgcatgcatgcatgcttggggatcggatgcacccgccaccgcgcaaacctgagacctttgctaagaaatcccaccggcgttcaccaaacaagcggacgaaccataccagctgagcgtcttcctcctctgtccacgggcccttcctcatcgccgccgccggcacctgctgcttatcactgttgccgctgcccctactactactgccactactacggtcaccaccgccctgcagcttcttgctcatcttgctcgctgctgccggtgtcgccatcgacgactgatgatgaggataacgatcgtccatcggtcagccttcgtgctcttcctttaatttttcgcagcgcg

SEQ ID NO: 21711 - DNA, 340 bp, Zea mays
  Clone ID: cC-zmle18900079e02a1
ggggggggggggtttttcgaagaagttttattcaggtcacgagcttattggcgtaattcgtacaggagctgagtgcgtgcacgtacgatagccaagtacgatgaccctgcacaaccaggcaaccacagacatacataagggacgcaggcaggcaccaacgggcgtggatgccggccgccgggcggcttaattagccctggcgaggaagctctccctgcgctcggggacctcgccggggcaggggttgatgtcctcctcgaccctgggctcgcgcaccacgaagccgtggccgccgtggtgaccatggtggtggtggtggtggttggcccccgcccctgag

SEQ ID NO: 21712 - DNA, 360 bp, Zea mays
  Clone ID: cC-zmle18900079e03a1
ttttataataaggagagacacggtcggggccatggggtatgaacagacttctggcatgcctaatccaaatgtgtgtacacacatatgcatgtgccacaccctacttgacaggcgaaacacgcacgaacctgaacccaagaagggactgcgctcgggcatggagggactgcacactgacgacctgtgctactctgtgtattacggacccgaccctgtacgcgtgcctggtatccatatagggcgttgtttttatggttggaccaccaccacacgcttgatggattctgagccacgcgtgcgtggactccaagtccgaccctcagacggacccgtaggctgacgcgtgagtcctgccgggca

SEQ ID NO: 21713 - DNA, 200 bp, Zea mays
  Clone ID: cC-zmle18900079e04a1
gttcatcataaaatcataaggggggagggggattattctttgacgtgtaccccaaagaccacaatgaaaggacgcaatagcccaagattaggcttggtgaacagtcccaaattcattttgtctaaaagaaaccatcaaagggtcccattgaaacggggagtatatatcttttgctgaccgggaggaaaagaagattttca

SEQ ID NO: 21714 - DNA, 214 bp, Zea mays
  Clone ID: cC-zmle18900079e05a1
gttcaccattctatcttatggggggagggggtttattttttatcgtgtactccaaaaaccaaaaggaatggtcgcaacagaccatgactacgcctggtgagcggtcacaaactcatcatggcgaacacatagcatcagtggcgcacacagaaaaagggagaaacgtccctaagcttctccggcggataacatgggtttcacgtgacgagcatat

SEQ ID NO: 21715 - DNA, 292 bp, Zea mays
  Clone ID: cC-zmle18900079e06a1
ttttgagaacaccaaacaatcgtaaggggggagggggaaaatccttcatcgtgaaccccaaaaaccaaaaagaaaggacgcaacagaccaagaatacgccaggagaacggacccaaactcatcatggcgaacaggtagcatcaaaggcgcccacagaaaaggggagaacggacccacgcctaaaccggaggaaaagaagagtttcaggtgacgggcagaggcactaatgggatacacgccgagcgtccgctgacctgagagggccatgcctagggacagcatggaaacaagg

SEQ ID NO: 21716 - DNA, 111 bp, Zea mays
  Clone ID: cC-zmle18900079e07a1
ttctttttacacaatttaatctttagggggccgggtggttttttttcactctttacccctacaccccaaagcattcggccaaaattcccatcataacaacaaaagggcaaa

SEQ ID NO: 21717 - DNA, 160 bp, Zea mays
  Clone ID: cC-zmle18900079e08a1
gatcacaattttattataagggggtagggagtttattttttattgtgtactccaaaaacccaaaacataggccgcaaaagaccaagattacgttagatgtacggatccaaactcataatgagcaacataaggcatcacaagcgcatattgaaaaagggag

SEQ ID NO: 21718 - DNA, 235 bp, Zea mays
  Clone ID: cC-zmle18900079e09a1
ttttgagatcaccatattattttaaggggggtgggggtttattttatatcgtgtactccaaaaacaaaaatgaaggggcgcaaaacactaagattaagcatggagaacggaaacgaactcatgatggttaacacatagcatcaaatgggcaaactgaaaaggggagaaatgatgcctggctgacaccggagaaaagaagactttcaggtgacgagcataggccataaagggatac

SEQ ID NO: 21719 - DNA, 218 bp, Zea mays
  Clone ID: cC-zmle18900079e10a1
ttttgttttcaccttaatttttttaggggggagggggtttatttttggtcgtgaactgcaaaaaccagaagtattggtctcaaaagactatgattacgcttgaaggacgggcacgaactcattttggtgtatacatagcatcaatggggctcattgaataggggagataggtccggcgcgttaaccggaggaaaagactgagtttcaggtgacgagca

SEQ ID NO: 21720 - DNA, 550 bp, Zea mays
  Clone ID: cC-zmle18900079e11a1
cctggtcaataaaggatggggaaagggacagttctcggtacacggagtacaatgtaatttggccaaatataactcgtctgccattattgactacctgttggacaagatgcattctaaactataagatattttaatttagtaaaaacaatgcatctaaaaaaattataatttagaatagagagtaaaatgtatatgccaacagaagatcgctatttgacaatgttccatcctcaccaaacgactgctgcatcgcggacttggttctgccgtttgatatgatgtggagattcgcagcgcaggcgaagtatggagtagttcacaagttcttcaaggcaaaacatgtttgccacacttgatcatcagccaccaccaccaatggacatccagaacattcacaagctttctgagttgagtagcagcttcatgtattgtgactttgaggattactaccatctttggacaagatgcgcttattagccacaatagatgtcatctctagttggtgccatctaatgccttgatatcagcctgtttgagctcaacaaacttc

SEQ ID NO: 21721 - DNA, 509 bp, Zea mays
  Clone ID: cC-zmle18900079e12a1
tttttatctcatagaattaaaatatagggcaaaaggtctatttttgaacaagttttatggaccatattttcatgtggtcttgagcgttttacggactaagttgaagcaacaagtccataaagtatcagttcagcccgataccgcatacagatcatggattggttacagtagttgatactgcctgctgggagcggaccaataccaaatcacttgatttcctcagcagaagtgaggcgagcggcagagcgtcagcgggtcatcccaggatgcatgtgcggcggcacggcggcggcggcgcgcccctgcctctccatgttcgcatgccatcctatgctcatgtcgaagcctcgcttcttgagctcgcggtactcctggcagagcgcgcagcactggcagcagcagtgcacgcagcagtcggagcaggggctcacctggaggccgtactgcgcgcgcatcttggcgcggtagaagcaggagtagacgcactgacagctcgtgagcagcatgac

SEQ ID NO: 21722 - DNA, 388 bp, Zea mays
  Clone ID: cC-zmle18900079f01a1
atggcggaatccccccaaccccaaccgaaaaaaggggaaacagcgaaagaaaggaagaaaaaccaaagcccaaaaaacgaaaataacaaaagaaaaacagcaaacccacagagcaaggggggcacaacacaaggccacaagggcaaaggggacagacgcgggggcccaccggggaacccgggaacgggccccgggggccggccagcccccccaaaaggcccagacacccaggctcgccacccgagggggagggggggaaccggggaaaaaatggaaacccgttacaaagccacaaaacaaaccagccggaaacacaaaaggaaaaaccgggggggccaaaggagcgaacgaaccaacaaaaaaagcctaggggccccggcccccaata

SEQ ID NO: 21723 - DNA, 56 bp, Zea mays
  Clone ID: cC-zmle18900079f02a1
ctctttttttttttttggactctttgggggaccgggtgatttttttaccggttctt

SEQ ID NO: 21724 - DNA, 69 bp, Zea mays
  Clone ID: cC-zmle18900079f03a1
attttcttttttttttattttttttatagggggtttagcgtaatttttaatgttttttcggacccctgg

SEQ ID NO: 21725 - DNA, 161 bp, Zea mays
  Clone ID: cC-zmle18900079f04a1
gatcatcatacaaaattaaggggggtgggggtttatcctatggcgtgaactccaaaaaccagacagaaggggcgtgatacacctaaattaggcaaggagaacgggcacgaactcaggttgataaacagacagcatcaaatcggacaactaaaagggggggg

SEQ ID NO: 21726 - DNA, 223 bp, Zea mays
  Clone ID: cC-zmle18900079f05a1
ttcttcgataaaggaactaaacactggggctaggcggtttcaccaaatgtgtatttacatgcaaggactaccatccaacctgatcagttgcatgatggtaactcaaccacaacaaaaacgtgcacaacactccccccctctcagacctcagctacaagaaaacatcaaatttaggactacccagggatttagattgtgcattttgacccacgcgtccgtccac

SEQ ID NO: 21727 - DNA, 492 bp, Zea mays
  Clone ID: cC-zmle18900079f06a1
tttttatacttttcttcttctcttctgggggttttgtggttttttaattcggtttcccccccccccccctttttaacacaccaaccaatcacaccaagccaccaccacacaacgcaaaaaacacaccaacccgcccacgggggaacaaaaaaacaaaccgaggggggggcagagaaacccccaaaaacgggcaaaaaaaagagaaaacggggaaaaaaaaaccccccccggggggggggggggcccccccaaaaaaaaaaaaaaacttcccccccggggggccccccagggaaggggggcgcggcgcccggggccccccccccccccaccaagaagagacaaaaaaaacgggggaaaaaaaaaggccaaaccgcccccggggagaaacgagattccccacaaaagcccaccccaaaaaaaccccgggaaaataaaaagaaaacccgggggggcacaaaaggggagccaccccccaaaaaggggggggccccc

SEQ ID NO: 21728 - DNA, 210 bp, Zea mays
  Clone ID: cC-zmle18900079f07a1
gatcacccttctattttaagggggcagggagtttatctttcattgtggactccaaaacccaaaaacaatgggcgcaaaagcccatgaatacgccagttgtgcggacgcaaactcatcagggcataccagtggcatcagaggcgcacacagaaaaagggagaacggacgcgctgctatcccggcaggaaaccagaatttcaggtgacgagc

SEQ ID NO: 21729 - DNA, 276 bp, Zea mays
  Clone ID: cC-zmle18900079f09a1
ttttgtgttcaccataatatcataaggggggagggggattattttttatcgtgaaccccaaaaaccaaaaggaatgggctagacagaccaagattaagcttggagtacgggaacgaactcatcatggcaaacacgtagcatcattggggctcattgaaatggggagataccacctacaggtgcaccggtggaaaacaagtttttcaggtgacgggcagtggcattaatgggatactagctgggtgtacgcttgccagagggggctcaagcctagga

SEQ ID NO: 21730 - DNA, 142 bp, Zea mays
  Clone ID: cC-zmle18900079f10a1
ggggggagggggtttatttttgatcgtgaactgcaaaaacaataatgatgggtctaaaaccacaatgattaagcttgttgtaccggaccgaactcatctcgggtgatacgaagcttcaatggggcccattgaaacggggaga

SEQ ID NO: 21731 - DNA, 472 bp, Zea mays
  Clone ID: cC-zmle18900079f11a1
catgtcgtgctaggtcatgggtggtgtgcctatgtacccaccaccgtcatgacgaccacttttactgcttgcctggcccatcgtagttctggtctggcaggtatagatgcctctgcgcgcccttgcctgtgagcaccaccatgcgaatcacaccgcccgagctgccgtcccacttgatggcttctgagagcgcgcccttgacaaacttgatgccttcctcctcgctcatgttctccctccagtttgcgtcgcagtatccatagatgtacgttgagcctgagccgccaattgcgtatgactgcttgtgcagggagcctccgaggggaatcgagtatacctgtccgccgtggcggtggtcccatccggcaataatgagtccagctgagagttggtccttgttggagtagcagagctcttggaagatggctgctgcagtctgtgtggtcggtggctcgtcgttggtggtaccgta

SEQ ID NO: 21732 - DNA, 410 bp, Zea mays
  Clone ID: cC-zmle18900079f12a1
atagggggttgggtttatttttattgtataaccccccaacccctcctttggtgatgtgggagaaaaaactaatacacaggcgaaaacacacacaaactaaaaaaggcaagcggccaaaaccaaacaaaaacaagcgaaaaagcaaagtcccaccaccccacctggatccgggaaaagtgcacaatctaacaccacaaagacaaagaggaaaagaagaaaacccccacaagccaacagatgcctatatcaaaaaggcaaagggatgctggggcgggcgctgaaacacattaaaggaacaggaggcccatggtgaaacagaaaaaaaggggatgggggaagaaggagacacacactcctcatttgcaaacggggaaacagccggtaataccgaaaaagaaccgggagaccca

SEQ ID NO: 21733 - DNA, 410 bp, Zea mays
  Clone ID: cC-zmle18900079g01a1
gtccgccaccgaaaacgaaagatctattccatgccattatgccaagtagatggtcacagttgctaaagggtaattagccttctttttaccggggccttacaagtttaggggggagcactatttcacaacacttttacatttacgttactacgtatgggccggatctgactcagggacgatccctcctccttaccactttacttgctcatgaaagcgatgcccttttgaatgctctcgcccagttccttttttggcggttccagaccagcttttttgaaatcattcaaagggccaagcgggaggatctccttgggtccaccacgggcaagcctcactttcgttgcaaagaacggcagttctgtcacctcggatgcaacatatgagcatttcacgattccagctttgccccg

SEQ ID NO: 21734 - DNA, 367 bp, Zea mays
  Clone ID: cC-zmle18900079g02a1
ggggtaaagccggatgattaatcacaaattgcagaaaacaaatgggttccaaaccaaaggcactgagcatttggacatggattgcctacaactttgggatctccagcttaacattgcctgaattggacagcaaatactataacattttgattaaccggatggcgggcactccggggtttaatttcttttttctatgaacacattgctttctttagaggttcctggagttttccactcttggatgccccaacggggatgtcacatccacccaagaaccccccctccatgtaaaactgcgggaaggggggcccactggagtactcctttagcccctgcccgagcgcctcgttggcgaacacctttagcg

SEQ ID NO: 21735 - DNA, 443 bp, Zea mays
  Clone ID: cC-zmle18900079g04a1
gttccaacaaaacaccataattgggcaatgcttagctttgaattcttgagctggaatggaacaaaacaaaatatcttgggcatttaacttgttcaaaacaagtagaaaagctgaacgaacattgccaactgacttttgggagactacagagccgggttacagcttatttcagaggaataaaccgcgaggggggggggggacccataccgggcctgccatgcttgaccggcttatttgagatggagaactcacccggggtgtggcccatcatcttaggcttgatctcaacctggttgaagggcttgccgttgtaaacaccaacaatgcttccaattattttagggacaatgatcatgttacggagatgggtcttgactggctttgggtttttaccaagaggagcctttttttttcgccttgcgcaaccttttgatgagcgccct

SEQ ID NO: 21736 - DNA, 311 bp, Zea mays
  Clone ID: cC-zmle18900079g05a1
ctccttatttaattacttttctcacttgggcaaatgatatttttttttttacatactccttaatcccctaaactttataccatcctccaacaaatttcttcccccagcaacccttaacacccacgggttcccacaaaaacaatgcccccgaacacagggaacaccccccttcccctatatagagcaaacataaaaaatgcgcactataatgcccaacacaactactgaccaaaaatcgatgtccactcaaccaccccccaaaaaaacccccccccattaaaatgcatccacccggggggccccaacaaatt

SEQ ID NO: 21737 - DNA, 469 bp, Zea mays
  Clone ID: cC-zmle18900079g06a1
aaacatgaatatagactgggtataggggatataaaaatagatatagatagatagagagagagagcgcgcgcttggccctctacctctgacctatgtctccatgcatcattagctagcttacatggcaattaattacttataattccatcatatgctcatgaccagtccgtatatatggcgggcgcatgctgcacgggcatgagatctagctaggtcacatggacggcggggctgtggcggttgaccaagacgtcgaccacgtccctgctgggcagcgtcgccggcgcggctgcttctgtagcgcaactcttggtgggaaccgccgccatctgtgttactggtgggagtcggcccgggctgagcttggtgacgttgacgacgacgtgctcatctgcagctgagggaagcttgccggcagccttgccgtcggcaaccggcagcggcgtcttgttcatgtacaccacgtaca

SEQ ID NO: 21738 - DNA, 337 bp, Zea mays
  Clone ID: cC-zmle18900079g07a1
ctaattttaaattttttaaaaaaattttttttttattaggaaaagggtatttttattttcgctaataactaataccaaatcatttaataatatatttaatactataaaaaaaaaaaaataaaaataaaactcaaaaaaaaaagagaaaaaaattataaaaaaaaaaaaaataatagaaaaaaaaaaaaaaaaaaaaaaaaattaaaaaataaaaaaaagggagagaaaaaaaaaaaaaaaaaaaaatataaagaaaaaaaaaacaaaaaaaattaataaaaactaaacaaaaattaaaaaattagaatataataaaaaaaaaacattaattaactac

SEQ ID NO: 21739 - DNA, 408 bp, Zea mays
  Clone ID: cC-zmle18900079g09a1
ttttttttttttttttttttttttttggggttttgggttttttttttttttttttttccctctttctcttttttttttttttttgggcggccggaccaactggttttcccccaaaaaccccaaaaaaaaactttttggtttacaacaacccccggggggcccaaaaaaaaaacccccacccgaaaacagaccccccccaaaaggggggccccccccccccaggggggggcccgggggccaaccaaacaaaaaacccccggcggaaagcccccccccccgggccaaaaaaaaaaacaaccggggaccccccaaagggacaaaattgcccccctggacctgggggcccccttaacgaaggccccgcaaaaaaccctccttttcgggcccaaaaaaacccccttccccgtt

SEQ ID NO: 21740 - DNA, 488 bp, Zea mays
  Clone ID: cC-zmle18900079g10a1
gagggtgtcatgggagttgggatcttcatcacaatttttttagagctagatcatatactcatatgacaagcagcaagcattcaggagaacacagttaattcactcttgtaccaacacaaacagtccgcatgacttgagataccaaacatagcaaataataagcagacagtttgccttgtcttcgctatgatgctcctggttatttcttgccacgcagcttcgttcccagggccctctcgagcttgccaatgatctgctggttgggaattgccttgcctgactcatactcctggatcacctgtggcttctcattgatcatctgagcaagctgtgcctgggtcaacttcttatcgagccttgcttgcatgagatttttcttcaggtcacttggaactcgctcatgggcgaggttctctgtgtcgccgtcgaggcgcttggtgttgagggatgtgccgctggacgccgccttgttcataccagcgttgaac

SEQ ID NO: 21741 - DNA, 592 bp, Zea mays
  Clone ID: cC-zmle18900079g11a1
ggcggcttttggcttctagcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgagggacgcagccgtgtggaggccgagctcgtagaggcgctcgccaacctcgaagcgcagaaggaggaggctgtcaaggcgctcgacgcccagatcgcctcgctcagtgatgagatcgtcaagagggtgcctcccatccgcgtgatgaaaccaaaccggccctgccttattctatgactatagttacatgaacatcataaatta

SEQ ID NO: 21742 - DNA, 375 bp, Zea mays
  Clone ID: cC-zmle18900079g12a1
tttttatagaaattatttttcctcagaggtcgcgggcaagcatacatgcattatctcagacttcgcagtggcgagctcgatcgatatatatgatgactagcatcagtactaaaatagtattgtatcagggacacacgtacggcatcgaccagagcaccatgcatggtccatggatcatatcatcattatcatggcttcatgggatgggaatggatcggagtacgtgcttaaccatgatcagtacacacgtatctctcggaggggcggcggtatcccgggtgatggccgggcgattaattagtagctgtagttcttgacgaacattccctccttggcctcggcaagtacacctccgacggcgaggccgtcgaggcc

SEQ ID NO: 21743 - DNA, 411 bp, Zea mays
  Clone ID: cC-zmle18900079h01a1
tttttgaaacacgaaatcacttgaacaggtatggggagaagattgttgcagtcacaatacaaattccctcggcattaagttataaacaaagcactgttacatgaggataagcaaatttcatagccaagagagtaagcgcagccaatgcagaccaatgttcaatttctttgtgagcatggaagcatgaacatggctacatcagttcttctcgtcttctgttttgtctgacttgtcttccttcttctcttgctctccctggctgtgcaatgatgccagcaaatctttaacagatggatcattgggatcaacaccaggaagcgaattaaggatagatgacacaaacgttctgtcttcaaacaccttactcatatcagtgtcactggacatgtttgcatcctggacagacatttg

SEQ ID NO: 21744 - DNA, 442 bp, Zea mays
  Clone ID: cC-zmle18900079h02a1
gggggaagcaaccggcccctcatgtatatactaattattatcttacgaggaatggagtggtgatggatcaactcattctattacacaaaccaaataaaaaagtgaggagtgagaagaagatggatcacttcattcctcaaaccaaacacacttttagtaaagacagttgctacaacctatgaagtgaatctgccgcttctataaatagtttatgtagtagttgcttcttttttctgtcgttacattactcacggaaacatcagctcaccaataggtcctgcgatcagggccaaacaacttgcttcttggatttttccttctatttggttcttgatagcacttgccaaatatattgtttagttaccctattttctttctcgagcatacaacatacattgggtcagttcgtcctggattaggagatatatcaagtgcctgggga

SEQ ID NO: 21745 - DNA, 525 bp, Zea mays
  Clone ID: cC-zmle18900079h03a1
tctgtcaaaaaaaaaaaaaaaaaaaaggggcccagaggaaattaaaaacaaaaaaaacaccaaaccccacaacaaaaaaaaaaaacaaacaaccgcccacacatccaccaacacaaaaaaaaaaaaaggcccccccgggccgccccccggtccccccccccgtccccccccccggccccccccccgtccccccccccgtccggggccccgggggcgcccccgggaattccggcccggcccccgggggggcccccctttcccccttggggggcctttttaaacccggggggactccgggggagggcggtcccccgggggaaatgtgtttccctccccaatcccccccaaaatccgacccggggccataccgggtaagcccggggggcccccaggggggggccacccccctttagtggggggggccccccggccccctttccaggggggaaccctgccggcccccccgctttaatgatccgcccccccccccgggagggggcctttggcctttttgcccccccgggg

SEQ ID NO: 21746 - DNA, 334 bp, Zea mays
  Clone ID: cC-zmle18900079h04a1
ggctgctttggctgtctgcgctggtgctgccggaggtcgcggaggcggggcctgggatctccccatcgctcaagaacttcctcctcagcatcgtctccggtggggtcgtgctcgtcgccatcgtcggcgccgtcgtcgccgtctctaacttcgatcccgtcaggcggggttgagctgcatgcgtcgttgtgtgttgttgtattgtacctatgtactgagatctctccccccgtgtgcttcccaatgaaaacagtgtttaatgcgtgaatgtgtaaatttcatttcatgccatctgtatgtatgagacggattcaacagcgcattcggtttcttt

SEQ ID NO: 21747 - DNA, 437 bp, Zea mays
  Clone ID: cC-zmle18900079h07a1
ctcttttttttttttttttttttttttgggttttggggggcaaaattgcactcaaatcactttattcagcactaatgttcgtctttgtacaatgatccgggacacggaagcccaaagggacatacatatacaagccattttcatcgacgagacaacgaccgcagtttatgcttgctatttgtaacagctaacataacaaaaattgggatttttcatcctatatttaacttcccaagaatgatggcctgcaccatgtggagcgaagctaacttcagcgacaggttcactggatgatacatctgtcgcctcaaactaattctgctcaagtttgtcatgaaagggctttgaaattattggcctcacgtcctctgaatccacgaggctctccaagaacgggagcaactcgatcagttcctgatctgaggggtcattaaacc

SEQ ID NO: 21748 - DNA, 392 bp, Zea mays
  Clone ID: cC-zmle18900079h09a1
tttttacacagtggtaatggacttccattatctgggtcgtactgacatacacagctgttgatgacgaaatatcaacaaaatacaggcagctcttgccctcaagactcgggcagagcacatccttcgtgtactgacatagacaggagggacaagaaaaggttacaaatcatacatgtggacacagcactaaaacaagcgttccacacagctaagcacggcactgatcactctgtctgatcccgtggagtgaagcggtgaacgatgcaactgaactgcacaggcggcgggcggcgacgacgagcagagcagggcagaggaattgatgaagggggagaggcccggtgggcggtgggggagggttcaaaagaaggaacgcttggcggagggcgccc

SEQ ID NO: 21749 - DNA, 518 bp, Zea mays
  Clone ID: cC-zmle18900079h10a1
ttcttttttttttccaaaaaggcaacggggttgggtaacaaacaaataaacatgacgctgatgcttgaatacatggacattgtacttattcaactacaagcatgcccatcgcttattacaatgctatagcaataaagggtacgtcgaaataaacagggtgcccatccagcactgatgactaaaatagtggtggcaaagagatgagtagcggtggggaaaattctcatacatggtcgcaatctacaacttccgtaccttataaaacatttggcagccattattgtcttacacaaaatctacagcagttcaccgtgcctcattttctaggttgcggaacccagtggtaaggtcgtcataaagtttcttaaacttgccgaccaaagcttcttcgccttctgcaggatcctcgaacttttgggatactaggcgataaaatagatcccccaaccgatgctttaagacactgtatgttattttatgggccgtcagtaccagctgcccgctccacagcctgattt

SEQ ID NO: 21750 - DNA, 559 bp, Zea mays
  Clone ID: cC-zmle18900079h12a1
ttttgactcagaaatgcgaacccaatccagatgggcatgcaagtcaacatgtctcaaaataacagtatagatacccaaacaacagacacagggcacacaaccaatagattttaacagatcgaagtatacgggcacaagtacaaaataaacgagggcacatgggaggacgcatcatttcttctttattgcagccttggtcaccttggcaccagttgggtccttcttctccacgctcttgatgactccaacagcaaccgtctgcctcatgtcacggacagcaaaacgacccagaggaggatactgagagaaggtctcaaccaccatgggcttagtgggaatcatcttcaccataccggcatcaccattcttcaggaacttgggctccttctcaagctccttgccagaccgcctatcgatcttggttatgagctcagcaaacttgacagcaatgtgggaggtgtggcagtccagcactggggcatagccattgccaatctgcccagggtggttcatgatgatgacttgggaggtgaagctagcagcctccttggcagggtca

SEQ ID NO: 21751 - DNA, 410 bp, Zea mays
  Clone ID: cC-zmle18900080a01a1
aagtgggcggggctcatcattttatgaccaaatgctgattccatttagatccatcttgtacactaaaccaaatccagcaaaaaaacacacacatctttatctcttctcgggaaaaaaaaaacatctggatccggagctagacgttttctcatggcagtttccactttatagtcaactttaataactgtatcatcgtttgcacatagctgaaagattgaagagcacatgaactttggcacattttcctatcttaatataatgagtcagtagttttcttgtacgttcgagagaaaaaaaactttatcacattttctctttctacggctgtaatgatcactttcttgtagcgttacctttggcttctagcatgtaacttcacgtgatcgttcgttgatcatcttgtaggcgag

SEQ ID NO: 21752 - DNA, 506 bp, Zea mays
  Clone ID: cC-zmle18900080a02a1
ggggccgggcgggggagattttatattgaagcgcaaaagtagcatcatacattacattcgacgaaatcggaaccctatacagcaaaggttcgattgcggcgagcacgcacgcaacgcaacgcagcgcagcaccagggatgatggataggatcttaaccgcttcacttttcgaagtagtcctcggtcctgcccttgaatccgatctggccgaaggggagcacgatgaacaggcccaggtgccacgtcactagccacagccagaactgggaggtgacgggcgggggcgtggggaaatgggccaactcctggccgatgctggagaagaagagccccgtgaggctgttgccgttgatggccgggacgctggacggccccatccagccgatgagcccgaagccgatgacgctcaggtccctccgcagccagtcccggggaaacgtcatgcaggtgatcctgccattcctcttcaggttcctgctcatcagggggttcctcgccgacacccg

SEQ ID NO: 21753 - DNA, 565 bp, Zea mays
  Clone ID: cC-zmle18900080a03a1
tttttaacataaagtataaaaacatcatagccttggcagtgcttccatcaaacagaaacatgagtattcatgagcaacatgaccaaattgtaacgcaaacagtctgccacccaaaaccacaaataaaaaaaaatccacaataagatgtctcttggacagctaaagtttggttaactgaactgacaatagaccaagaaaagaagctgacgacacctaggcctcccactgcatctttcaggccatgatcttggccgatctcatgtacaggctgtccacaaccttgccaacattcgtgatcgtttcaagtgtggcagggaagatctcctcagtcttgctgtcctcgaagatgatgaggcagccagcgccttgatcaagtgtccctgcgaatttcttgtcgaggatcatctgggacagcttcttctcaacatggttcattggcagctcaatcatctctgctatgtgagcaatctccacccttgagtagggctcaatcagcctgcagaggttctgctccaagagagtgtcatacagcgaggaaaggtgcctgtggacaataggatctttt

SEQ ID NO: 21754 - DNA, 305 bp, Zea mays
  Clone ID: cC-zmle18900080a04a1
gcgattaaacatactcggaggatacggtccgatgttcagcacaagataggcaagttcacataaggcactgtaataccctcaaaacacttgaaattcatgttccacgaagcaaagtaagatacgctaaagcaaaacgtcaggattcgcatccgcacttaagcaacggcatcgaggaaagccttcccaggagcacgcttctcaagtctgccgtggttgccgagcagctttgcgttgacaccatcaggaacaattctgccctcgctcttgtacttcaggtagtcagcgcggctgaacttggtgaagcc

SEQ ID NO: 21755 - DNA, 310 bp, Zea mays
  Clone ID: cC-zmle18900080a04d1
gtccgggcttcaccaagttcagccgcgctgactacctgaagtacaagatcgagggcagaattgttcctgatggtgtcaaggcaaagctgctcggcaaccacggcagacttgagaagcgtgctcctgggaaggctttcctcgatgcccttgcttaagtgcggatgcgaatcctgacgttttgctttagcgtatcttactttgcttcgtggaacatgaatttcaagtgttttgagggtattacagtgccttatgtgaacttgcctatcttgtgctgaacatcggaatgtatcctccgagtatgtttaatcgc

SEQ ID NO: 21756 - DNA, 552 bp, Zea mays
  Clone ID: cC-zmle18900080a05a1
ttttaactaactagtatcatctaatgagcacgcggggtgaggtcatttttacaagcaagcagagtgaattcatttttacaagactaggttacactgggactcttgctatccggagcaccatcaccttgcacaaagcagttagcgcccagttatcttgaccatccatgcaccacccaagtataaaccaagcaagggaccagccaggagcatttgtgtcaacgggtccgtcgaaggtgtaagcacagcagcagcaacaacagcaccaacaacaacatatctccagatcgaaagcatttggtcactagaaaccaatccaagttgtcccagcaaaagctggataacagggacctgaaaggaccctgtgctaaacatcagcacaagtatgaattcaaagtactggtctattgaccacaacgattccactgccccatctgcataattcacaaagaagttcaacgcagcagggctgagaaccgtgtaggagaagaaaatgcctagatagaatagaacagaagaacccacacaataggcccaagaaatttccgctcgtcc

SEQ ID NO: 21757 - DNA, 508 bp, Zea mays
  Clone ID: cC-zmle18900080a06a1
ctctttttttttttttttttttttttttttttttgtgattgtgttttttttttttttttttttttttttttttttttttttttttttttttttttttgggggcccaaaagggtaaaaaaaaaatttttaaaaaatcccgggggggggtggggaggtacaaaaatgcaaaatccaacacccttacccaaaaggggggggaaaaaaaaactttttttaagacttttttaaaaaaaaagggggggaagcccaacccccaaaggccatggggggggggaaaaaacttaaccttgggggggtaaaccaaggggccaaaaaaaaaaaaccccaaagggggggaaaactgggaaacaaaaaccacaagggggggtttaggggtaaaaagggggaagggaaccaaggaaaagttttccctcaaaaaagttaaaaccccccccccccccggggaaaaagggggctaatttgggggccagcccaaatttttttaaaaaaaaaaaaaaatatccccccc

SEQ ID NO: 21758 - DNA, 517 bp, Zea mays
  Clone ID: cC-zmle18900080a06d1
tatttggaacggccccatgggagtgtttgagttcgagaagctagtcattttggcactgaggcgattgccaagagggtaggggagcttacaaccacgaagggtgtcactaccatcatcggcggcggcgattctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctgctactcaggttctgccagctttgcgtgtcatcttgtttcggaccttgttgtatcactgcaaggctaaggtttactcctccacacatggactttcggggataggcttgccaccgcgttttgctagatgagtcgtgaaataagcttttacttcctcgctgctgtgggtgaagtgactggaattcggaaatttggaactaacaaaaccccccgtggatttgtatgatatgttttgtttgaca

SEQ ID NO: 21759 - DNA, 522 bp, Zea mays
  unsure at all n locations
  Clone ID: cC-zmle18900080a07d1
ttacaaatatacgcgtatgaaagcactcatttttcangactagcagcgattgaggtgaggatattcctttctattgactaataccatcaccttttggcgtcacaagggaaccacttataaaactatcataaaatattcttgctatatctggatagcggtcgctctatgtgctcctttctcaaagcatgcgcgaattggagtatctacagcctgccataggtatcgtgttgatcttcattgggacaaacatgatctttgacttttttggttatcatataccaacagaagctatccttgcaatcgcaactacatgtctgagtggaggcgtcaattaagtcttaagaaaccatcacaagagaagggggacaagtatactgatgcaacacacatgcaggcataagaaaccaccctgctccatatttttggccaatagccacattacaaacataattattataaacacttaaaagccagttaacatactgctttaattaaacaattacttggataaaaaaatctaac

SEQ ID NO: 21760 - DNA, 337 bp, Zea mays
  Clone ID: cC-zmle18900080a08a1
atctatatttttttcttttttttaatctcttttttttatgaaggggtaatggggactttaccattgcctgcagcttgccaacaaaaaaattgttaatcttacaacttgacattttacaataaaacattaacaaacacacacctgtaacccacctgcctttaataatcttgttatactgccactatggacataaaaaaaaccacttcacttcctgcacattttatttgataccctcttccccacctaaattacttaaggtcccttaagtttcaattttgtttccaacgtctaccccatctcatttacgcaacctactgttgttggtcaattaataact

SEQ ID NO: 21761 - DNA, 253 bp, Zea mays
  Clone ID: cC-zmle18900080a08d1
ttaacattcaccccaccacccttaacagtctgctaatttaatagcctacttcttctacccgttcaaacaagacctaaactcactgttgaaaatatctggaacaaggctacatcgcatatacaacaaatacacatgcaagacatacacacataggttgatgacacatggccggtttctaccactttctctaaatacctgtcgaagctctagaggcacaataccaggccctacctttatatgtactacatactga

SEQ ID NO: 21762 - DNA, 406 bp, Zea mays
  Clone ID: cC-zmle18900080a09a1
gcagtgcacttgatgggcttacaggtccgaggccgtcagaaagcaattaagcggcctcacgtcaggcatgcatctaaagctcgaaccaacaatagggacaacaacaccgtggcacgtacattaattatataccaccccccggccctgcagctgcaacgcgggcgtgctcagttgtggcagaccttggcggtgggcatggtgacgcagatggccgcgtacttcttcttcgcctcgggggtcccgttcttggggcccgccatggcggcgccggcgccgccgatggctgccacggccgccgcagcagccgcgagcatgacggcgcggcgtccgtcggcggcgggcctggcctcggttgctgctagcgtggcgggctcctggcagcggtcgaccttggcggacctgacca

SEQ ID NO: 21763 - DNA, 500 bp, Zea mays
  Clone ID: cC-zmle18900080a09d1
cgaagtgctagcgacccacgtccacacgacacgaaccacttccactttccagcagccgcaccacgcacccggcgcagagcgatggcgtcgctcaccatgatggcgtccttcgccgccgtggcggtggccgcgccctctcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtactctgccatctgcgtcaccatgcccaccgccaaggtctgccacaactgatcacgcccgcgttgcagctgcaaggccggggggtggcatataattaatgtacgtgcccggcgttgttgtccccattgttggttcgagctttagatgcatgcctg

SEQ ID NO: 21764 - DNA, 322 bp, Zea mays
  Clone ID: cC-zmle18900080a10a1
aggcctcgaagagtttggagcgtgaagacggccgggcgggcggcgtcggggggcgcggcggccagcaggttgagcagccccgcgcggccgtagaacttggcgaggaagacggtggcgttggcctgcgcctcggggctgtcgatccactgcaggcaggggcggatggtgcaggcgtcgctgcagcccttgcgcaggacgcggcagccgttgcagctcatccgcatcttcggtcggtcggtcctctcctcccggcggtggtggtgatggtgggcgcacagatcgcgagcttgctactatgtgctgctagcctatacgaatccgg

SEQ ID NO: 21765 - DNA, 324 bp, Zea mays
  Clone ID: cC-zmle18900080a10d1
cggattcgtataggctagcagcacatagtagcaagcctcgccgatctgtttttcccaccatcaccaccaccgccggggggagaggaccgaccgaccgaagatgcggatgagctgcaacggctgccgcgtcctgcgcaaggggctgtagtgacgcctgcaccatccgcccctgcctgcagtggatcgacagccccgaggcgcaggccaacgccaccgtcttcctcgccaagttctacggccgcgcggggctgctcaacctgctggccgccgcgcccgacgacgccgcccgcccggccgtcttccgctccctgctcttcgaggcct

SEQ ID NO: 21766 - DNA, 558 bp, Zea mays
  Clone ID: cC-zmle18900080a11a1
gcctcaacaaagtttatcatcaaacagaggtacaaagcaatgtataaagtagccagcaaattcatggcgaggagtaccatccatttccacactcaaaagatgcaacacatccaaggagaaaaagatgatccagacaatgagaactcaagagttcaccctagaacaacttaaaacacgcaaggcacaactcctgctcaagttcaagactcatgatcctttctactcaatcagatcatcatcgtcatcaggaagaggttgtgcagctgctgcagcaagctcagcttcatgctgctgctgcatagccatgtcgatggtaacttccggaggcttaagagcaacagcttcaacaaagtgaaggttcggatcaccagccagcttccttgcgaggtacaggaaaggtttctcaaagttgtagttgctcttggcagaaatttcatagtactgcagattcttcttgctgtggaaagtaacctgcttggctttgacctgcctgttcttcacatcaaccttaattaccgcagagggacaatgggggatgttttcacaggaccctgcaca

SEQ ID NO: 21767 - DNA, 428 bp, Zea mays
  Clone ID: cC-zmle18900080a11d1
agggttttgctgctctccgaccccgagctccgaatgtctcattatcaggcgcggcccccctcgcgtgggaccgggatggctctgccgaatcacgggaccgttcattaccccagcttcaagctcgctatcttccggcgatggtggaactggtaaaactacattcgtgaagaggcatctcactggagagtttgagaagaaatatgaaccaaccattggtgtggaagttcatccgttggatttcaccactaactgtggtaagatcaggttctactgctgggataccgcagggcaagagaagattggcggcctcagggatggatactatatccatgggcagcgtgcgaacatcatgtatgatgtaacctcaaggcttacttacaagaatgttcctacgtggcatatggacctgtgcagggtctgagaaaaca

SEQ ID NO: 21768 - DNA, 432 bp, Zea mays
  Clone ID: cC-zmle18900080a12a1
ggaggtattagtattacgaagaagttttattcaggtcacgagcttattgtcgtaattcgtacaggagctgagtgcgtgcacgtacgatagccaagtacgatgaccctgcacaaccagtcaaccacagacatacataaggcacgcaggcaggcacgaacgggcgtggatgccggccgccgggcggctcagttagccctggcgaggaagctctccctgcgctcgtggacctcgccggtgcaggtgttgatgtcctcctcgaccctggtgtcgcgcaccacgaagccgtggccgccgtggtgaccatggtggtggtggtggtggttggcgcccgcgcgtgagaccgtgtcgacctcctcgaacttctccttgacgacgtgctgctggacgccgcctccgtggcggccgaagccggtcggggccaccgacctgacc

SEQ ID NO: 21769 - DNA, 326 bp, Zea mays
  Clone ID: cC-zmle18900080a12d1
tgctcgagaggggcgggccggcggctcgcgcacggagcgggccacaccgcgcaggaaagtcaggaggcacacggctacgcccgcccaccacacaccccctggtaccacgggcacggtctgggccagacgggcgggggacataaccctgcaccgcagtccacagccagggagcttctcccggctactgaccgccggggcggatccaccccgtcggctgctgcggcctatgatgtcgggttgactggtggcaggtcatgactggtatgacggcacgcctcactctgtcaatacacatagctggactgataactctcgtaactatccac

SEQ ID NO: 21770 - DNA, 510 bp, Zea mays
  Clone ID: cC-zmle18900080b01a1
ttttgcattgtagttaagtgcttcctgatacaagggcaacagaaaatggtacattgccttgccgggtccatatgaacaaacacaagtccgaaattacatggccattattagccattgcgtctagcctagcttggcgagaacatcgccaagagcatctttggttgctgcgaagtatttctcggcctcaggggtgctcttgatcttcgcggcatggtcaagatcgtcgatggtgctgaagagcttgccggtgagctccttgaggctcttcttctcctccttgggcttggaagcgatgacggtcttgaggtcgtagcgcacgtaggaggcccggaggcggaggtcgttctggacgtacggccacgccttcttgtcgatgagcggcttgaggttgatgatgtcctgcgccgacgtctttaccctcgccgccgcctccgccggcgggagcggctgcaggtagaaccgctccttcaaggggaggtcgaagtccctcgcctggtcagagttgagagt

SEQ ID NO: 21771 - DNA, 542 bp, Zea mays
  Clone ID: cC-zmle18900080b02a1
tttttgaattcaatcatacaattgttttgtcaaggaatcggtgtggtaaaagttcggagccgtaaatttatacactgatgatctgcgtgtaatatggaatgaatgtggtaacatcacctttcgtcaaaatatttgtgcagaacatagttaagcactcgagattttcaaatggcgtcctcaacgagcatctcatctacttggcgatgacaccagaccagattcttctatacataccttactatctgggtgaccactgaccagggaccatggctaccaccttcgtttatatacaacatgacacttttcaaccttcacgatttccgactggaggtatagaatcctggattgcttgagcgaatgtagcaatcttataggtaaaaaacccaacaagcattggtattaactcaagctgcatgaaaccataatccggaactaatatctgattccatctgttatacatcatcacaagtaccactggaataagcaaccttggttgtgcagcagcactcttgacagtttctccagttccacctgctagggaa

SEQ ID NO: 21772 - DNA, 522 bp, Zea mays
  Clone ID: cC-zmle18900080b04a1
ggaacaagcaacaataataggggatggggaagtaaaagctcaccctaggcttcaaaacatatgcatgttacgtttaacagacaattcagaaacccaaaatggtttacgggattctcaaggtaaacataaaaaaagatgaggtccgttgtccatttaaccggctcgagccataataagcattacacaaattcatatctagaacaagctgtcggaggataccacacttaggccaccagagtgctcgctgtggttgactcatacttccaggtgggtggaagcttctttgtgcgcttgtagtagcgggcaaggcggtggatcctgctctccacaagaatgagcctgaatttagagtctttgtccttcctgttcctctcaaggggcttccttatcgccaccgccttcttgatgaggaagtacaggtcctcggggatttctggtgccagcccatgggccttgaggatgcggaggatcttgctgccggtgacgctcttgacaagggggataccgtgctggtcacggagc

SEQ ID NO: 21773 - DNA, 482 bp, Zea mays
  Clone ID: cC-zmle18900080b04d1
cccgtcgtctcctgaggtagacaccaatccgccgccatgggtcgtattctacagccgcgggaagggtatctgggggtgggggctgccgtacaagaggacgcctcctacctggctcaagaccgttgcctcgacgggaggagatgatcacaaaggcagcgaagaagggacagatgccgtcacagatcggcgtactgctccgagaccagcacggtatcccccttgtcaagagcgtgaccggcagcaagatcctccgcatcctcaaagcccatgggctggcaccaaaaatccccgaggacctgtacttcctcatcaagaaggcagtggcgataaggaagcaccttgagaggaacatgaaggacaaagactctaaattcaagctcattcttgtggagagcaggatccaccgccttgcccgctactacaagcgcacaaagaagcttgcacccacctgtaagtgtgagacaaccacaacgagcactctg

SEQ ID NO: 21774 - DNA, 570 bp, Zea mays
  Clone ID: cC-zmle18900080b05a1
cctccttttttttttttttttttttttttctttcttcttgggtttgggtcttttttcctttccccctcccccttctccgttgtcccctccctccgcccccctcaccgggggaaaaaaaccccaaggcccggggggccccgagcgggggagggggggcccccccccccacatttccagggccgggggggggggggggcgcacccgaccccagggggggggcccggcccccccgtgttccggggcgggggccccccaagcgccttgggggcccaaacacccggccgggggggggggttgtaccggggggggggggccccccccccccgggggccagggaaaaatgtggcccccgcctggggcgccggggggggggggacccctccgggggggggcggggctcctggacccccgcccccccggggggggggggccccagggccacccccgccgcggggagccttcttcaggtggggggggccccgggggttcggcctcacaccctagggacccccccccccggggacgggccgctccaggaaacgcccccccctggggggacccccggggggg

SEQ ID NO: 21775 - DNA, 434 bp, Zea mays
  Clone ID: cC-zmle18900080b05d1
gccttgacacgcagactaggcgccagccttctgcgaactttcttttcccttaccaaggaagaggcagggggctgggggtctcacccggcgatgcaccggcacgtcacctccggccgggcgtccggcacggacgggtcccccttttcttaccagatggtcgtgaaatcccggcaccagagggtcgccgagggcagatcccgcctcgcgcgccttatcctcttgcaggcgctgcacctagtggccggaggcttgcttctatagctgtcgttgtccaagggggcggcggtgaacaagttcgtcgtgctgaccatggccgtggcattcctggctataggggtgggggaattagggcgaatgctgaccatgccacagctgcttcggctttacacaagctcgccatccattgctgatgcattctctgagacgtgcattta

SEQ ID NO: 21776 - DNA, 83 bp, Zea mays
  Clone ID: cC-zmle18900080b09d1
cacacgacacaacacaaagcaaccacccaaacatcccatttcaatttaaaccaaaaaaccccaacccagggcacgggggacac

SEQ ID NO: 21777 - DNA, 344 bp, Zea mays
  Clone ID: cC-zmle18900080b10a1
aatcttccctttttttctctttttattttttacaaactttttataaatcaatactccaacttaaacctacaaacacccttacataaccaacaccaataccaacctacccttcaagaacaacctcgtacacccccatataaacacaaaacaacttcctccaaaccacaaccacatccccaaaaaaatacaaaaaaaaccccaccaaaatgaaaaaaaaaaacatccccaaaaaaaaaaaaaaagccaaaatacacccaccaataaaaacccccaaacccaaactaaaaaaacccaccaagcaaacaccaaaccaacaataaaaaaaaacttatagaccaccccct

SEQ ID NO: 21778 - DNA, 199 bp, Zea mays
  Clone ID: cC-zmle18900080b10d1
ccccacgcgtcctcgtacgcgtggtaaaaaaaaaaaaacaaaatttttattttttaaaaaaaaaaaaaaaaaaaaaagagaaagttaaattattataaaaaataaaaaatcaactccacaaaacatttatcttcttgttcccttactcttcccctattttcttctttttaaataaatatcctttcttttctttactctt

SEQ ID NO: 21779 - DNA, 496 bp, Zea mays
  unsure at all n locations
  Clone ID: cC-zmle18900080b11a1
tttttgaattattaacatcaacactagcatagttgccacagggggcacaagtcatctcattacccaaggcaatggtaggttaatgttggactagaactcggatcctagagatggatcggagaatgcacaaggaacagaagaacatacgtccccgataacagtttgatgggcaacaccacaatcgtctgcatttagccagtaacgccgaacatttcatgccatggcgtacttctgggtccagctgcgggctgtcgcctcgtacttaggccgatccgtcttgtacatgtgagcaatctcagggacaagagggtcgtctgggttgggatcagtaagcagggagcagatagaaagcaaaaccttagagattgtcaaagcagggctccactgctccttaagaatgtcaagacatatgcttccattactattgatgttnggatggaagaccttcgtcttaaaagaataccttggaggcttgaaggggtagtctggcgggaaa

SEQ ID NO: 21780 - DNA, 592 bp, Zea mays
  unsure at all n locations
  Clone ID: cC-zmle18900080b11d1
ccattccttccttgttccttccccagctccgcaggcatgctcatttgccttttcctccgcgcccccgatccacatgggggatcggggggcttgtcatggcatccaaacgtatcctcaaggaattaaaggacttgcaaaaggaccccttcaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcactggagccctgctttgacaatttctaaggtcttgctttctatctgctccctgcttactgatcccaacccagacgaccctcttgtccctgagattgctcacatgtacaagacggatcggnctaaatacgaggcgacagcccgcaactggacccagaagtactccatgggatgaaatgttcggcgttacttgctaaatgcagaccattgtggtgttgcccatg

SEQ ID NO: 21781 - DNA, 165 bp, Zea mays
  Clone ID: cC-zmle18900080b12a1
acctaacattttggggttttgggggtttttatttttaaacaacacattattgtaaggaaccaggtaaaacccaaaaaacagaggaatcaaaggggccaaggataacccctggggtgtatactacaaaacggctcaacaattacaaccacccggacgcgaggaaaa

SEQ ID NO: 21782 - DNA, 377 bp, Zea mays
  Clone ID: cC-zmle18900080b12d1
gatgtagttgttgagtaactctgtagtatataccacaatttttatttttggccccaatgatacctcaaagggatgggtgtaaactgaaacattaacattacctgacgcctgaccatgaacacagttccaaaaaaataatgttcgggtataaaaagagcaccgtgcaatgattaataaatacagccttcttcttgattaaataaaagccattcatctattttttccattgcaaaacaaacaaacaaacagacaagaacaaagttaatttggatcgagtatttcaatccattaaccggctgtccttttcagcaagaaaaacccttacctttaggaaacgagcaccgtcgcgcaggccaccgtcattctaggagttgccc

SEQ ID NO: 21783 - DNA, 298 bp, Zea mays
  Clone ID: cC-zmle18900080c01a1
cgcatgaacaactaccatagagggagttgggggttctttaacgctaatgccctattcactgccacaggccacaaacagcggatagagaatcacatcgtgagccggcgactctatttagcttatttactgcacgagcaagatagctcactactggtggggggattcctcaggtcttttaactcacagcattggacgcttcggccacaacttttgccccatgctccattgtttgggcgacgccaacaagctcagcgggcattgtctcaacgactttgaatcgagccagaggaggacaaac

SEQ ID NO: 21784 - DNA, 197 bp, Zea mays
  Clone ID: cC-zmle18900080c02a1
gggtgtcatttatgggggtttcaaattgatcaccgcaccataattcaagtttcatttccgttgccatgtttaagcccaacaaataaccctttttggggaaactaaaacaccaattggattattggaagcgttggttttaagctgaccaaaacaaacggacatcggacttgggtgcccattgaacaaaccttttggag

SEQ ID NO: 21785 - DNA, 467 bp, Zea mays
  Clone ID: cC-zmle18900080c03a1
ctttatcatgacaaaggtaaatttaaatgctcagggcttaggattgtttaagtccgctaccaattcccgagtaccaaattcctaggcaacaactttggcatcaaaactatggtttttgaagtacatacggagcagtctagttgagaccccaaagaaacatccagattcaacaaaataaaatggggatatccgggcgtcatatttatgcattttcggccatagggtactcaaagaccacatctttcccacacagcctgcggtagaccgtattgtaggtgtccagcttgtattctgtgttgttcctctcctttgggtccaagaagatcttgatgatcttggcaccatccagacggtacctgacacgcttccccacaatcttagctgggaagacaacatcctccaggatgccatcatggacagcagtcatagtcctggtgcgagggcgctgaacagctgaacccttcttg

SEQ ID NO: 21786 - DNA, 232 bp, Zea mays
  Clone ID: cC-zmle18900080c04a1
cattccggcaacacccccaataagctactagtgctatggatggtatgacagttacaagcgacgaaaaacatctgctcgctgaagaacaaacttaacattgaaacaaaatacaactaatcgactagtataacacatcatctgggacatttggtgtaagaaacttctgtggatccttgaacaactctacgtaaatgtacttaggcaacaccctctccggaacaggctcaaatgg

SEQ ID NO: 21787 - DNA, 360 bp, Zea mays
  Clone ID: cC-zmle18900080c05a1
ggggattttataaattgctttaccttacacccaagactcgtattaagacgaatcccgcccctgcaaaacacaaaaaatttggcccagacctatttatctattcacaggtaaaaggaggccatgctgcgcacatttgtcggtatgaaggccacgtcaaccagtaagacgagcaggtctaccggctgccacaacattaacaatctgcggcggcggctggggaggcaacaccagcggcagtatcatcagctagacggggagggaggcgaacacaaggaacaccccgatgctgaagtaggtggaccccatgacccttttgccgtggaaatacccctgaagttgagcgccggtgcctatgccgct

SEQ ID NO: 21788 - DNA, 375 bp, Zea mays
  unsure at all n locations
  Clone ID: cC-zmle18900080c05d1
acagaacacaaaacacccggaacaggcaaaacttaaaanacaccgcaccaccaccaacccccaaccagaacaaaccaaccgaaatggacagaaccaaacccacaaccacaacaaagaacagacggaaagcagacataacccaaaagaaacagggacgaacaaacacagaaggaaagaccaaaggcagaaaccgcacgagcacaaacaaaagaaaaaccccatgcaaaggaaaaccaccagaaccacaacaaaaagcaagaacacgaaccgcccacaagcaaaacagaaaggggggaggaagaaacaaccaagggcgcccactcaaaagaaaccaagccacccaacgccggcaggccacaccaaaacccccgcaaa

SEQ ID NO: 21789 - DNA, 324 bp, Zea mays
  Clone ID: cC-zmle18900080c06a1
cttgggacctggggagcgaccacaccttttatggcatatagcagcgagccgacgccaaccaggggtcagggggagttttaagagctggtccacaaaatacccacccgaccagaacattcctgacgagcaccatactttggtgccctacaagccgggcgaggaccgcaagctcggctcccttgcctgtgggagggtgaaatgagcggacgacccagcggcggtcgtcgctttgttgggggagaactcccgggacgccatgattgacggcggagccaactcagggtgcgggggctcacgcgagcacgcactctacactcatgggga

SEQ ID NO: 21790 - DNA, 509 bp, Zea mays
  Clone ID: cC-zmle18900080c09a1
aaaaaacctaggaacctatagagcggccagacaaaataaaaaattttaaatttttaaagaaaaaaaatcaaaaaaagggaaaaagggaaaaataaaaaagaaaaaaaaaaaacaaaagaaacaagggaaaaaaaataaaataaagaaagataaaaaaaactcgaaaaaaaaagaaaaaaaaaaaaagaaaaaaaaaaaaaaaaaaaaaaaaaaaaaaaaaaaaaaaagaaggaaaaaaaaaaaaaaaaaaaagaaaaaaaaaaaccaaaaacaacaacaaaaaaaaaagagaaaaaaaaaggcaaaaagaaaagagaaaaaaaaggaaaatgaagtacaatgcaattgataaaaaaaaagataaaaaatgaaataaatgaaaaagggaaaaaaacaaaaaataaaaaaaaaaaaaagactaaaaaaataaaaagggaaggaaaaaaaaaacaaaacaaaagaaaaaagacaaaaaaaaaaagaaaaaaaaaacaaaaaaaacagataat

SEQ ID NO: 21791 - DNA, 369 bp, Zea mays
  Clone ID: cC-zmle18900080c11a1
tttttgtttttttttttttttactttaaaacaacggcttccgggaacattaaccaatgaccacctacccaaaggaaggaaagaacaggagcatatcggctaacaatgtgcaaccaccttactatggcgaatggcaactcatgtgtacccttcgacatacactacaacacaattcaagacgatgatcctagatcgatcatggatacccacaaccaacaacaaattcaaaggaacattggcgcccaaaaacggttttcttgaaaccccaccgtggtggacaagcaggaaaacgttcgtctgcccattgcgtactctctgctccagctgctggccgtaaacatggtactatggccggccctttttgtccatg

SEQ ID NO: 21792 - DNA, 524 bp, Zea mays
  Clone ID: cC-zmle18900080c12a1
ataccatcagcttacctatattcaaacggcacactataaataatacgatctacaatataaaaaagtacagtagttcacccatatatgatcactacaaatacaatgtaaaaaggtacaatgtacacccatatatggtcactacaaacaccttttggactatttttgtagtgtagattatattattcataggtcactatgaacaccttttgcactattttgtagtgtagattatagtttaaatatgggaaagagtaagctactgatggtctaattctcaacccaccggtatcagcttacccatcgcctttactgcaatgaattcccacaccaccatggatttgaaacccttttggaaacttcattttcccaaaaaaaaaaatgaactaattttccttaggaaaccttggaagaataagttcccaaactagccctaatcaaattgaaaatagaaaatggaacttcgcaaaaaaaaagcaacatgaaattgatctccaggggaactcatgctctcgtgcccctagcta

SEQ ID NO: 21793 - DNA, 428 bp, Zea mays
  Clone ID: cC-zmle18900080c12d1
ggacgcgtgggagctgcagcatgtaaaaaagagaaaaaagatttgactttctagaggaggaggcctttgccaggatgggggcgctctcatggcaggccacgcaataataaaaagatgattattgcgtgccgggggaggagatcgcacggaggttgatgtttttggccccgggttctcctccctcatcttgttccgtgttcctgtatgcgttgcttccgctcctgttggaccgctacgcacgccggatttttgcatagagcacggagatctacaacaaaaacatggagctacgacgcgattcccaaggtacaatcgtaattatgtttcaaacaatttttaaggcgggctgcgctccttctattactagcaacgctttatattgctgtgcttgcataataaatcgaaagaaatcctgacaccaatcgaac

SEQ ID NO: 21794 - DNA, 488 bp, Zea mays
  Clone ID: cC-zmle18900080d01a1
aacaaaagatttatccgggcatgggggctctttgtggtagacccagctgaccacctagagctagctgaatacagattgactcagcatgtggcaacgtaggaacacatgtttatagacgacattcttcgtactaatagccaggcttggctgctaaccaaacgacaaccacgagatcgcaacgatttaaaaagaaaaaaactcagaagcaaatggacaccagaaacccgtcttactcattaagcactccatccttgtcctcgatagcatccaacttcctccaagcagacaagattagccagcttgcagtccttcgcaaaaggggctgcattctcgccatcaaagcagcgaagaacggatttgggcgagctagcaacggcgtcttcagaagcacacaagctctggtagatgaggatcccacttccaggcagcttctgctcgaccatgttgttgcagtcataagcctcccgaccaagttccctttcccatgt

SEQ ID NO: 21795 - DNA, 549 bp, Zea mays
  Clone ID: cC-zmle18900080d02a1
gcaaaactatgcatctgagggctacgggtattttttaactgcctgtttacagttacacccttcaaaatgaaaagtgttatgcttgagctaaaactgttatacaaatgaacaaacctgacttgtattttcttggcatatacaacttgcttgacacaacaccggaatttgaatctctcttctgcagcctgtacacttaatatacacaactaaaaatcactctccagcaagtaagaccagatgtgtgctgaatcctgtgctcaatttatgctttagccttgagatattgggggagcaaatgcctgtgtggtcatcttgcttcttaactcttcaaaagctttcatgctttctgcatcaaagcccccagcaaactgatgaacccggaaagcgaaccttacaccctggagaagcaaaaactctctattgggctctttctcagtgccttttaatgcattaagttctgaggcaacccttttcatattacttgtttgcaagctgaacagatgccactttgatcttggccactacttcacatactgacagccagtcaaa

SEQ ID NO: 21796 - DNA, 336 bp, Zea mays
  Clone ID: cC-zmle18900080d04a1
ggggaaaattaaaagcggtttacccatacccccacaactagtaatatgacgaattcatcaaatgcaaaacattaaaaaatctggtcaatacctacatataaattgacaggtaacaggaagccctgttccacacatttattggcttaaaggtcgcctcaaccaacaacactagcaggcataccgccagccacaacattacttattgtaacggtagctggggaagcagctccaacggcagaattaatacttaaacagggaggcgggcgaacacaagaaactcccctattcctaaataacgtggcccaaagtacctttttgtcaaaaaaaccaggttct

SEQ ID NO: 21797 - DNA, 299 bp, Zea mays
  Clone ID: cC-zmle18900080d04d1
aaaaaacaccgcacggaacaccaccccccacaacggacaccacccaccgagacaagagaggcaacaaaaaaccagaagaaagaaacacaaggaaagcccgagccaacgagaacgaaggaggcacgacaaaacaaaggaggaagcgcccccaagaaggagaacacaccaaaaggagcaggaggcaacagaacgggcacaacaaagccaacaaaaaaaaccacaccaacagaaaggcagaaacacaacaacaacaacaagaaccacacgaaggagagaaagcagaccagaaagcaccccac

SEQ ID NO: 21798 - DNA, 250 bp, Zea mays
  Clone ID: cC-zmle18900080d05a1
ggttcaacaaaatcccacaccgaccagatcatgccggaagagcacctaactctggcgacctacaagccagacgagtaccgcaagcacggaacgttcgacttcgcggggctccaatccgcggcctacccgacgccggccggcgctccggatgaggagtactcccgccacgccataattgacagcggagccaacttctggagcggatactatcgcgagcacgcacccgtcgcgcttggggccggtggcgcac

SEQ ID NO: 21799 - DNA, 64 bp, Zea mays
  Clone ID: cC-zmle18900080d10a1
acaaaaccttgtatcctctagaacgaccgcccttatccacttttttttacattttttttacaaa

SEQ ID NO: 21800 - DNA, 68 bp, Zea mays
  Clone ID: cC-zmle18900080d11a1
caacaaaaccttggatcctctagaacgaccgccctttaatttattttttaaatttttaccccacccaa

SEQ ID NO: 21801 - DNA, 402 bp, Zea mays
  Clone ID: cC-zmle18900080d12a1
atggggcccggggggccacccgggaaaaccggaccggggcctgggggcgacccaccttggccaaaagggagggaaaaaaaagctggggggaaccagggcaaaagatgctacctgggggaaaatggtatccgtacccaattccccacaacagacaacccggaaacaaaaaggggaaagccgggggggccaaaggggggggggaactcaaaataatggggtgggccccactgccccctttccagaggggaaaccgggcgggccaaatgcataaaggaaggggccaacccgcggggaaaggggccttggatattgggccccaccgtgttttttcttttaaccagggagacgcggcacacttgatggccatacccccccgggcccttaaaaatggaaagaaagggg

SEQ ID NO: 21802 - DNA, 167 bp, Zea mays
  Clone ID: cC-zmle18900080d12d1
cacccgccctgtagcgtccctttaaacgcagggggggggggggtgacccccaatttaaccattaaacttgccagagcccaagcgcccgctactttcgctttcttccctacctttatcgccacattttgacgtctttccccattaaactttaaattgggggctccctt

SEQ ID NO: 21803 - DNA, 332 bp, Zea mays
  Clone ID: cC-zmle18900080e01a1
aattcctctaaaatatggggggagggggaattttaaaattcaattacccccccccccacaaaaaacaaaaaaaatagggcacgacgacaacaacacaaccggcacgagcgaaaacgagaaaagaaaaaacagaaggggagaggagggcgccgagaagaaaacaaccgcccgagggaagaacacaaaagggggggaaaggaaagaggggaaggggaaaagacaacgcagggagggagggagaggaggggaaaaaaaacccccccaaaataccaaagcggggggggggggggggaccccccccaagacaaagaagtgtcggacacaaaaaaaca

SEQ ID NO: 21804 - DNA, 451 bp, Zea mays
  Clone ID: cC-zmle18900080e02a1
ttttaaataagacttcccttcagttaaggacaggggtatgctcatgtttcgctcaagcatacttgaatgagcaatctctgttttccagtatgactaatcttgtcaacataatttgtctttttttaaataaaaaaagacaatcagtgcaatttcgatgtaataattcaatattaagcccatcaaaagttaacagcagcaatggatgacaggcatctttcaagcaatgcagttaatgtggtgaaacaatgccgcagagatcaagcccttcagagattgatcagagctgacatgagctgcgatcagagctgatctcaaatgtaaaggacagtacatgccatgccaagtgaccacagaaataaacatcaaccagggattactgtgaaattaaatcatacaatacgctccagctccctcgcatagctgagcgtctggttgatgagctgcaaggatg

SEQ ID NO: 21805 - DNA, 228 bp, Zea mays
  Clone ID: cC-zmle18900080e03a1
gggcccaaggttttttttttttatcacttttcccccttaacaacaaacaaaaaaagggggacatccctttttaattataaacaaaaacacccaccccccagggcttacccccggactgccctgggacaggcccaataaaaataacagaccggaccgtggcccaaaccagaaatttccgacccctaccctaagactgcaactttacctcatgagctggcaacacatggg

SEQ ID NO: 21806 - DNA, 403 bp, Zea mays
  Clone ID: cC-zmle18900080e04a1
agaacaagacacaaaaaacgggagacgggaaactttacaaacattttatgcaacaaaaaggcaccattctgcttgaaaagcaccatatatatacctgccccgggatagggcttaaatcaaccggttattgaagcgcagatgctgctccctaccaggcaagaaaaatattcggaataaacatccaaggaattattgatgccggactgtgtgcgcatggaacggcgatagggcgcctattaggaatccagcggtccccggacccattcaggtcctgtataatgtgctgggccctgctgactgccgattccatagcgggtgacctacatgtacattgatcatgccacaggcttccacgcttagctttcaagcccgaaggttgttcttcttgggcgcttccacctgc

SEQ ID NO: 21807 - DNA, 390 bp, Zea mays
  Clone ID: cC-zmle18900080e04d1
tcgactctttaaaaaattggctgacccattacctgaatatattttccaaacatgaatattccatctggggtaggataattattaactgattttccaattccactcgcaacagtatgacctaagagagcagcctaatgaaaatctgtcctgggaaaggacattatgtctttgtctaaatctgacgaggagactactgcaaataggaaattggctaatgagctggatgataaatggagtcttccaatattcaacatgagcactagattagaggacatgaacagatatgatgatgaaagagcaccttacaggcagccacaaattaacaaaccttcatcgagtagctctggaatggaatccatacatcatcatcttgatgcttacttttcacaa

SEQ ID NO: 21808 - DNA, 131 bp, Zea mays
  Clone ID: cC-zmle18900080e08a1
aaccaacaccccccaacacaccacacacccaacccacccaacacaacaaaacaatccaaacaataacccacaaaccacccacaccacaccacacaccacacacaccacacaccacacacaaaacaccaacc

SEQ ID NO: 21809 - DNA, 388 bp, Zea mays
  Clone ID: cC-zmle18900080e09d1
caagaacacaccacacacaaccaccttcaatttccaacacccccaaccacacaccggggcacaggggcaaaaaaaaaacaagaaaaaacacaccccaaacaaaaaaacaacaaaaaccacaacccaaccaacctcacaaaacaacacccaaaccaacaaaccaaaaaaacaaaaacaccacacacaaaacccaccacacaaaacaacaaaccaacgaccaaacccacacacaaacaaaccaccacaaacaacaaacaacacaacacaaaaccacaaccaaaaaacaaacacacaacaaaccccgaccacccaacaaacaccaaccccccaaaaaccaacacccacaaaggcagaaaaaaaaaggacacccaaacacataacaacacca

SEQ ID NO: 21810 - DNA, 313 bp, Zea mays
  Clone ID: cC-zmle18900080e10a1
ttttgactcgacactcagctaactgcggggccggggggaactaaaagctgatcagtcccgcccgggcgtaaaacttgatgagtatgacggcagcctccgcactacgctctggactggcgttccactggaagcaggggcagcatggtgctagcttgaaagaagacattgggcttgacacggcggtcgatgcatcctattcccgtcttagatcggcccgacctctccaaccgacggcggtctgctatggtgggcgcccagatcccgagctcgcttctatcctctgatagcctatacgaattcgccggacgccttt

SEQ ID NO: 21811 - DNA, 408 bp, Zea mays
  Clone ID: cC-zmle18900080e11a1
atcgagataaatcggaatcaaggtattgattatttctaggaaacacacgtcggtatgagggcaccattatcgagtacatctcatatgtaatctaaaagatggcacctccaacgatgggttgctgcctcgacaagacaggattcatcaaagagaactggttgtatggcagcaattgttgctgctgtaggaaggcggcgaccaatgggttagccactaccaatggattaagtaactgttgtcgctgttgtaggtacccaacacaattcgacagagtcagttggatgaatggaagcatctgttgcaagtaggcaacagggtttgccacagctagttgagtcagagctggtacaatctgttgcaacaattgttgtagcaggtatgtaagtgcattgcccacagcgagcgggc

SEQ ID NO: 21812 - DNA, 570 bp, Zea mays
  Clone ID: cC-zmle18900080e11d1
ggaaacacaccaagcgaagcgcactagcaacgacctattttcatttgctaccaagatattagccctcctggcgctggttgccctttttgtgagcgcaacaaatgcgttcattattccacaatgctcacttgctcctagtggccattattccacagtttctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcattcaacccacttgctctggcaaacgtagttgcaaaccagcaacaacaacagctacaacagtttctgccaacgctcagtcaactagcccatggtgaaccctgccgcctacgtacaacaacaacaactgctttcatctagcccgctcgctgtgggcaatgcacctacatacctgcaacaa

SEQ ID NO: 21813 - DNA, 343 bp, Zea mays
  Clone ID: cC-zmle18900080e12a1
actgggggccagagggtgcattacataaacaagctgcagagcctgtcaaaaacaagatttattctacgttatctcatcggacacagtttgcgatgagcctggttcaaatgtaaccaccacatggggctggggcaaatcatgatacagagttatagacccaagacaatcttcaggctggctgctcataagtgaccctgctattggagtctgaactaggatcatcaacagacagcttactccacctttcccaagaaacccttcatctctgctggggtcaaaactttgaactcacgaacaccttgaataattcccatttcaatggtggtggaggaaatttgcccct

SEQ ID NO: 21814 - DNA, 394 bp, Zea mays
  Clone ID: cC-zmle18900080e12d1
ccgtccgggaggggcaaatttactccaacaacattgaaatcccttttatattactctgatcgtcagttcaaacgctgggagccgagcacatatcaaggctttcttggaacaggcccactcagctgtctgttgatgatactacttacaaacaacaattagccaccgtcacttatgagcagtcctccctgacacattgtcttggttttattacttctgaaactgatatgctccagcaccatgtggtggctacatttgaaccaggctcaacgcatactgtagacaatgagataacggatgatgaatgctgtatatcacatactttgcatcttgtttatgtgatacacgttcttgcgggcggtatcaaacatattaactaaacctcccttaaagacag

SEQ ID NO: 21815 - DNA, 198 bp, Zea mays
  Clone ID: cC-zmle18900080f01a1
gggccacaaaaagggaaaaggggcccccccccgccggggggggaaaaaaattccccgccaacaaaaaaccgccgggaaatatccccctttaaaaacccctccccttttttccgggggggacccccccccgccctataccaaaaaggtttacccccccccctttaacaaagggaaaaaaaaccccgccccggggggccc

SEQ ID NO: 21816 - DNA, 469 bp, Zea mays
  Clone ID: cC-zmle18900080f02a1
atgcatagctcatcctgggcatggggaaatattataccatacgattaatacaacgtgtggtgattcttgatctatcgagttctcactctcttcaagagggatttcaagaaattccattgcacgttttcctgagttctgcaatgacatttctatacctcctagctcgccatatatcccaacagatgcgaaggttgttactcccattgagttcggagagctgtagttttaggacatctgaatgcatagatcgttaaacttttgctgcttccgctggtacaccagccctctcagcaacaatctgttcatagaggtctctaatcttcagtccaatgatggtctggaagagacctgtcccgttgttgctacctgggaagtctgcatgctttagcatttgttgtgtcacctctccgtagaacttggttgaaaggttgcttagatggctctccacgtagatgagctcatctagtct

SEQ ID NO: 21817 - DNA, 457 bp, Zea mays
  Clone ID: cC-zmle18900080f03a1
gggggttggggtttttttttttttttttttgttaaaaaccaaaacttataattggtaaaaaaaaagaaaaaaccacatcgaaaggggagaataaaagggaaaaacaaaacccaccgggggggcaaaaaaaagaaaacaaccgaaaaaagggaaaaaaaaccgggaaaaaaaaaaacccggaagggaaacaaaaacccagaaaagggcaaaaagaccaaaaaaccccttaaaaaaaaaaccgggactgaaaaccaaaaaaacgggaaacggggagaaaaccccaccccctgccaaaaaaaaaaggccccgggaggaacaaaaaggcggaaaaaatttgcaaaaacagaggaacgtgggagaaaaacccaccccacccaaaggaagaaaatgggggaaaaggccgacccgaggaaaagaaactgaaaagaagttccaaaaaaaaaaaaaaagaacgcgg

SEQ ID NO: 21818 - DNA, 542 bp, Zea mays
  Clone ID: cC-zmle18900080f04a1
tttttagagaataaatccagactaagcgtcattggctgtctccagaaaggtctcgattatactcatataatacccaagataagtcgcaattcagctaagcaatcatgcatggatgctgtagcaaagtataaccgctcaggcgacacctataaggctataaccctttcttcacattaacggaggtaaaagaaaaaggaaaactcaaccacaagttgcagttcaccccgacctggtgcctcagttggagctcgctccgaaaaccctgattctctcttcgacttcagcgctgcagcaggggcagcgagtgatgcctttatcttcatgcagcttattgcagccaacacagaggacctggtgggcacactggagtaggatcacacacgccgccgccttcttgcaggcaacacagtcccggcggcggcttggcttctgggctggtggtggcagcgaccggttagatgcaggttgtggccgcaagatggcctgctgcttggctgcctgcgccgcgcttcggtagctgtgccaggaaagttggctgatgg

SEQ ID NO: 21819 - DNA, 578 bp, Zea mays
  Clone ID: cC-zmle18900080f04d1
caaagaaccatatggcgcgtgaactcattaagcagacaagtttgatttttacgcagcttaaggagcgaaaggaggtgggggcagggaaaggcgatacatgctgctcgcaagcttggtgctgatcttactgagctgcgtgtgctgcggatggaacatgatgagaaccagcggcgtaagaaggaaaaacaggtgatggaggatgacacaatgaagcgccttgctcatctggagaatgagctgaagaaaaagagtgggcagcttgacaggagtaatgcaacagttcagaggctggaaatggagaatgcagagatacgtgctgagatggaagctgcaaaactgagtgcatcagagactgaaaaacaatgccagggtctcttaaggaaagagaagaaggatagcaaaaggcttgaagtctgggagcgccagaaagcgaagctgaaggaggacattgctgaatgcaagacatatattacacaagctgaaagggagcttgctgaggtcaacaaggcaatataaaatatggagaaaaagatgcgagaagacacaagggtcaaagaagacaacatggtgcttttgga

SEQ ID NO: 21820 - DNA, 493 bp, Zea mays
  Clone ID: cC-zmle18900080f05a1
ccccaaacatctttgggtatgggtttatgcttatatatatataattagagcaaggctaatggtttatccggtagaccgattgtaaactatacatctcatcttactaataatcagtttttgtatagtaacaagctcttacttaggtgcagaactatacacactcctatttaataaaagtaattgggcctatatttttatttttcttttcctcacgacgagacatacgtttcgccagtttctcagaataatgtattgtataacattatacacgtctgctagctcgatctcactggacttttgagagcaaattaagccatgcgtagcgtatcctgtggctattgtctcggttggggtcatcagagcctttttgcaaggctcggaaatcgttcgaggatccatgtcactcccctgatgattaccagtgccaaatccccgggcttggcggccggctccacgcagtttcgaccatacacaatctgcagccgctgctgct

SEQ ID NO: 21821 - DNA, 516 bp, Zea mays
  Clone ID: cC-zmle18900080f05d1
tccgggacgcgtgggcgcgccccttcgtggggcgggagcttttggtttgcttcttcggcgagttcatgggggccaggggcccctacctgcagttcgtcatcgacgacatctccgccgaggactccgccgccgtcggggtcaccctggcacctggagtggagggggaggccgcttcccttcagcaggggatgcagcttctaccgcttgctcggttcttcggtctcggagcagcagcagcggctgcagattgtgtatggtcgagactgcgtggagccggccgccaagcccggggatttggcactggtaatcatcaggggagtgacatggatccttgaacgatttccgagccttgcaagaaggctctgatgaccccaaccgagacaatagccacaggatacgctacgcatggcttaatttgctctcaaaagtccagtgagatcgagctagcagacgtgtataatgttatacaatacattattctgagaaactggcgaaacgtatgtctccgcttgagga

SEQ ID NO: 21822 - DNA, 478 bp, Zea mays
  Clone ID: cC-zmle18900080f07a1
ttttgagatggacaaggcatctttttatggatattgggattcattacgtggcatccatttgcaccacggaccgcgccataaaaaagcacgggccgacagggatgagctatacaaaccttattaccagtaaagttctggtctgtcatatacagtagtattagttacctcggtcggtacttaatcaggcacaccacattccaagtcattttaatttgcacgtcacgagaaataccatactactacacggcagcattatattacgtggccgtgagtccgtgacggttaatgtcacatggtattattgctcaggcaatcactgtggtctccacggcggtggtggaccggaggacggtctcgacgcggtcgccgccgctgccggcggcggcctcccagagctgcggcagcgccttcttgatgttgtggatgctctccagcgccacgtgcgccccttggaccagcgccgagctccccacgatga

SEQ ID NO: 21823 - DNA, 495 bp, Zea mays
  Clone ID: cC-zmle18900080f07d1
gggacgcgtgggccctctgcagctacaggacagcgtttttgtttgtggctgacagggagcttgcgtggggttggggtgcatatgacactgacggacggctaatactctaagatggaggcgtacgctgcttgagccaagtttatactgcttgctgttcgacatggacgacactctgtacccactgagccttggcatcaacctagcatgccgcaagaacatacaggagtacatgctgaacaagctgcggatcgaggagagccaggtccccaggatgtgcctggacctgttcagggagtatgggaccacaatggccggcctcaaggttttggggtaacggttttgactactacgactttcacgcctgcgtgcacgcgacgctgccgtaccagaaggtgaagcctgacccggtgctcaggcagctgctgctttccctgtcgcataggaagatcatttttaccaactccgacaaggcccacgctggccagagtccctgag

SEQ ID NO: 21824 - DNA, 346 bp, Zea mays
  Clone ID: cC-zmle18900080f08a1
cttggatcctctagacggccgcccttttatactaccgtaattatttttgcattccacttgttggggataggggacctattcctccttaaaccactatagccgtctcactttattaaaacatctaaagctaaaaccatcaatagggacaacaacaccgtgggacgtacatttaattatttaccaccccccggccctgcacctacaacacgggcgtgctcaaaaatggtataccttggcggtgggcatggtgacacaaatggcctcgtacttcttcttcccctagggggtgccgttcttggggcccaccatgtattctcctgccccgacaatggttgccactgccccc

SEQ ID NO: 21825 - DNA, 385 bp, Zea mays
  Clone ID: cC-zmle18900080f08d1
cgaaagttgatgctggacgctcaattaaaggagctttaatttatcccagaaggagtcacaaaggggacaggaggaacttgctgaaatggaggaaatcactccaaagatcagtacaatgacagcatatgcatactttctaaaagaaccctgaactcaggaagaagtttgacgatgaaatccgtaacgataactggggatattgaagagattggatagaactctcatgatgccatctccatgtccgtgaagaaccaataatcttcctgtgccctgaaatgggtggtttccatagcatgtgcacggcgcttgcgtggaatgcctacagaatcgactgtgtcaagccttcttgattccgaaaaaacatgcttcgtctgacctcatcata

SEQ ID NO: 21826 - DNA, 387 bp, Zea mays
  Clone ID: cC-zmle18900080f11a1
aggtattagtattacgaagaagttgtgattcaggtcacgagcttattgtcgtaattcgtacaggagctgagtgcgtgcacgtacgatagccaagtacgatgaccctgcacaaccagtcaaccacagacatacataaggcacgcaggcaggcacgaacgggcgtggatgccggccgccgggcggctcagttagccctggcgaggaagctctccctgcgctcgtggacctcgccggtgcaggtgttgatgtcctcctcgaccctggtctcgcgcaccacgaagccgtggccgccgtggtgaccatggtggtggtggtggtggttggcgcccgcgcgtgagaccgtgtggacctcctcgaacttttccttgacgacgtgctgctggacgc

SEQ ID NO: 21827 - DNA, 556 bp, Zea mays
  Clone ID: cC-zmle18900080f11d1
gtccgcccacgcgtccgcacagcaatccacacaagcacttcgttgtctttcgggcgctgcacacagacacaccaagcgtgggcaccaatggcttactaccaggaggtggactactgctcggaggaggtgaggtcggtggcccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactggatgtgcagggtcatcgtacttggctatcgtacgtgcacgcactcagctcctgtacgaattacgacaataagctcgtgacctgaataaaacttcttcgttatactaataccc

SEQ ID NO: 21828 - DNA, 291 bp, Zea mays
  Clone ID: cC-zmle18900080f12a1
attaaattatttttttttttttttatttatatatttttctttatttttaattcattttttatcaaccaacaaacaagtaaacacacatactaacaaaaacacaaaaacccacccccaacaaacaaaaaaaaaaaaaaaaaaaaaaaactccgacccccaaaatataacacacaacaaaaaaaaccaaaaaaaaaaaaccaaaattggctaaaataatatttataaaaacaaaaaaaaaccccaaaaaaaaaaaaaaaaaacaaggacaccaaacaaaattttcttcttttt

SEQ ID NO: 21829 - DNA, 531 bp, Zea mays
  Clone ID: cC-zmle18900080f12d1
gtccgcggacgcgtgggaagacgacttgtttcattgattcttgaagagatcgagcttcttttgcaccacaaggtggagggtgtcttgcaactgcggatcaagctgcggctgcggctcaagctgcaagtgcgggtaatatatatgataatatataagtgcaccgtgcatgattaatttctccagccttcttcttgtctagttaatttccatttatttattttttccattgcaaaacaaacaaacaaacagacaagaacaaagttaatttggatcgagtagttcaatccatttgcgcgctgtccttttcagcaagaagtaccctgacctggaggagacgagcaccgccgcgcaggccaccgtcgtcctcggcgtggccccggagaagaaggccgcgcccgagttcgtcgaggccgcggcggaatccggcgaggccgcccacggctgcagctgccgtggcaactgcaagtgcgacccctgcaactgctgatcacatcgatcgacgacctggatatgaatattatctatctactt

SEQ ID NO: 21830 - DNA, 475 bp, Zea mays
  Clone ID: cC-zmle18900080g01a1
ctttttcccccccttcccccccccccctttggaaagtgttctttttaattcccttttcccgactacccccccccttggttcacccctataaataataaaccgtacggggggcccggggggcaaccccggaaaaaccgggaccgaaaccggggggaaaaaaagggaaaaaaaaaaaggggggaaaaaaaagggggaaaaaaaaaggaaaaaaaaaaacccggggggaaaaaaaaaacccaaaaaaaagccaacaaaaaaaaaaagggaaaaaaaaaagagaaaaccggggggggccaaaggggggaaataaaaaaaaaaaaaggggccggccaaaaggcggaaaaacaaagggaaaaacaggggagggcaacggaaaaaaaaaaagggaaaacccccgggaaaaaggggcaaaaggaagaggcccccgggcccttctcaaccgaaacaaaaaaaggggcaaaaaggggaggccccc

SEQ ID NO: 21831 - DNA, 530 bp, Zea mays
  Clone ID: cC-zmle18900080g02a1
gcagccacgaatatggaagtaaaagaaggcgctctagtctgagagagacatattaaagtaaaataacaggtactctagtctgagagagtaagacaggcaggcaggccataacaaagattctcagcttcttcaatagaagaaacctagaaccttgcctcctacgctcttccggcgggcctcctcgtggtccatgatgcctgccgaagttgtgaggacgatgtatccgaactgcctggacgggagcagccttgcagtccatccctcaatgtctttcacgccgatatcaaagcgagggctgatgacgccgcacttgttcagcctcccgttgagttcgaccacgatcttgcccgatcggtggtcatcaacgtactcgaactctccaatgtagccgtggcgctgcatgaccgtcaggaacttgatgatgaccttggacgacggcctgatcatgacctgcctcttgccgatcttctcagcgttgtacatggacttgagcgcatcgttgagcacactgaccctcaccatgctgacct

SEQ ID NO: 21832 - DNA, 449 bp, Zea mays
  Clone ID: cC-zmle18900080g03a1
gggccatggggttccagcaaacatatagccatatagaagccacacaaataacatgacaaactgttccaaacgtttaattgcaacttgcaactagcgcgacagcaacatgacacattgtttccgaaaggaaaggaacaatataactagacgcagtaacttatacttgagaaactacttggcaacatgctcgttgttcctcaaactttttattcttagatagcgtagcccaactgacatccacactgaatggacttttagttgcgggagcaaccgcccactgacaccattcttgtagctacatgtccaacgagagatgaatcatatggtccgtgcggagcgcctataatcactggattcgagtttgtttcattaaccctttgtgtcagcgttgaagacctcgtataattcatccccatcagactgccgacagatcaatcatcctccactcc

SEQ ID NO: 21833 - DNA, 416 bp, Zea mays
  Clone ID: cC-zmle18900080g04a1
cttcttttttttttttttttttttttttggttttggtttttttttttttttttttttttttttcccttttttttttttttttttttttttaaaaaaaaaaatttaaaaaaaattgaaggaaccaacaaaggggtaataaaagggccaaaaaaaaaggccctttaaattggaaaaaaaaaaaatttttttttttttttttaccaaggagggaaaaaaaggcccaaaacaccaccacccaaaaacaaaagcaaaaaaattccccttcaaaaaaacttaaaaaaccccaaaaaaaaaaaaaaaaaaaaagggtaaaaaaaaaaaacattccccaacccaggtttaaaacaaaaaaccaaggaagaaaatatcccctttaaatgggggggggtggttaaaaaaaaatttaaacccaaaaa

SEQ ID NO: 21834 - DNA, 513 bp, Zea mays
  Clone ID: cC-zmle18900080g04d1
ccgaccggccagcggcggcccaggctggtgatcgtgtcgcggacggggtttccgcgtgatcgagaacgaggcggacgtgggggcgcttgcggcggacgtcgggttcgacgtgcgcgtgatccgccccgaccgcaccacggagcctgtgcaagatataccgggagctgaacgccagcgacgcgatggtcggggtgcacggcgccgccatgacgcacttcctgttcatgcggcccgggaaggtgttcatccaggtggtgccgctgggcacggactgggccgccggcgcctactacggcgaccccgcggcgcggatggggctgcgctacgtcggctacaagatcctccccgaggagagctcgctgtcccgcgagtaccccacgggcgaccccgtgctgacggaccccgccggcgtcgcgcagcgcggctgggacgtgaccaagaaggtgtacctggaccggcagaacgtgcggctggaccttgcccgcttccgggaggagctcgtcgcggggcacc

SEQ ID NO: 21835 - DNA, 319 bp, Zea mays
  Clone ID: cC-zmle18900080g05a1
gggaccaggcgctggtaagccagaagtaagcgcacaaaacgaaaccccatgcatggggatatacagatgatactgatcaaacgatctctacccttaatatccccttcagctaatgtacataccagtcactcctcagcccttgctcccttcagaccatgcatgcattgcaacacggcccgaatctgtaccctccagatagattaacaacacacacaaactgatccagaaaggaacttaaggtttcaatgtttgccttccagtccatatcagctcaccagcgatggatcgtatcccttcttgacctcgcccacgcgttcgg

SEQ ID NO: 21836 - DNA, 374 bp, Zea mays
  Clone ID: cC-zmle18900080g05d1
ggggaaccacccgaccgcggacgcgtgggcgaggtcgaggagggataccatccatcgctttagagctgatatggactggaaggcaagacatggaaaccttaagttcctttctggatcagtttgtgtgtgttgttaatctatctggagggtacagatttcggcccgcgttgcaatgcatgcatggtctgaagggagcgagggctgaggagtgactggtatgtacattagctgaaggggatattaagggtagagatcgtttgatcagtatcatctgtatatccccatgcatggggtttcgttttgtgcgcttacttctggcttgccagcgtatggttcaaaataaaaataagggggggggggaggaatttatttag

SEQ ID NO: 21837 - DNA, 467 bp, Zea mays
  Clone ID: cC-zmle18900080g06a1
ttttgcaaccaaaccaaacttaaccagggtgacagagctatttacagagtcatcaagagaggaagagaacaaaggaacacttcttaacattcaagctcagttccacacttccaccccaggaaggaaccctggcagttactcctatgcatgtgggagagcttccgttctcgacgctcacgacctcttcttcctcttcttgtcctccgacttgtcggccgcgttcttgagcatgatgacgaggacgcggacgaggacggccacgaagtcggtgaagagggtgagggcgtgcttgacgtggtccatgtcgccgcggtgcgccctctcgatgatctcctgcgtgtcgtacaccacgtagcccaggaagatgagcagcccgaagtagacctcgaacatgaagctggttgcggagtggccgaagatggaggcggcgagctgcagccagagcaggatggagagccccgacagag

SEQ ID NO: 21838 - DNA, 548 bp, Zea mays
  unsure at all n locations
  Clone ID: cC-zmle18900080g06d1
ccgcccacgcgtccgcgttcgcgtgcttctccggcgcggccatggttgccaggcgcagggagtacctctacctgggggggctgctctcgtcggggctctccatcctgctctggctgcagctcgccgcctccatcttcggccacttccgcaaccagcttcatgttcgaggtctacttcgggctgctcatcttcctgggctacgtggtgtacgacacgcaggacatcatcgagagggcgcaccgcggcgacatggaccacgtcaagcacgccctcaccctcttcaccgacttcgtggccgtcctcgtccgcgtcctcgtcatcatgctcaagaacgcggccgacaagtcggaggacaagaagaggaagaagaggtcgtgagcgtcgagaacggaagctctcccacatgcataggagtaactgccagggttccttcctggggtggaagtgtggaactgaacttgaatgttaagaagcgttcctttggtctcttcctttcttgatgactctgtaaatagctatgtcaatctggttaagtttggtttgttngc

SEQ ID NO: 21839 - DNA, 272 bp, Zea mays
  Clone ID: cC-zmle18900080g07a1
cctctttttttttttttttttttttttgggttttgtggaaatttttaaacttattatccattacccctatttttatattggaacccggtagtaaaaccaaaaaaaccataaccaaatccataaaagtacccaatttacccaaataaaaccataaataaaaccaaacataaaaacaacaaaaaacttaccccaaataaaaaccttaatcaaataaataaaacccaaaaataccaaacgaaaaaacaaaacaaaaaaactggggtacccaaaaa

SEQ ID NO: 21840 - DNA, 435 bp, Zea mays
  Clone ID: cC-zmle18900080g07d1
gcacaaccccccaagcttacccccccctcccacccacatacaaatgcccccccctccgggccccccaaagccaacacaccgcccggccccccccaacgcaagcccggggaaaacccggccccaccccacccaagccccctagaagcacatccccctacccccccccggcgccaacagaaaaaggcccccaccggcccccctcccccacccttccccaccccaaaaggcacagggggcgcggccggcaccccccccaaaacccccaccactgcgggggtcccaccccgcgaaacccctacactcccccccccccaaacgccccctcccgcccgctttccccctccctctcccaccacgggccccccccttccccccccagccccagaaccgcggcccccctacggcccccactgaggccttggggggcccccaccc

SEQ ID NO: 21841 - DNA, 390 bp, Zea mays
  Clone ID: cC-zmle18900080g08a1
acaaaacttggatcctctaaaacagccgcccttttttttttcttcttttatttacttttttttttttgggtctttttggtcttttatattttaatattcttcttacaccccatataattatttctcatatttaaacaacaaaaacaaacaaacatcactatatcattaacatcacttacattaacaaatatccaaaacataccaccaacacaaaaaccccaacaatatcaaccaaaaaacataaaacctaaaaaaaaaactctaaccactcaacttccctcaaatcaaaaacatcacactttctccaaaaaactcactttacaaaaacctccacttcacaaactcatacctcccaacaacaaacaaaaaaccaattaaacttataacact

SEQ ID NO: 21842 - DNA, 352 bp, Zea mays
  unsure at all n locations
  Clone ID: cC-zmle18900080g08d1
ggaaaaaaaaataacaggacaactacacctgtttgtttgcattgaaatatgcatgacttctttttcggtgnagggtctattatagatcacaataaaccccggccattgtacttcagcacaaacaaaactttgaatcaaacccttggtgaagttgtacctgttgattttgattggtaaaaaaaaaaaaaaaaaaaataaaaaaaacaaaaaaaataaaaataaaaaaaaaaaaaaaaaaaaataaaaaaaaaaatagactacaaaaattaaaatatttaaattttctcttttcttataatatttaatctcaattctcactatttattctaggggggggggggggggggggggg

SEQ ID NO: 21843 - DNA, 492 bp, Zea mays
  Clone ID: cC-zmle18900080g09a1
cttaaaaatgggattgatggttgcgggcagttttttccactgaaatatctgctacttttcgtcgtatcagccaatctcaatcgttaggctgttgctttcagtgtgcaacgcccgttagaatgattgattgaattgtcatatacttacacactgttacatacaacaacacggcatctgcaatggaatcgtgcgtctgatttgtttgtttggttgtaggctggagtgggcacccggtctgcgtgaagcggtaccatttcatcatcgagaacgacagtagccacctttgtggccgccggcgcacctgctgcctccgctgcggaacacccatggccgctaaaggcttttgtggaccttgagtggtgttaaatggatcttgtcgctgaccactgatgtgatggtaatctgttctccttgcagatgcacccatttcccattgcctgatgtccatcttttgttcgaagcatatcagacttttcatggctgcctaataaa

SEQ ID NO: 21844 - DNA, 565 bp, Zea mays
  Clone ID: cC-zmle18900080g09d1
cccgtccgcctcgatacgatttggatatgttagaagccagctcctctgtttttgcaccatttgctaggattttgtgatgggggttattaggcagccatgaaaagtctgatatgcttcgaacagaagatggacatcaggcaatgggaaaatgggtgcaactgcaaggagaacagattaacatcacatcagtggtcagcgacaagatccatttaacaccactcaaggtccacaaaagcctttagcggccatgggtgttccgcagcggaggcagcaggtgcgccggcggccagaaaggtggctactgtcgttctcgatgatgaaatggtaccgcttcacgcagaccgggtgcccactccagcctacaaccaaacaaacaaatcagacgcacgattccattgcagatgccgtgttgctgtatgtaacagtgtgtaagtatatgacaattcaatcaatcattctaacgggcgttgcacactgaaagcaacagcctaacgattgagattggctgatacgacgaaaagtagcagatatttcagtggaaaaaactgcccgcaaaaatcaataa

SEQ ID NO: 21845 - DNA, 421 bp, Zea mays
  Clone ID: cC-zmle18900080g10a1
gcagcaccaagaagcaccatttttggcttaagattaacttagaataaagcctgacgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccgctcagttgctccagttcccgtcggagttgccgtagccgccgccacggttgccaccgccgtagccgtcgtcaccaccaccgtagccgccggcgtcaccgtagccgtcgtcacctgcgtagccgccgccgccatcacggtgcccgccac

SEQ ID NO: 21846 - DNA, 407 bp, Zea mays
  Clone ID: cC-zmle18900080g11a1
attgaggtccggaacaatattttgttacaataaattaagtttcaatcaaacaaataaatagacaaaaacagttattcacattaatttacaaaaatacattttctctgacatttgtacttggtttgaaaatattaactgaaaccttaagtctttggttaaacaacttaaaactagaaaataaattaaataaataatcttcgtctcgcgtcgtatccgggttttcaggcgcctaagatgtcatcgaagaatctttcgaagtagtcttcgtcgtcgtcatcgtcatcgtcgtcgtcagcagcagttccgtcatcgtcgtcatcgtcatcatcgtcatcgtctccgagatctaagtcgacgtcatcgtcgtcgtcatcgtcatcgtcgtcatcgtcgtcctcgccggcttg

SEQ ID NO: 21847 - DNA, 600 bp, Zea mays
  Clone ID: cC-zmle18900080g11d1
ggggaacacccgtccgagtgaagttgtgggggaaaaaaggacttgagaagtgtgactgtattttttttgttttttaattttagagaaggggtaaaatgaagttcggatggttattggtttgttgcctatgtgccatcgccggttcggcattcgggttcacccgttcctgtactcaacgaaagcggagcaaagtcgacgtcgaggcaagcgcccgcggagcaagtccagcctgtcgcggcagcaccgcaagccggcgaggacgacgatgacgacgatgacgatgacgacgacgatgacgtcgacttacatctcggagacgatgacgatgatgactatgacgacgatgacggaactgctgctgacgactacgatgacgatgacgacgacgaagactacttcgaaagattcttcgatgacatcttaggcgcctgaaaacccggatacgacgcgagacgaagattatttatttaatttattttctagttttaagctgtttaaccaaagacttaaggtttcagtttatatttttcaaccaagtacaaatgtcagagaacatgtatcttttgtaattaatgtgaataacggctttggctattattt

SEQ ID NO: 21848 - DNA, 450 bp, Zea mays
  Clone ID: cC-zmle18900080g12a1
ggacaacacaggaaagctcaaactgaacgtacactcaggaagtgagaggatgttcaaacaatgcaaaacaacagagcaccataagctaaaggcaagagcttaaccagcgctaagggtgtgggtatcaggtcgacgaccatccccgcatcttctgcttcgctgcgtttcgtgaaaggtaacagcagcgccccccagcagtcctcacttcagttgtcatcgtcgtcgtcctcctcctcctccttcttgaggcgggtggttccaccctctttgcttatgggcagcttcatgttgccgaagggagtgtcgacatcgatctttcccttgatggtgtatcccgtgcccctccccctgatcatgtgccagacagcggatccgaagtccttgggcctgaagctgaagggcacctgcatcctggtgatcccctgcttctcgatcttggcggtctgtgtg

SEQ ID NO: 21849 - DNA, 501 bp, Zea mays
  Clone ID: cC-zmle18900080g12d1
tccggcctcaacctgctcgagtacgagatgtggctcggcgattacatttatcgcctccgccgagctcacacagaccggggagatcgagaagcaggggatcaccaggatgcaggtgcccttcagcttcaggcccaaggacttcggatccgctgtctgggacatgatcagggggaggggcacgggatacaccatcaagggaaagatcgatgtcgacactcccttcggcaacatgaagctgcccataagcaaagagggtggaaccacccgcctcaagaaggaggaggaggaggacgacgacgatgacaactgaagtgaggactgctggggggcgctgctgttacctttcacgaaacgcagcgaagcagaagatgcggggatcgtcgtcgacctgatacccacacccttagcgctggttaagctcttgcctttagcttatggtgctctgttgttttgcattgtctgaacatcctctcacttcctgagtgtacgttcagtttgagg

SEQ ID NO: 21850 - DNA, 416 bp, Zea mays
  Clone ID: cC-zmle18900080h01a1
cgcgatttatattttttctagttctagattcgctagcgcggtccttggttttttttttattcccaacagatatgacttttttgggtattgaagacctacactaaatgcatacatacaaagtcatcaatgaaacgagcttacgacaacaacacatgaaacgggtgagtacgcacggggtatgctttactcaaggaacccaacactggatctgttgcaatgcaacaatatgcttacgtcactcagaaatggcgaaatgcaacctagaccacatgcaatgtgccatttattgcttaatataagcaggtgccgcccccccccttgaaagagaaaagcatatatccatactgttgggcaaaaatttgaggcctggttacaaaaagaatccccaccaaaaatgaggttcattttagatctca

SEQ ID NO: 21851 - DNA, 367 bp, Zea mays
  Clone ID: cC-zmle18900080h02a1
aaacccacacaaacattggaaacccccaaaattttttcgcatcatcccaaggccagggggaccacaaacagttgggaaacacattgggagcaccacaacccaatacctgaaacaagaggaaatgaacccccttaaaagtttttaaccgcccttgggggccaagggatggatcaaacggacttaaaaatccttaaaccagccaagcgggatttatttttttgggtcacaaccaaccatgggtattcggggctcaatgggcccggagggttctcctttggaggctttgaaccaaaaggaacgggcagctgtttttcatttgccaaatggaccttgcaaaaggagcaaaccacccgggaattccggaccg

SEQ ID NO: 21852 - DNA, 536 bp, Zea mays
  unsure at all n locations
  Clone ID: cC-zmle18900080h03a1
tttttgaaacacaaccaacaggttctagttgccgggtcgaatcaccatccagtcagtaaacaagatcaataagctactagtgctatggttggtttgacagctacaagcgacgaaaaacatctgcttgctgaagaacagacttaacattcgcacaaaatacaacttttcgactagtatatctcatcatctgggacatctggtgtaagaaacttctgtggatccttgtacagctcttcgtagttgtacttaggcttcaccctctccgggacaggctcaagtgggataatactgtctccatcgatcacgccatcaatgagtccataatcgacagcctcgagagggcccatgtaacgatctctgtcaatgtctttctctacctgctcaggagtgcggcctgtgaagcctgatacgatccgaatgacattcctcttgttggtcaatatctccttcgcttggacctctacatctagggcctgcccgcttgcacctccgacaggctgatggatcataatcctggtgtngggcatggcaaatcg

SEQ ID NO: 21853 - DNA, 439 bp, Zea mays
  Clone ID: cC-zmle18900080h04a1
gggggggatcgggccctggagaagttgcttcacattacactcatgactcgtcttaggacgaatcctgcagctgcaaaacacagaaaatctggccaagacctatttatctatttacaggtaagaggaggccatgctgcgcacatctgtcggcatgaaggccagtacaaccagcaagacgagcaggcagaccggcagccacaacagcagcgacggcggcggcggcaggggaggcagcaccagcggcagtatcagcagcgagacggtgaggcaggcgagcaccaggaacgccccgatgctgaagtaggtggacgcgatgaccttcttgtcgaggaaatccgcctcctgctgacgctgctgcagatgccgcttcacggcattcctcctttgtattgccgcccctccttccatcgcgctagatcggcttgccatgtgttctttg

SEQ ID NO: 21854 - DNA, 531 bp, Zea mays
  Clone ID: cC-zmle18900080h04d1
cggccgttcttctgaagcaggggacgggcgattcgaccacccgattctagatctgattacaaaacgttcagaaaaggcaaggcgttctcacaccgcctttcacttcttgcttactttggcaaccactcactgcgactggtctccacctccacctacaccaaagaacacatggcaagccgatctagcgcgatggaaggaggggcggcaatacaaaggaggaatgccgtgaagcggcatctgcagcagcgtcagcaggaggcggatttcctcgacaagaaggtcatcgcgtccacctacttcagcatcggggcgttcctcgtgctcgcctgcctcaccgtctcgctgctgatactgccgctggtgctgcctcccctgccgccgccgccgtcgctgctgttgtggctgccggtctgcctgctcgtcttgctggttgtactggccttcatgccgacagatgtgcgcagcatggcctcctcttacctgtaaatagataaataggtcttggccagattttctgtgttttgcagctgc

SEQ ID NO: 21855 - DNA, 541 bp, Zea mays
  Clone ID: cC-zmle18900080h05a1
tgctgccgcggctttcagcagctcgccgtcgtcagccgttgtccacggggagtgcttcgtggtgggcgacaatatcgacaccgaccagatcatccccgccgagcacctcactctggtgccctccaagccggacgagtaccgcaagctcggttccttcgccttcgcggggctcccatccgcggcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggggaagtgtaccctctggagctcacggacgttggggcctggaaggagtgcaagacaggggatgtggtcaccgtggaccttgctaactccgtttttattaaccacacctctggcaaggagtacaagctgaaaccaattggtgatgctggccctgtcattgaggcgggagggatc

SEQ ID NO: 21856 - DNA, 532 bp, Zea mays
  Clone ID: cC-zmle18900080h05d1
ttatcttttttttaacaatgtgaatgcagccattggattgcataccaaaagctcaaatacatcgaacggcagcgagtttcgagagttgtacacatatagatgggcaacacagcagttattcaaacagataaggacagtagcaggcaggagtacaattgtacaagtactagtaacaaacaaaaaaaaaacgatctgtgacaaagaccaaattgattgattcatcataatttcggtaggccgcaacttattttgagacaccgtcgacatcaagtaggtgcagtaactcttagtcctaactccagcttacttcttcatcttcgcagaggctcggctgcctaagctgatctttccctcatgcagcagctttcgacgcaatcattcctgtcttccgggcgtaggcaaagatccctcccgccttaattacagggccagcatcacccattggtttcagcttgtactccctgccagaggtgtggttaataaaaacggagttagcaaggtccacggtgaccacatcccctgtcttgcactc

SEQ ID NO: 21857 - DNA, 467 bp, Zea mays
  Clone ID: cC-zmle18900080h06a1
atatccaaatactgaagggattcaattgcccgaaatgttagtgtatttacagcattggcacttggcagtacatctgagcagtacagagcacagcagtcagcagcaaagggtattacctgggaaaactcatgcaactgggatgcatcgtagtctgcagattcagataccctcttgctctcaggggcaggttcctcaacaacctttgatgttccttcggtgtcatcagcagaagcttctactgtatgtttatttcttgcttttgaagatttttttttgtctgcttgggctgttgcagcgccagcatttgcagctctactgtgtctcaaattgtaacgtctttctcctggggcatctgtcactgccccagcagtttgccgcctcttacggcgctgccctccaagtgaaacactttctgaatgtgcttcgctcccttcttcatcttgttcacttatggtagctccagcaaa

SEQ ID NO: 21858 - DNA, 551 bp, Zea mays
  Clone ID: cC-zmle18900080h06d1
cgaagtacaaggcgtgcaaaaactgtgggatttctatttttgatttttggattctctgctgcttaaagagagtggggaaattgagcatccaagtttggctgttgagggagatgatcatgccttgaccaccgatacataaggtccagatacaggaacccttgttaattcaggtggtcgtttttctttgttacagaagtgttcaaggcttttcaagttctcccctagaaaaaagggtgagcagtcatcagaacaaccatcagagaggaatatatcttttggtgcaagactcgaggaagcaacacagagcgatggagattatgtgccaactcctgtctatgagatagcccacgattctttcaatgcagaggatgagctcccttctgacggtgaaaccagggagaatgaagaagtctgaaggcatgacataactgataatgcccagatggagtcttctgtggtgtagcagataacagtatagatattcttggtactaagtcatttgatggtgctaccacatggcagtttaagcaactattgtctctgttgatcaa

SEQ ID NO: 21859 - DNA, 460 bp, Zea mays
  Clone ID: cC-zmle18900080h07a1
gtgtcagagaacatggcataacatctaacgagtgggccctttttacactggttacaacatagtacaagtacaccatgcatcgcactcgcaccacgagcattccatcattgacagtctactcagcagtccttccccaccaaaaaaaatgtgaagtttcatatatatcggccatcaacctacgatgcatgtgtggtagcactcctcaaaatgctaataataagttcaactcctcatttgggggtgaaggcctggaagatggtggcgtggccagggtcggcgaggtgggcgaagaggttgtcgatggggccggtgccggtgtactcggcctggaaccaggcgcccatgacggcgagcatggcgaggcgtccgttcttgatctccttggtgcgcagctccttgatcttctccggcgagccgctgccccagccgagcgggtcaaaccagatgccaccagtgtacc

SEQ ID NO: 21860 - DNA, 457 bp, Zea mays
  Clone ID: cC-zmle18900080h07d1
ggccacgcgtcctcaaggccacagcttgcgcccgcaatttcacttgtttccgcctcctcgtcctccacgagcggcgtcacggctctccccaggaatgggcagcgggcgtcttcctccttccttggcggcaagacgcctgctgaaacaggtcgaggcggcccggccgccgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaactttcaagctgagctggtgcactgccggtgggctattctcggcgcggcgggcatcttcatcccggagttcctgaccaagatcggcggcctcaacacgcccttctggttcaccgccggcgagcaagcagtactttaccgacac

SEQ ID NO: 21861 - DNA, 451 bp, Zea mays
  Clone ID: cC-zmle18900080h08a1
gcattggatggttggtttattatccttaacaaagtgataaaaggatattatggtatgttccaacatgtcccctttcatatatattaagggtgctgatgattctcgcataaagtgcatgtctctaaccactctatctgctacataccatagtcgtggtgttgttacaattgttcccattgattttaagtttcctttgttaattacatgtttatttcagtgtgcctccctaatatgttgttaattttgatgtcttactcttattcacctagctaatgctagatgaaattcctttcaaggaatgatttgctgcattttgttggatgttgtcctaatcaacccaatttccttttttgcaatgaggcatcatatatttatatatatagggattgtctccatcctcttgatggcgatctatactggttatttccgaagaagaatcatgaagcaattc

SEQ ID NO: 21862 - DNA, 402 bp, Zea mays
  unsure at all n locations
  Clone ID: cC-zmle18900080h08d1
ctatgccacctctgagggataggtaacaattttatattgttacaaactaacacacatgtctcaatctggtaccacaacttgccctgtaaaggtntaaatttgcttccttgattcttcttcggaaataaccagtatagatcgctatcaagaggatggagacaatccctatatatataaatatatgatgcctcattgcaaaaaaggaaattgggttgattaggacaacatccaacaaaatgcatcaaatcattccttgaaaggaatttcatctatcattatctaggtgaataagagtaagacatcaaaattaacaacatattagggaggcacactgaaataaacatgtaattaacaaaggaaacttaaaatcaatgggaacaattgtaacaacaccacgactat

SEQ ID NO: 21863 - DNA, 301 bp, Zea mays
  Clone ID: cC-zmle18900080h09a1
gctggccggggcgttggcggcctgcgccgacgggcgcaggcaggccggggccgacgagtcgctccgcaaggccatgtacctcagctgctggggacccagctgagctgtacggcgttggtgagtgaccgaccgaccgtcggcgggtgactggactgtatgtaattcgtacgtacattagttctaggctctttgtgtagatattcgatggaatggaactacgaactaccgctcactgctaataatcattgggttcaaaaaataataataacaagcggttccatcgtttggaacttagaatggt

SEQ ID NO: 21864 - DNA, 314 bp, Zea mays
  Clone ID: cC-zmle18900080h09d1
tttctcttttttaccattctaagttccaagggagggaaccgcttgttattattattttttgaacccaatgattattagcagtgagcggtagttcgtagtttcaattccatcgaatatctacacaaagagcctagaactaatgtacgtacgaattacatacagtccagtcacccgccgacggtcggtcggtcactcaccaacgccgtacagctcagctgggtccccagcagctgaggtacatggccttgcggagcgactcgtcggcgccggcctgcctgcgcccgtcggcgcaggccgcccgcgccccggccagc

SEQ ID NO: 21865 - DNA, 481 bp, Zea mays
  Clone ID: cC-zmle18900080h10a1
ttttgacagggatcattcggtaaatagggagatggggaaaataaaatggaaacaaaacacccgcactaaccacgagacggtgccactcgaaacacaacacgctcattgcatagcacagggacagcatcaaatcttccgagtctgcgtctgccagcgtagccgattccactggttacacaaatgtatgtcgggcgagctctttcctcctcccaggtcccagggagaacatccagcaagcgctgtgcaggatcaggaatccatggacaggcctccattattgggcttaagctgcctccttgaatatacgggggagcacttcatggatgccgatgtccaaggcctcagggctcctgcacaatgtccgtgccttctcttttgtgcttggcacaaaccatatctttctcagcgccggtgcctcgaattgcacgaagaacccgtcgctctggtcaagcttccacttgctcgacccttgccctttcca

SEQ ID NO: 21866 - DNA, 363 bp, Zea mays
  Clone ID: cC-zmle18900080h10d1
gggacctggctgcggaataccgaaatgttggttgctgtgatgggcccaagagagattctaccacagttggaaaggcacggcaggaggaacttaccgacgacggtctcggcaatcaggcaccgcctgagaaaatggtggccaagccaaagaaagggacgcattggcagaccctgagctggacatcgcatcagaggctcccgatttaaggaggcacttaagcccaaaatgaggactgccaggttctgatcctcacagcgctgctgatgtctcctggaccggaggagaaagagctgccgacatcatttggtaccagggaatcgtacctggcgaccaaaccggagattgatgctgcatggctatgca

SEQ ID NO: 21867 - DNA, 524 bp, Zea mays
  Clone ID: cC-zmle18900080h11d1
cgcccacgcgtccggtcacttgctctccctccaacaagcttattttttccggtcgtcatccctcttctagggcgtgtattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggctttgcctttcacgagcaccacgagaagaagaaggaccacaaggaggccgaggaggccggcggcgaaaagaagcaccatttcttcgctgaatgaaccctcccgtatcg

SEQ ID NO: 21868 - DNA, 471 bp, Zea mays
  Clone ID: cC-zmle18900080h12a1
ggatgccaaccagagcgggcacaccggaggcatgacgccggtttcgttcattcacgaagcaaacattccaatccaacctggccgtacagtttatcatgcaccgtactattgcgcttgcgacttgcattgtatgcctccattggatgcgtataaatttacgagctaaccaaaacataattacacagggcaacggccaagaatcatgtacagtacagcagttcaaacagggcaggccccttgcagcctagcgtcagcaaaccaatttacaggggttacctaggtgcacgagcgtggagaagaaccctctgttctgttagctcaactcaaaaagatggcctgggcagagcctgcacaaagttgcagtcttcagaccggcactttcgtgcctcaaaacgccggttatggtcttcgattttcttgaagtgataagatgagatcactctgtgtcaaatagaaaacacctaccacctt

SEQ ID NO: 21869 - DNA, 300 bp, Zea mays
  Clone ID: cC-zmle18900080h12d1
ttagcaccggacattgtggagacatgatgggctgaaacgactgtaacactggagatgtacactggaatgacgtggcttgcacattctaagagagatcactgcccaagcaacaggaatccaaaatgcaaaggaagctcactggcagatgcactaagggcttgattgggcctagtgataaacggcatcagaaagtattgcattcgagggaaggaggccattgccgctctttggcactggaccgtccgtgaaaagactccctgagcttgtgcagagaatggagagacttgccaacagcaccac

SEQ ID NO: 21870 - DNA, 190 bp, Zea mays
  unsure at all n locations
  Clone ID: cC-zmle18900082a01a1
tttttataatagcttagctactaagtaaaatctttactggtgccatggcgtgcactcgnacaacttttacccctctccagggctgtcttacaacaaggtatgatacaggattaagccaaaaaaacagatgaccccggtggagacaggttcacattttaaacctttaaacattgtctttaaaaaaaaagca

SEQ ID NO: 21871 - DNA, 285 bp, Zea mays
  Clone ID: cC-zmle18900082a02a1
ttttgggtttataatccgcttagattatataatccataggtcaaaagttgttagattacccaaacaaacacccccttaagatcgattttttacagttttgatgagtaacagcagtaccacactctgaaagcacaattttgaatacaagcagttctctgttgcgttcactaacaatttgttcttcagtcagtcccaggttgacttccctgtttgcttcaatatctccaccgattattttatccgtaatcacaaacaattggctctttatttttatacagaacattg

SEQ ID NO: 21872 - DNA, 57 bp, Zea mays
  Clone ID: cC-zmle18900082a03a1
attggtgtagggggttaaatattgacaccgttctctcccccccccataacccgacac

SEQ ID NO: 21873 - DNA, 414 bp, Zea mays
  Clone ID: cC-zmle18900082a04a1
tttttgtttgcatcccaacgcgaagataaattattcactgcatgcaatacgccaagcacatgcacaagcccacatattacagaaccaaatgaggtgcaaacttaagtgcccaatgaccaaaatagcattatgacaaacttatagactgtttggtttgaggaatgagctagtcaatcatcttctcactcctcactttttttgtttggtttgtggaatggaatgagttgatccatcatcacctcattccttatagttagttagttagtactaatatgaggaatggggtcatcccaccaaatttgaggaatggatccatgatgcaccaccacattttggatggagtgatttctcaaaccaaacacccccttagaagccctgttcatcaggtaattgccgaacctctccaccaccata

SEQ ID NO: 21874 - DNA, 128 bp, Zea mays
  Clone ID: cC-zmle18900082a05a1
aaaagaaaggaactattggtttcggggaggaaataccaacaatcttaattctatatatcattgaccttatactatatatatgcgttggcaatatccatagtaataaaggataataatcggactcgtgg

SEQ ID NO: 21875 - DNA, 333 bp, Zea mays
  Clone ID: cC-zmle18900082a07a1
atccggggggagggaaacggggcctaattgggagtattacacggctgttgcccataatcgttatacatgcgaacgtgcgtgtggccgtacactttttattagcaccttaaagtcaaaagaatggcacaatgagggccagcgttacaaagccaacggaggctttcgtgatcgggaacggcatcctccccctgtcctttctgacgaacatggcctcatagaccgggaccttgaggagctccagcaccccgcaaagagccacctgtaccaaaaacactttctgtgccgccgccattcctttgccgccgcctgctgccaacgccaggcccactatgt

SEQ ID NO: 21876 - DNA, 467 bp, Zea mays
  Clone ID: cC-zmle18900082a08a1
tttttgatacgaaagacaaccttgttcatgcatctacgttccatttcgtagattggttccatactgcgcattttcacttgtacagattctaaactaaactactacaggatattagaatcaacaagaccagatatatagctccaagtaaaccatagtcatctttcgagaaagatccatagaaaactgctagtatgtagcaacgagaggtgagaagattacccttgtcctatgctccaactctcaaaggttctccatctggatattgctcttgagtggcacgtactccccaaggtagcctccaaggtgctcatacaatgcagtgcggtcaatctgctggctgtggaaggccttgcaggcgtagtagaagacactctgcacgagcagtcctagcagattgacagagacaagaacgcacaccagcacggtgccgacaagcagccggccaggcaaagccaggccgaacctcc

SEQ ID NO: 21877 - DNA, 225 bp, Zea mays
  Clone ID: cC-zmle18900082a09a1
ttttggttttatacttctttcttttcatttcaattgtggattcaggtcattgctcacactgacactgccacccatggtgatgcgtgacacattattactcaatcatcgccgctaaatgactcaactagctagctagccagcggctatactacagcacatagtttcttcagtgggggacaccgccggcagcagcgtaggggcatggagtcggctgctgcaggccgc

SEQ ID NO: 21878 - DNA, 274 bp, Zea mays
  Clone ID: cC-zmle18900082b01a1
acgaataggttttgataaatagggactcagggaaaatacagtgtgaaccatagctagaatgccttgagttctcttaacacaaaaatcctaatccaaagtgcaaataaagtgtagccatctcaacaatcaaacatgacatcatagaaaccaaatatgagattgctcaagcttcaacagcaaccctttcagccacctggtccagatcacgccttccctgggaggtgatgcgccgtccacccttgggatcgacatcaatgatgccaatttcctcaac

SEQ ID NO: 21879 - DNA, 290 bp, Zea mays
  Clone ID: cC-zmle18900082b02a1
acaagggacaccagcagcatgtactaaatcagattcaacgatgcgatacaaagtagaccactatacaagcagaccaccaccctaacaacaccaatacggagcaaggtaatctaaacacaatggcctttcttcctcctctttccttttctacaagcttcttttctctgactaattctcaaaacgttacacacatggtcctacacagcatgcgtagaggataaattcatttcacatctcgggtccaaagtgttacctgcatgtgtttgtgcatcagtctacttgtccccctc

SEQ ID NO: 21880 - DNA, 399 bp, Zea mays
  Clone ID: cC-zmle18900082b03a1
gagacatcacatctggggattgattggtaagattggcttaatgccaaatccaagccccaccgtgtcggtaaaaggttaatccaccctacataatcataacttccataacaccgctgtaccttcaagtaaaaagattgactcaagcattacagccatcaacttcgacatttgatattggcaactatcctgaaactcatctttatgctaaaacatattcaattgataaacaagaaacgagctcaacactcaggttgcctcatttgtagaaatcgaagtccgtctcaggctttttcacgttggttcggtagcccttctcaaagtccttggggaggatgacatatcggtttttgcggacagcatgcatgccagcttcttgacagatagcagcaatatcagcag

SEQ ID NO: 21881 - DNA, 427 bp, Zea mays
  Clone ID: cC-zmle18900082b04a1
ttttggattgagccactttattcttctccactcctcgggcaaacaaatcatggacaaagattttggtatttacttgtttattgatcattatgcactccaaaacatttcagatacagaacaacaactcaaaaaaagaacaaagggcggctacaacaatactagctttagcttccaggttatttgtactcttatcacaaaaaaaacagcgctacataactgctgaacccttcaaaaattggcatgcaaaactctcattcagccctcctctccggtgttctagacgtccaggtacttgctggcggtgtgcacgtccttgtcgccttgcccactgcagtttagcaccaccctcacgccgttcggcaaggtcgggcacaacttttccaggtaggcgagcgcgtgggaagtctccagggcccggatgatgccc

SEQ ID NO: 21882 - DNA, 375 bp, Zea mays
  Clone ID: cC-zmle18900082b05a1
ggggggtgggtttttttttttttttttttttcttcctctttttttcttggggaaaaaagcccctttattaaacccccccggtttgttcgcttcaaaaaaaccacgccccgggggttatggcccccccccttggtaaaaaggggaaccccccgggctaaaaaccccaaccccccccaaaaaaacaaaaaaggggccccccgcgcaaaaactttgggggcccccccctagcttaacattggggggcccccaaaacccggtaaaaaaaacccctggcccttttgtccattcccttcccccccccctaaaaaccttattgggggcccggggttcccggggggaaaaaacccttctgtttttaaaaagggaagggggggg

SEQ ID NO: 21883 - DNA, 470 bp, Zea mays
  Clone ID: cC-zmle18900082b07a1
ttttggtttaaggctttgcttattacaggcctagaaatggtaccacgcacgctccaacaaatggcaggcatccttccgctccctccatcatcattattccaagctccgagacataggactgtcctcgaggtacagtgttcctttggcatcaacgacgacagaaaaaaaactcagaccgttgttagctcttaaaagctcttggcagctgcaatgatgctctccacggtgatgccgtactccttgtacatcgacccggcaggagcactcgcgccgaacttgtcgatgccaatggccttgccctgggctgcgacgtacttctgccagccaagagtggacccagcctcaatgctgatcctcgctgtgacggcagcagggaggacgctcttcttgtactcatccgactgctcatcaaagagttcccaggagacgaacgagacgacgcggaccgtcttgccctccttcctcagctc

SEQ ID NO: 21884 - DNA, 465 bp, Zea mays
  Clone ID: cC-zmle18900082b08a1
aactccttttttttttttcaccttctacattatccctcggggttttgttcttttaaaaaccctcccaaccccccattcacattaacacatttactacatacaccacaccaacacccaaaaaaccccacaaaaataccccccatccttaacacactaaaaaacaaaaacaactaaaacacaaaaaacaaataaacaccccaatcccacctaaacaacaaaaacaaaaaaaccccaccacaaaaaaaaaaacaaaatctaaaaataaaacacccccaaaaaaaaaaaaaaaaaatccccctccccccagaagaacccacacgcaaacactcatttaaataaaaaaaaaaaaaatccaccccccacacaaaaaaaaaaaaaacaaatgtacttaaaaaaaaaaaataaacaaccatatcaacacccatcaattaaaaaaaaaaacaactacaccacaagaatattcat

SEQ ID NO: 21885 - DNA, 447 bp, Zea mays
  Clone ID: cC-zmle18900082b09a1
gggccgaactggggctttattattcgtcgtatatatattaattagcccgtacacgacacgactatagaggagcggtacacgaggccagtccacatgtggagagactaaacagaaaagtgacacaaacacctgatggcgcgcggcaagacacgaaacaagcaggaagatcagcccacgtgcgcacgtacatgcatgcatgcacagcacacgtactagtactagcagcgcggcacggagacgccgcaggaggcgacaaccttgcccgcgttggggctgttgatgtaacgcccgtaggtggggttcttcacgaactggcagaagcacccctgctgcgccttgaggttggagcaacacgacgcggagggcgtcgcgccggcagtgatcgccggtgcgcacgccgtcagctgcccggcgttgcacgaagccgccgacgcccgtttgggcgtc

SEQ ID NO: 21886 - DNA, 348 bp, Zea mays
  Clone ID: cC-zmle18900082c01a1
gggttgggggagcccccaaaaaaagttttattgatctttgccaagggagcatggacctcattacccttgacattttccaatcctttaaagatcccccagcccattttcatacaacattttcccccgaaacatgtttccccccttttaaattacataactcaagccgggagcatcctttttgcaacctaacaactggatagggataccctgatcagtaatgactaatgagtcgttatccttccctggggaacaagagagagctcctttgttacagctcagctagaaaactctaattccctatttccccctagcaaatttattagtagccctctctcatttcaaacttgg

SEQ ID NO: 21887 - DNA, 592 bp, Zea mays
  Clone ID: cC-zmle18900082c02a1
gacgtaggagaataattatggggcttcaataagaacttctggcaatattgcacattgtcacttgccaagctgttgttctcaagcaataggcgcttggctggcctacccacaacacaacaataaggttagattcccatcactaatgtcttgaagaaatacataggattcggactcaaagatagttatttgaactctggggtagatatcacatcacggaagtagttctttagccaagtggactcggcttctggaggaacggtgcgggcctcacataactgaaccccacaaagttgctgttggccgcaacagggctggccaccggagaatcaagcacgggcatgttcgtccagcactcgtcaaagttcgcaatgcaggtcttgccagcaacattcggccggaagcttggctcgatctgccgggcctccagcctcttccagtttacagacttgaaccacttgtggttcttgatttcgtcactgccgcctggtccgcttcccagcggtctgccagcttctttgtgcaataatcctttaacattgagtgaacttcactagataaatatgttggcagctttatcttctcctttactatc

SEQ ID NO: 21888 - DNA, 313 bp, Zea mays
  Clone ID: cC-zmle18900082c03a1
aattggggttggttttttttttccttttcttctctccctcttccttctcttctttttttctctcctctctctttccttaaaaaaaggaaaaaaaccctttcttctttattataaaaagtcactccagtgcaatttcccccccacccccccccccctgggggatccccaaccacattttacccaaccccccccctaaaaaaaccaacaaaatcactccccccccggttttccccacaaccaatttttcttctagggggcacccccccccccaccccaggggggctttaaatcttcttttcaaccccccaaaccc

SEQ ID NO: 21889 - DNA, 499 bp, Zea mays
  unsure at all n locations
  Clone ID: cC-zmle18900082c04a1
acaaaaatgacactagttggcaacaaacacatgatacataggtggtgtctaagaaactgatgctctcgacaaaatatacagatgtgcagtctaaaacatcgatgaaaactttgcacagggaatcgaggtacggaaacctcaattaaaacggcctctttgtacatggggactctgaatatacaaacatatactactcgaagagctacacttagaatatcataatccaattgcgatacactctgcaaatatatccacttaagtccatagtaattgataacacacagcactagattatgaatgagactttgataaccggggtatccttgattttcccttctcagttggaaatttccagatgatatcatctaatttgccgcagtagttatttacgaaaattttattagaagttaatctgtgcagcaagcatcagcatcaccctattacaggcattacttgccaatgtaaatttgtccctttggatgtatcgngttatactctg

SEQ ID NO: 21890 - DNA, 408 bp, Zea mays
  Clone ID: cC-zmle18900082c05a1
ggggggggaaaattcaacattttactaatttaaaaaggtttcaaacatgttttctacatcttgtacttgtagaacacacgtgatgatatcggaacaattgcttgcttagaacttaaacaccaatgctaggggtgaactcaaacgctgaaaaccatgaactattttcacacccggggccaccacttttatgcaccaggcagggttggggcataccctcagctcctttcaagaaaattcatatctaagtcccttccacccccgcagaggtgaaaacgcagatttgagaataaaccccctttctcccccaattgaattttgggtccctttcaccctctataacaagctgggaaacctccgtattttactaaagcccctctcctctgcaaaatataatcatttcctttcctt

SEQ ID NO: 21891 - DNA, 580 bp, Zea mays
  Clone ID: cC-zmle18900082c07a1
ggaggaacagaggtttgttatttgccaacagattacacacatgattggcattccacacgcaaccgatcgatatgacgattatactcctatttattagcaccagctatatatatatagccatgtctggagtctggactagcaagcaaccgagatcgatgatacagagatagattcatcggtttgcatgagcatgacttgttggcagccactatgttacaccaccatccaccaacgcatgtacaaagttctgcatcatcatcgcatcgcctccgcctgatgatgatagatcagtgcagcgccgtcaggacagtatacccttccaccaccttgaaagtggcaccgcagatctcttcttcgtcggcggggacagcggtgaccttgtgcttggggttctcgtagcacttgagccctccgagggcgttggagtagaagcagccttgcgggaacggcgcgagcgacttgccgcatgagcctttgagcatgtcgatgtcgtcggagaaagcgacgcagccgtcgggggtgatcccccaaagagcggacccctgccttcggtcgcggaccctgggtcgacccggaattc

SEQ ID NO: 21892 - DNA, 132 bp, Zea mays
  Clone ID: cC-zmle18900082c09a1
aaaaaaaatatttggggtccccttcattttttagggggagtgggggggcaaaatttaccccccaaaaatttttttgaaacaaaaactttgtggttttgaaaaaaaaaccaacaggttttaagcctttttaaa

SEQ ID NO: 21893 - DNA, 285 bp, Zea mays
  Clone ID: cC-zmle18900082d01a1
atggccttcgcggtcagctttttctcagccttctccttgatggacgtgggcgagggctactccgtcgcccgcactgtctgcaatatattcctcgacgccctcggctgcaggggccggtgcgacgacacgccttgcggattctctgagcccgggcaccgacatgcggtgccccgacggttgatagagactcggtggctgccatggcgacacggaaacggtattccatcgagcgcgcttgctagctggcgtgatcttggcgcgggggagctaggtggagcccacgcg

SEQ ID NO: 21894 - DNA, 478 bp, Zea mays
  unsure at all n locations
  Clone ID: cC-zmle18900082d02a1
cataaaactgatcaccaccatcgttgggattggtcatcagtaactaaaaacagcagagcagaatgcagcaaaatagtctcgccaattttgttccccccaactcaactaaacagcactccgttacaactgaacaaatgttccaaatgttctacgaaaactgcccaaaacgtcatatcgtcgacaactaatggggactaccgtaccgacgacggatatggtttttaaacgtaaatctccctcaccaatgggtgctaaaacgtaacaacaaacagcatgtgcgtccggggattctctctctctctctctcgnattctctcaactcccccctctctaccgtgttaggcccgcttgttccaagacttgcctcggtaggatttctgcttcgtcctccgctgcgatacgtagtccgcctcctcctggaacgggtttggcccgccaaagtcttgctttgaccttcgcaccttcttcgtcttccctc

SEQ ID NO: 21895 - DNA, 255 bp, Zea mays
  Clone ID: cC-zmle18900082d03a1
ctgatgttccatccgcccggaaaggtgcttgacaagtacctttggatataatatgaacaggaaacggttcatttgccggctccatatgaacaaacacaagtccgaaattatgtggccatcgttaacccatctattagcttccatctaggctagcttggcgaggacgtcgccgagcgcatctttggttgctgcgaagtatttctcggcctccggggtgctcttgatctttgcgcggacgcgtgggcggacgcttgg

SEQ ID NO: 21896 - DNA, 365 bp, Zea mays
  Clone ID: cC-zmle18900082d04a1
ttttagaataggttgaactgataagtaattacagaaacattatgcatcttccgtttaaatcttttaaaaagttgtgaaataagttgcgctaaacagggccataaggccataagttcgtccaatgcagaatacacttgaccagctgaatcagatagccacctcatgaaatttgcttcaggaaaataacactacagatatatcgtgtccattacagattttggacagcagttgacagaaaaaaaaaggggcctttggaagtggcaatgcaacaagtgaacgtcctcaacgctttgagaactgaggccgctttgcgtgccttcttgaaaccagccttcttcctttaaacgatacaggtgtcccttgtc

SEQ ID NO: 21897 - DNA, 362 bp, Zea mays
  Clone ID: cC-zmle18900082d08a1
agaaatgcacttggtgtatgtgtgggaagccataaacatcatccaaaaaacttcattattgaactataactcataagcaatctaaaagagggcaccgccaatgatgggttgttggtagaacgttgttgggtttgtcaaagcaagttggttgaatggcagcaattgttgcacctgtaagagggtgccagcgttaggcgcagcgtgcaggtagaacggcaacaactgttgttgtgtcaagaaggcaacagggctcacatcaacttcctggcttaatggtggtagccggtgctgttttaaataatcagcaaagttcaatgctgccagttggttgaatggaaaaaaatgctgggggtaggcagcag

SEQ ID NO: 21898 - DNA, 370 bp, Zea mays
  Clone ID: cC-zmle18900082e02a1
gggggtgggttttttttttttttttttttttttcctctcttttttttgccccggggccgggaataacatgggaaaaaaaaaaaccctgtcttcccacaaaattttaggggatttccccccgggcgcgaaaatttacagggaccctggagcccttggggccctgaaaaaaaaaaaacctgatattcctacccccaccccagggccccaggggacaaacaacttttttatacccccccggggctggcacaaaggggcttttccagaccccggggccatgggttttttttttccccccgaacccctaggggtatggagggccctgacaaaaccaaaaggggccccttggtaaattattgccccgtgccaaaaa

SEQ ID NO: 21899 - DNA, 317 bp, Zea mays
  Clone ID: cC-zmle18900082e05a1
gggggggggggttttttttaattttcttgtaccccctcaagctgcaataccccgtctactccccattgcgagcgaaattgagaattccaagagagacccggagatcggcggcaacccgaaaatctcggacgaaagtagaacacagattcatctttacccaataaaaagaagataggaccaggggagcataacgggggggtacctactcgcgcatgaaaaaagctagaccctcccctagtcccaataatttcaaaccactcatctaaaagggggggagggggggggggggttcattcatatctcaactaaacccaatt

SEQ ID NO: 21900 - DNA, 456 bp, Zea mays
  Clone ID: cC-zmle18900082e06a1
ttttcctttaatcctagatattcattgtattgggtatgggttaataaaggtttttagccatctaaaatagctttcgaagatataataccgccaatacatatgcagggctaatcactgtttatagccagggtactagtaaaaatgaacttaaacatgaacttgggggccctgtgtatggccaaaaaaaattgcataaaaataataataagatccactttgtaattgacgcaattatttaagcaaaactacatatataagaatttcctcatttagtcgacttcttcgatcttgggtccagcaccgctgccaccagccggcgaagcatcccgatccatgccaccggccatgtcaggaccagcggcgccctgatacatcttcgcgatgatggggggtgcaaatgccctccagctccttcatcttgtcctcaaactcatcaacctcggtgagctggttgtt

SEQ ID NO: 21901 - DNA, 460 bp, Zea mays
  Clone ID: cC-zmle18900082e07a1
gaagcaaatattaggcgatagatataaaagcatattacaccgtatcggaggaacgatgtcagcagggaactacacccgtgagctctgaactgtcaagctgaaatggttatagcaccgccacaaatgaatcagagttttcgttaggaaacccagctctcatcctggatccaatgtttgtaccctacgttttctgctactctagcaccaaaaagatgttgccaaggtatcatcaagtctgcaacgctagaatcctgttggagtggcaagaaaagcagcaggtggcggaccttctatatcatacacagaaaggacagccttacttaatgccttcaaatgtcaagttgatctatgttgatcatgctagcagctttctggatcagttccttcctatattcaacccgggtgcccataagtgacgagaacacaacattgggcctgggagcatcttcaaccctaagct

SEQ ID NO: 21902 - DNA, 298 bp, Zea mays
  Clone ID: cC-zmle18900082f02a1
aggaaattgacgtcacggtatggaaccagttcagtaatgataacagaagtttcaacaccttaacagcaacatactgcagccgagagccaagtgcctaaacagcataacataaatctatcgccagtaacaaactcggcaataactagcagcaaccataactcctcaacctttcatagctttcgaaataaaaaaaaaggtaatattttcgagaaccataattcgtcacattcggccaatctccaaatcaagagcttattcttcctcctcagcctcctcgagccatttgacaaacggctcc

SEQ ID NO: 21903 - DNA, 488 bp, Zea mays
  Clone ID: cC-zmle18900082f03a1
aagcaataacacttcaataacaagggtggggctttaacaagcaatccaatcttgggacaattttttctcaaacaaacccttttgagttcaattcagccaggacaactatagttttggatataataatagtacatagatagtacccaacatgggtaactaatttcgccgcacgcctagcacttgatctccttaagaccatgagagaaatagaggaatgtcggattagtggcaccatccttgtaataggcgaataccacagacgcatcatccttcatggactcaccaacaaagaattggaggtccttcagcttgctaaggagaaacttggttgcaccctcgacaccctttttgaactcatccgctttttctggctccaacacagcagtgagattcttgatgtattttttgatgtaagacacaaatgatttctttgcaaaaggaggttgctcctgtagacggaatgtgtcaacaatttaaccccctttaca

SEQ ID NO: 21904 - DNA, 422 bp, Zea mays
  Clone ID: cC-zmle18900082f04a1
ttttggatgcaactctcgcattctattctatggggccgggcatgcatctagactctaaaaggttctgatgaacatactgcaaactcatgctgcattatatatattaccgggttcctaataggttagataaggttttctccaatccccaagcataaagatagccatcctagcagatggtgacgatgagtgatgaacaatatagacaagcatcactctggtaccaagatcatcattatattatatatataatagtggtggtggtgttcctcaacagcaactgcaacggcaggcagcttagtgcttggggacataagatccctttcacgaggcccgttcggatctgcgtggcattgtttcgcaccgttccggggccattgcgggatgaacaccgatgaccccttggacgacccgccgatctcctt

SEQ ID NO: 21905 - DNA, 514 bp, Zea mays
  Clone ID: cC-zmle18900082f05a1
aagagcctagctgccctcttgtttctctccctccatttcccagcagcgccctgtccctgtcgaagcccttctatggcgcgcgtggatttctcctcctccatccccagctagcctgcgagctcctccctcctccctgcatccatggatctcggcgcccatctccatggctcgccctgcgtccagccgccgcgcccggttccgagtccctttcctggccgagttccctgctccatctctgccctctgccggcgctccagctcctccatccatggccatgcctgctgctcgtcggtgctcgccgcgggagacggcgcttggtcgcccaaccttcctgctcctccctgctgtcgtgtccctggctcctgctccactcgttgcgtgcgcctgcgcgctgcccagatggccgtctgtccttccgtgtcacgcctagctccagctcggtctttgctcgatgcccagcgtcgcgcagcacggctcggcccgacggcataaagtgtctcgtcatcccggactt

SEQ ID NO: 21906 - DNA, 478 bp, Zea mays
  Clone ID: cC-zmle18900082f06a1
cccttccttccccttttttttttttttcccccccctcctcttctgggccgggttctcttcctccctctctttcccccccccccttccccccctctctccccctcccaaaaaagggggagagccccccccccccccccccctcaaaaaattccccccaattccaaagggccccccaaaaaaaaaaggggccccccccccccccataatcaaaagtcccccccccccccccctcgtttcttgctcccctagaacccccccctaacccccctattacccccccccaccaaaaatccccttttcggccaaaaaaagccccccccaatttctacccccccccctctttttttcccccccatcctccttaaacacaggtaaccctccctatgtctcccccccccccaaaaaaggctcccccccctcacaagggttgtgcccttacctcctaaactttcggttaccccccctcaaaacccccccc

SEQ ID NO: 21907 - DNA, 124 bp, Zea mays
  Clone ID: cC-zmle18900082f07a1
aaactgctcctatgtctcaaccagagttgagaaaattacccttgtactatgctccaaccctcaaaggttctccatctggatattgctccttgagtggcacctactccccaaggctatctcccca

SEQ ID NO: 21908 - DNA, 417 bp, Zea mays
  Clone ID: cC-zmle18900082f08a1
aaattaaacaggggggacgtttttcacaacccacaatctattgcaccttttacacagtccacaacttacaatagcttttcctcgaacgacaggtgaaccaaaaacacacacacacttaaccaaacttacgacaccaaatgggtggacagaactaggtcataacttccaagacctggatttacaagaggggcagtccaaactttaaatttcccacttcttgagctccataccatcaggagggctcgcttccaccgtctttgatccaacatctttccaattgggtgagagaacggttccattaaattccctgaatgactagtccatggccctccgcatatcttcatcagcatccttgtcgatatcacggaagaacttgttcaatgcagcataaccttgaagtttttcttccttacggac

SEQ ID NO: 21909 - DNA, 480 bp, Zea mays
  Clone ID: cC-zmle18900082f09a1
tttagataggacaaaacaatatacatatatgatgaagacatgtttatcatagaaaatgacaatagcaaaaatctcgacagcaggatatggcgatatgcacaacagaatgacctgtgaggactcttatatctaaacctagatcgataaggctatcgacaacatcagcactatcgcttctaaggtcatctgtgtaaggcagaagggcaataaagtcccaacaagagtctacttgatgtcctacagctatggcctgatatccatcaagggcaagttcatccattatcatgcttattttctctttaacttctttgctgctgccacagtgatgagcaacctttgcaggatcacctttgaatacgcaacacttgaatctattgccttcgtcgatgtatgtagtctggaacatcagcttcagtgcaacaaagaaactggcatgatgctctaagacttgaacaccgagtcgtgcctgcttcggatcat

SEQ ID NO: 21910 - DNA, 316 bp, Zea mays
  Clone ID: cC-zmle18900082g02a1
ggggggcccaccaattttattgaaaaaaaaaaaaatttcaaacgtccagggccaaaaaaaaaccccttaaattttttcaagaaacccaaaaaaaaagccctccgtttgttttttaagacaacacaccccacccggtgggaaaatatttacctaaaaccaacctcgtgggggccaaataaaccggggcaaaaaaactcttccccttaaaaaaaaaaaaataccggttttttttaaaaccccccgggaaaaatttaaaaccttaaaccccctctttatttaacagataaaaaaagccctcccctttttttaaaggggg

SEQ ID NO: 21911 - DNA, 329 bp, Zea mays
  Clone ID: cC-zmle18900082g04a1
ggttggggtaaaaacaattattggtcaaaatacttcactctctttaaaaaaaaatattatatgcataaaacactccctcatttaataatccccacccatgaccaatttccccattaaaatctaaaaccaaaaccaccttctattacttctctctgatagaaaaatacacataggacatcggcccacattacgatataataaaaatcgaaatatctgttccaattcctgcgtaaaaaaaatggaaccccaggaaccaactcataagctggtccttttacatctccctagacacttaatctctcaaccttcttaaaaaaaaaaaacccccc

SEQ ID NO: 21912 - DNA, 379 bp, Zea mays
  Clone ID: cC-zmle18900082g05a1
ggaaaaaggcatacatttattcatgacaaaatagcggtacgcccaacttaaccgatagaacataacggggcccaagacgagcaaatagataaaacgagtcccttgtccaggatcccaaaaatatgcccctgtagtaatgggaagttcccaaaaacaggaccagggaacccgtacccaaaatacaactcaggacattatatgttatgacgcgacattcttaaaaactccgaaacaacaaaaaccctttcagttccttccttcctggacacgtacaaaaaacacgagcaagcgtgacttgggggcgggttcaaacttttggtgcctttggagagttctcgggcgtctttaggggcagttcctgggccctgcttggtttggg

SEQ ID NO: 21913 - DNA, 459 bp, Zea mays
  Clone ID: cC-zmle18900082g06a1
ttttagcttaaggagtcactcaacaccaccacatgataaacaggacccatgcccgtcataattgacccctcaacaccatgttccaactagcactgatgcaaaagcatctgcgagaaggggcgataagaaccaacataacttgtaagggatcattgtgcaaacaagatggtcactgtcagcagcttcggcatcggcatcgtcacatcagctgcaccattgccatatcaacaccaatgacagcaagacatcatccaccatagttggtcccgtgcaataccgttctaccagtataacagcaacccatctcacgaacagataacttggatcgcggttgattgcagactgctacttccattgtgctcaatcaaccttctcaaggttctgcaatcccgtgacttcgtgagaaggcttgtttctaggcatcaccaaatcagcaagctttactcctgacgtgaattg

SEQ ID NO: 21914 - DNA, 607 bp, Zea mays
  Clone ID: cC-zmle18900082g07a1
taagcttgcatcctctaaagcggccgcccttacatatttttttttttttttttttatatcttttttattttttggtgattgataatattttttatacattttttatccttcccactaattatcttattttcattacttacaatccttttttctgggaaaaaaaaaaactatctttaaaaaaacaaaaaaaaccaacaaaaaaaggccccctctaaataaaaaaaaaaaaacaataaaaaaaaccctcaaaaatttgtaaaaaaaaataataaacccccaaaaaaaccaaaaaaaaacaatggtccctcaacccccccaaacggagaaaaaaaaccaaaaaaaaaacggggaaaaaaatcaaaccataccccccataaaaaaaaaaaccccaaaaaaaaaatcccttcccccaccccctttaaaatggccaatttttgcaaaccttccaaatacccaaacaaccccatatacacaattgcccaacccccttttatacaccaaaaaaaaccccacccaccccccaaaacacccaccttcccaaaaaaaaaccaaaaaaacctagccaaaaaaataaaaaaccctcctcctaaaaaaatattcccctaac

SEQ ID NO: 21915 - DNA, 246 bp, Zea mays
  Clone ID: cC-zmle18900082g08a1
ctctccgggggtggtgtttttttctttttcttttttttaattcattccaaaaaaaaattcctcccatcccccttttatcgaacttttccccatcaaaatgtttgtgccccctttttctacctcccctaattctgttttaggtttcaccaaaaagggccagagccctttttgcctctgtccttttatgaatcgcttccttttcgcgtaaggcaccccccccccctttggcggtctttcctttttcgg

SEQ ID NO: 21916 - DNA, 367 bp, Zea mays
  Clone ID: cC-zmle18900082g09a1
ggggacggaaactaatgatgggcattggcgataggccttatgttatgcaagaagcaagcaaatgaacatgtaaatataaaaagagacttggtaataaaattacacaaggatcatcatgcccatttcaaatcatgccaccaccgtaccagcagccaaattacaattttctgtgattaatagaagaagaagttctttaatttggatcccggctggggcgtgcggcgtacgtgaagtgtgattagtctaagggggccttgccggaaaacttgacgtcgatggggttgacctttttgccgatgctgaggaaattttggccgacgcccttcctgccggggttgaccttttccgggaagaccccgcccttggg

SEQ ID NO: 21917 - DNA, 391 bp, Zea mays
  Clone ID: cC-zmle18900082h01a1
attattaggaaatataaggggtggtttcttggaggccacatacattatccaaaaaactttattattgaatgacaactaataagcaatctaaaagagggcacccccaatgatgtgttgttgggagaaggctgctgggcttgtcaaagcaagttggacaaagggcaccaacctgtgcagttgtaaaagggttgcggggttagccacaaactggtggtagaacggaagcaattgttgttgtgtcaaaaaggaagcggggctttgttgtaactatctttccaaatgggaggagtttttgctgctgtaaataaacagaggggttcagtgcggcgaattgcttaaatggaaaaaattgttgctgctgaaaataggccatatctatctggctgaatgg

SEQ ID NO: 21918 - DNA, 468 bp, Zea mays
  Clone ID: cC-zmle18900082h02a1
agtattacgaagaagttttattgaggggacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggtgaccatggtggtggtggtggttggcgccggcgcgtgagaccgtgtcgacctcctcgaacttttccttgacgacgtgctgttggacgccgccgccgtggcggacgaagccggccgggggcaccgacctcaccttcttcgagcagtagtccaccttctggtagtaagccattggtgccgac

SEQ ID NO: 21919 - DNA, 396 bp, Zea mays
  Clone ID: cC-zmle18900082h03a1
atagggtcaaaattatgtaatgaagagtagcactgattattgttacatgacgaaggttgagcatccatggaggctaaattataaacagacaccctgattttacatgacgaatcgcaagaagcgcatgcattggatatccttaaccggagagggcgctggtgttgtaaaccaggagggcgccgccgccgaggatcccagcgagggtgacggcccaaatcaaaagcccagtggttccaccgacgtaaacgtcgccggggggagaccaggcatcctcgctgtaaattgggctgtatccgtcgacgttcgcgccgtacttgtcgactaactggtacacgcccttgcccttgccctttctcccgttggcgtcgacctctacggtcaagccacccccaatcc

SEQ ID NO: 21920 - DNA, 485 bp, Zea mays
  Clone ID: cC-zmle18900082h04a1
gaaggataaacaatttattatttatccctgtacaaacgataatatctgtttcatgaaaggaatagaacaaacagctccaagtacaaatcatcaacactcacgccacgctggggcactggccaccaaatgcgaaacctgttccacgtactggagtgcagaaacggacccagatctcacaaagacgcaaactgcacgggcgacagccgacacccttgcgttgtgtaaaaacccagaccaactgcgcacatcaggaacatcctaatatggcactgttgttgaaaaaaaaaactaaactgacctgacgatctatactgctgaagtactgcacatgtttcttcatgtagtaccatcaatcgactttaccaccttgcacaatgctccatggccaacagctcttcaatatccagaaagaacgaagaatgctagcgagaccacgggacaaacttgcatcccaactaactgaaaatgcaagcaacagatatact

SEQ ID NO: 21921 - DNA, 513 bp, Zea mays
  Clone ID: cC-zmle18900082h05a1
tttttaatgatatttgaagtaaatgttcctcagtttcacatatgcaagaatccgtggacagtaattgactacgaagtatgccaaaaacaaaatgttaagcaactggcgaattccttgggcaacataaatcagcatgttttaatccctttgctccatcacatcccgcaccccagaagctatccaatcaggctaagacaccggaaacagggcagaggtaaatcaccttggacacttaacacacgactactgtgactgtaaaaacgacggcattgaacctattacaccattacaacacgagcacccctattgtccaattagcaatcacctgatctcctagttattggttgtatggagagccaagccaattattggattcacattgcagtatacatcatcgatgctagccaaatgttcgaccagcgacgatagtcacaattaggacaatacacccggcatcaaagaagcttggacgcccacattcagatggtgatcaccacacacctctcgtcaagt

SEQ ID NO: 21922 - DNA, 249 bp, Zea mays
  Clone ID: cC-zmle18900082h06a1
agtccgcgtctagggaggaattgaaccttgatttaccatgttcaatacattttgctgatctcaataagagcagtactagatcggtgcaccaggcgacaagctggccacccatgaatcattaccgattcaactcttcacgtctccgttttaaaacgcatgcatctacctttcctcatcaaacatcgggtggtagacgcagtaggattgctgatccaccatcattttaaagtaactagcggctggtttgca

SEQ ID NO: 21923 - DNA, 367 bp, Zea mays
  Clone ID: cC-zmle18900082h07a1
cgaaatgctctttctttggattgggattcaaagagaacaccacactccacaccttatttttacatgcaaacggattgtaccaacttacagacaatgtcaatcatgtgatgaccttccaatgtgatcccttgtaacaggaaccaaatgggataatgatgatcgacacctaacttctgttgctcccagctgtttatgactacaaaatatcaaactggttcagggactgtgagcccaattttaatgccacctatgcacattaccatgtgccttgcctgcactttatttggggcgagggaaactccatttgcaaccatccaggggggctcatattgaaagaacttaagccaaactttgaagtttctggttt

SEQ ID NO: 21924 - DNA, 82 bp, Zea mays
  Clone ID: cC-zmle18900082h09a1
cttattatcgggggcggggtttttcatactgtcatttacaccaaaacatttgttttgccgtagggtacacaaccctaccact

SEQ ID NO: 21925 - DNA, 287 bp, Zea mays
  Clone ID: cC-zmle18900083a01d1
ccacgcgttcgacggcggctacgagcgcgccaaggagttcgtggccctttttaagaccaacgaccccgagggggacaacgggggagactttctcgcctggggctcactcgcccacatcgtcgcctactacatcctcgccacctccatcaacggatacgaccccaacttcttctgagcggtcgtcggggatgtactctacagacagccgtgtgcgtgtgcttgtcatgtattcgatcaaagtttggttaatttggacaagtagtgcaactgcagaataattggtaaaa

SEQ ID NO: 21926 - DNA, 601 bp, Zea mays
  unsure at all n locations
  Clone ID: cC-zmle18900083a03d1
gccacgcgttcgaataagacgacttgtttcattgattcttgttgagatcttttcttcttttgcaccacaaggggggggatggcttgcaactgcggatcaagctgccgctgccgctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgatagagagagaaacagagttcttcagtttgctatctttctctgcatgtttgggcgcaagctttgtgctcatgtacgtacgtgtgtctacccgcatgttggttgatcccaatgcatctgctgtaaccatatattaattgggccacgatgatatgattngatgctatatatattcct

SEQ ID NO: 21927 - DNA, 308 bp, Zea mays
  Clone ID: cC-zmle18900083a04a1
ggaaaaaaggggtttctccaggagttgaccttctttaaatgacaaatcccgaaccaccagtttactcacgcagaagatgacaacaacataccactagtgtacactgtacagacaccatgacccggccggcacaacttggatggtcccgtcccccctcctgatcactctaggtggtcatgcggccggagcgacatgaacatggccgcgtattgtctgagccgccggtccccgtcgttgggtccgcccgccaacggcggggcggccattgccgccaggtccgtcgatgcccgggccctatacctgcgcca

SEQ ID NO: 21928 - DNA, 578 bp, Zea mays
  Clone ID: cC-zmle18900083a04d1
aggctcgtttgcttatggaatctatttgggggctcttcctgttttttcgagcttttcgcttgctgtcaaaattcgggatcctggagttttggggcctcatgacactcactacttttggtaacgatcttgccccaacaagcaatggtattgaggtgatattcagcataatcaatgtcctcagtggcctgatgctcttcacattgctgatcggaaacatacaggtatttctgcacgcggtcctggcaaggaagcgtaagatgcagctgcggttccgagacatggaatggtggatgagacggaggcagctgccgtctcggctgaggcagagagtgcgcaaatatgagcgcgaacgctgggccgccgtcacgggagacgaggagatggagatgatcaaggatctgcctgaaggactgaggcgggacatcaagcgctacctctgcctcgagctggttaagcaggttccgctgttccatggcatggacgatctgatcctggataacatctgcgaccggctgcggccactggtgttctccagcggggagaaggtgatcccggagggcgaccccgtgcagcgcatg

SEQ ID NO: 21929 - DNA, 351 bp, Zea mays
  Clone ID: cC-zmle18900083a05a1
tttttcacactttcgtacgcattttatgcgtactgtagtttttaggcaatctgcggagtaatcagtacatataccaccgagacggctagctagccagcttcttcgtcgtacaagatcgactaggtacatctgctaccacagcagagcgaagaattataatcgaatgaacggccagctagctagtagctccacactccgtgcattacatactactacgtacacgttctgctagctagccggccgagatcgatccggaacgacgacgacgacgtacggtgtatatacagctaagcttcacttccacttggcttatttttattggtcggtcgtcttctccgagatgatagatag

SEQ ID NO: 21930 - DNA, 343 bp, Zea mays
  unsure at all n locations
  Clone ID: cC-zmle18900083a05d1
atctgggagaagacgaccgaccaataaaaatattccaagtttatgcgaagctcacctgcatagggaccgnggggcgacgtcgacgcgccggatccatctcccccggctagctagcaaaacgtgtacgtagtagtatgtaatgcacggagtgtggagctactagctagctggccgttcattcgattataattcttcgctctgctgtggtagcagatgtacctagtcgatcttgtacgacgaagaagctggctagctagccgtcttcgatcgtatatgtactgattaatctgcagattgaataaaaactacagtacgcatatgatgcgtacgtacgggtgaaaaa

SEQ ID NO: 21931 - DNA, 494 bp, Zea mays
  Clone ID: cC-zmle18900083a06a1
ttttaaacttttatagcttggttttttgatggttaccaaaatatggatttcacaggagtgtccaaggcaccacaattggataaacaattcacagtttaggcagaagtagccatataaggtgatgaatgagctcggaacccatagtgaagattgaaaaaaaaaggatacacggaagtttcagacacggttcatcctatgttttctgaaacatgtccataaaaagtggcacaaaagaagggtttatggtgtggatgcaaagttataccagctttcttttcttcttatgcctccttttgcgccgtggtttatgaacatcagaatttgagctcagattactgttattatccgcggggcgatttggtactcttctatttttaaatgattcgccgcttgtgctgtttgaagtactgctcgagctggatatcgcacgtttatctgcatgtctgcctctatttggggctaatgagcgtggtggcggcataagaactcgagca

SEQ ID NO: 21932 - DNA, 557 bp, Zea mays
  Clone ID: cC-zmle18900083a06d1
acgcgtgggccgccgccgccgccaagaccacctccctttttaaccttttccgctccaccgagcgcttcgggggcaagggccttccggatgagattagggtcgctcaagagaagaaactggaagaactgaagaggcaacaagagcttcagaatcaacttgttgtccagcggacattacagtttagagatagaaagataaaattctttgagagacggaagattgagaggatgataaggcgactcgagaagcaacaacgttcaaatggtgacggtgtcaacaataatctgtcaaaattgcgagaagatcttgaatatgttagattcttccctaagaatgagaaatatgtctcgctgttcactggagggaacagtcaagatattgttcaagagaggaataaatggcgcaaacagatcaaggagaatctcatggctgctgcagcaaacggaaaagatttagaagagacagcaagcgacgacgataccttggatgtgagtgatgatgacttctttatgtctggaagttcaagtgatgaagaggctgatgaataatggactgac

SEQ ID NO: 21933 - DNA, 274 bp, Zea mays
  Clone ID: cC-zmle18900083a07a1
ggcggggaaccaggaggggaataaacttggcctatacatatacatgtgtaatggggggttcgaatacacgtcctgcaataaactcgtgtaatgggtggttcgaatacatgtgtaataaacttgtcatatacatatacatgtcctttggaataatttccaacctgtacccgcgtgtgcaaaatctgcaggtgccgtattttcactgcccctccgcctgtcgagcccgttggtcctcagttacaaaaaaggcacggacccctgggcggacccgtgg

SEQ ID NO: 21934 - DNA, 254 bp, Zea mays
  unsure at all n locations
  Clone ID: cC-zmle18900083a07d1
gtgccttttttngaactgaggaccaactggtttgacattttgaggggcagagaaaatacggggcctggggattctgtacacgcgggtacaggcctggaaattattgcagaggacatgtatatgtatatgacaagcttattacacatgtattcgaaccacacattacacgagtttattgcaggacgtgtattcgaaccacacattacacatgtatatgtataggacaagtttattacagtcctggttgattgctg

SEQ ID NO: 21935 - DNA, 420 bp, Zea mays
  Clone ID: cC-zmle18900083a08a1
aaataatgcatgggaatcctttggcatgattaaagcaaacatgtccatagctcaaaatgacagaaatcacaggacgcgccgatcgaacgctcgatttctggctcctggaatctataacatttaacaaaccttatgcagcttaatataagtaaataaatactagagaagatactgctggcactggtgggatgattactcctgatgcagtgcggctgcggcctccccttcatgagcatcctccagtactgggaaaacaggaggcttgacgagcatgaacggaccaacactgatgaaatggtcgtcgtctggctgcctctggtacacctgcttcacctctctggtcttgacgtgcatgtacgcaacgacgccagtcacaccgagctccaagaacacgaactcggcgttgtccccggggcccac

SEQ ID NO: 21936 - DNA, 447 bp, Zea mays
  Clone ID: cC-zmle18900083a08d1
ggggcatggtcaacgcaagccccacttttctgttgacacccccctcaagggtacggggacatctcttacaacctttccctagagcccactgctcgcggccggctaccaccggctggctgctgccctccatcagtttccgccgacttctgccgaccaccgccgcgcctacttggatctactttcagcggcggatcttgggtcggagttcatccattcggcacctgctgggctctagccggagtagactgtcctaaccatgccatgggtggggcgacctccgcgccagcgttggactgcgaacggcatggtcctttcccttcggggcagacctttaaccccgctggtctcctggcgttccccctgtgaatccacatgccaaagcgggtgctccccgtcgcgagccgccacttccgggtacctcacgcgagttctcctacgacaagcgac

SEQ ID NO: 21937 - DNA, 350 bp, Zea mays
  Clone ID: cC-zmle18900083a09a1
gcccccaaaccgttccctttttaaattcaaaaacccaaaaaaggcccggggggaaaaaacaaacccaccccaaccttttccaacaaggtgtttaaacaaacccaccctaaaaaaaccgggcctatgggtggttaaaacacttctttaaaccccccccctcccaaaaaaaatttgaaaaaaaaaatgaaacccccttgaaacaagccacggccccctgggccgacccctttgttaaccccttaatatccgacccggacccgcaagggaacccaccttccccataaggaggcgcattaaaacctggcgaaaacaagggcaaaaccgtttcccctgtgaaaattgtatcccct

SEQ ID NO: 21938 - DNA, 219 bp, Zea mays
  unsure at all n locations
  Clone ID: cC-zmle18900083a09d1
ccaggcgtgcgctggctgtctcaagcagctatcatatactatttcaaattctatacngcaagcgcgaagngggaaacaagggctgacacaaccatatgcacaccctatctaacgttggtctgttctatcagcttgttgggaaaagtttgcgtgagcttgaatctagccccctgtactctctctggtttctgaatttgaatacgaaacagcttgatcgct

SEQ ID NO: 21939 - DNA, 386 bp, Zea mays
  unsure at all n locations
  Clone ID: cC-zmle18900083a10a1
ttttagtatttctaagaagttttattcaggtcacgagcttatgggggtaattcggacaggagctgagtgcgtgcacgtacgatagccaagtacgatgaccctgcacaaccagtcaaccacagacatacataatgcacgcaggcaggcacgaacgggcgtggatgccggccgccgggcggctcagttagccctggcgaggaagctctccctgcgctcgtggacctcgccggtgcaggtgttgatgtcctcctcgaccctggtctcgcgcaccacgaagccgtggccgccgtggtgaccatggtggtggtggtgnngtggttggcgccggcgcgtgagaccgtgtctacctctcctccgagcagtagtccacctcctggtagtaagcc

SEQ ID NO: 21940 - DNA, 376 bp, Zea mays
  Clone ID: cC-zmle18900083a10d1
taccaggaggtggactactgctcggaggagaggtcgaatggtctttttcgccggcgccaaccaccaccagcgccaccatgggcaccacggcggccacggcttcctggtgcgcgagaccagggtcgaggaggacatcaacacctgcaccggcgaggtccacgagcgcagggagagctttctcgccagggctaactgagccgcccggcggccggcatccacgcccgttcgtgcctgcctgcgtgccttatgtatgtctgtggttgactggttgtgcagggtcatcgtacttggctatcgtacgtgcacgcactcagctcctgtacgaattacgacaataagctcgtgacctgaataaaacttcttcgtaatactaaaa

SEQ ID NO: 21941 - DNA, 407 bp, Zea mays
  Clone ID: cC-zmle18900083a11a1
gggcacgccaccacacgggcacaaatatttttatgcaaccatttccccctcaaaagccaaatccagctttgagttcgacaatccataaacaacgccacacttggcacgttcagctgcttttcttggcaaaaaaccccccgaggcccccgaggtttaaccccccgccgtttccgctttcgtcgccgccggtagccttcttgccgccggtcgtcttggcccgggaggcggtggccggcgcggcccccaccttgttgaggagcgggtccgtttccaccaactggtccttcttgaaaataaaacccaaaatggtttctccgaggcccttctcctccttggccggggccgggcccccccttctggcagggggcggtacgaccaacacggaccggtgcgcggacgccttggtt

SEQ ID NO: 21942 - DNA, 264 bp, Zea mays
  unsure at all n locations
  Clone ID: cC-zmle18900083a11d1
ccgcccgctgccagcaggggcgtttccggcgtttgccaaggaggagaagggccncggggagacgaggggcggctacaaccgcaagaaggaccagccggcggagacggacccgcnccncaacaagggcggcgccgcgccggccgccgccacccgcgccaagacgaccggcggcaagaaggcnaccggcggcgacgacagcggcagcggcggggggcacaaccncggcggccacggcgggcgcnncgccaagaaaagcagcngaac

SEQ ID NO: 21943 - DNA, 294 bp, Zea mays
  Clone ID: cC-zmle18900083a12a1
tttttagccttttatactacctttattatacagcttgatttgaggtcaatcacagcaggatattacaacatgagaaaagggggaaaaagggaaaacgccacaaaataaatgtctctctctcacacacagctcatccactgcctgactgaacaacctagctgctgctgctgcttgcttctgctcacagactcaacggtgccctcttgcacgtagccactcttttgtacagattctccatgggccttggaaatttcttttcttccttggttgcatggacggacggacaaaaacaat

SEQ ID NO: 21944 - DNA, 283 bp, Zea mays
  Clone ID: cC-zmle18900083a12d1
cgtccgtccatgcaaccaaggaagaaaagaaatttccaaggtttttggagaatctgaacaaaagaggggctacgggggagagggcaccgcggagtctgtgagcataagcaagcagcagcagcagcttggttgttcagtcaggcagtggatgagctgtgtgtgagagagagacatttattttgtggcgttttccctttttcccccttttctcatgttgtaatatcctgctgtgattgaaatgaaatcaagctgtataatactggtagtattattaggctaaaaa

SEQ ID NO: 21945 - DNA, 351 bp, Zea mays
  unsure at all n locations
  Clone ID: cC-zmle18900083b01d1
cggcgagaacggtgagtttatctacaagtttgattctatttagaaagtcttcacggcgaccgacctgccggggcgtggggtccggttcagcaacanaaagggccaagcccccgaacccggacagaacataacgctcgtgagctttcagagggagggggacgctgtggcacgagcgcgggagctacaaagggctagcctggctggggcgcctgttaggatcgagatttccaagggggtcagtgtaaaacatcctccgataataaaatgaatattaaaacggactccaagcaataaacggagcggtgtgcttctcttgaaaaaaatactcaagttaatgagaggggggggggg

SEQ ID NO: 21946 - DNA, 434 bp, Zea mays
  unsure at all n locations
  Clone ID: cC-zmle18900083b03d1
ggtgtctccttgtgatatggtgcttcttttttcctttattncccgaaggacaagccggactggggatcaataactcgtggggcgagaactggggggagaacggatactacaagatatgcaggggttccaacgttcgcaacaagtgcggcgttgattccatggtctctaccgtgtccgcagtccacgcctcgaaggagtagactctggtcagcggtgataatcgtgattccatatattgtagaactataatccctgctagtaatccatttgtgctgcttatgtatcgaaggcagcaaagatgtgtgaagcggcaatgggatgcttgcggtaaggtaatatgtttagcttgctaggcatgctacacgctatttggatgtagcaacgttatcaccagctggatacgctttttaatcgacaacatttgaatataaaaa

SEQ ID NO: 21947 - DNA, 78 bp, Zea mays
  unsure at all n locations
  Clone ID: cC-zmle18900083b04a1
acttcncnnattcnagaggagaccctttgagaaaaaatttactaataacccccaaaaaaaccccacaaaagagcatga

SEQ ID NO: 21948 - DNA, 427 bp, Zea mays
  unsure at all n locations
  Clone ID: cC-zmle18900083b04d1
ctccttgcaggatatggcgcaacngttttcgcctccatccgccagaaggacaagccggggatggggcaacaataacaaacggggccagacctggcccgagaacggacacaacaagaaaagcaggggaaccaacgaccgcaacaagagcggcgacgacgccagggacacgaccgcgcacgcacaccacgccacgaaggcaaagacccgggacagaggcgagaaccgagagcccacaaacagcaaaacgataaaccctgctagtaatccatttgtgctgattatgcatgcacggcaccaaacacgtgcgaaaccccaatatcatgctggcggggggggaatatgtccaacttgctaggcatgcgacacgctaatttggatgtagcaacgttatcaccagctgtatacgctccttaatcgacaacatttg

SEQ ID NO: 21949 - DNA, 413 bp, Zea mays
  Clone ID: cC-zmle18900083b05a1
catgacatgcatggttcatgttctgagtgcatgcttctttaagaaaagaagaaatgaacataaattgttcagcaggcatctgtggcccacgagacaataaaaacagtgcccttcacttgttagaggaaacattttattcaaaaggacagattaaaattgcagacacaggaaaaccttcaacaggacagcctctgcattccgatgatgcttcttttatccaaaaggctgttagaagtcaagtggttgcctcaagaacgcctccatttgcttcgccctgttcctgattgagatatcaagcaccttctgcccgaattcaatcactaatcctcccatgatgctgtagtcaatcttctgttcaaccaaaatagttttgttttccccaaggatatcctgcaaggtttccttgagttctt

SEQ ID NO: 21950 - DNA, 612 bp, Zea mays
  Clone ID: cC-zmle18900083b05d1
cgcccacgcgttcgcgcaagaccacctcaccagcctcctcgtctttgatcttttcccacccgcatccaagggttggcttctggaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatgggacaatagggggagatgaaggtgtggtcaggacagttatttcactca

SEQ ID NO: 21951 - DNA, 278 bp, Zea mays
  Clone ID: cC-zmle18900083b06a1
ggttgggacaaaccatttcccttggctttataaaacattgggcccttacctttcgagccaacgggtgggggggggccacccaaaatgtttcaagtttcccccgggccctggagaccaaaaccaaaccaaatggaagcctgctttatacaggcacaggggggggtttattcaagggaacaacccccggaaggccctttcctttcaacaattccagggttgcgcccccccccggggaaatgggggtcataacgcgaggaacccccacctttttgaggggg

SEQ ID NO: 21952 - DNA, 526 bp, Zea mays
  unsure at all n locations
  Clone ID: cC-zmle18900083b06d1
gggtgctcctgtgtgcttcattggtcgatttgactttttgagctnggacgtctctggggcaaaggctaatgaaaagggcgtctcccttatgctgccaactgatgttgtcattgctgacaagcatgcccctgatgctaacagccagattggtccagcatctgcaattcctgatggttggatggggctggatattggcccacattctgtcgcttcattcaacgcagccctggatacaaccaagacggtcatctggaacgggcccatgggcgttttcgaatttgacaagttcgccgtaggaaccgaggctgtggcaaagaagctggcagaactcagcggcaagggcgtcacaactattatcggaggtggagactccgtcgccgccgtcgagaaggtgggagttgctgaccttatgagccacattttcacgggtggtggcgctagcctggaattgttggaaggaaaggagctttcgggagttgttgccttgaatgaagccgccactgtgactgaatgaagcatgctttca

SEQ ID NO: 21953 - DNA, 284 bp, Zea mays
  Clone ID: cC-zmle18900083b07a1
aattaatgcatggggatccctggagctgattaaagccaaccttcccataagtcacaatgacagaaatcacaagacgcgccgatcgaacgctcgatattcgtctcctggaatctataacatttaacaaaccttatgcagttaaacataacgcaataaataccacacaagactccgctggcactgctgagacaatcactcccgattccatgcggctgcggcccctccttcatgagcatcctccagtcctgggaaaacaggaggctcgccgagcctgaacggaccaa

SEQ ID NO: 21954 - DNA, 294 bp, Zea mays
  unsure at all n locations
  Clone ID: cC-zmle18900083b08a1
aaaaaaaaaccccgacccccaaaaaaacccaccgaaaaaaaaaaacaacaagagcaaaccggggaccaaccaaaaagacccaaccccgaaaacaaaagccacaaaaaaaacaaaaaagagcnaaaaccacaaaacaacaaaacacagccaggcaaggcaaacccaaaaacaacccacaaacccgccaaacaaaggagggaaacaaaaacaccggaacggcgccaaaaaaacccccccccaccaaaacaccccnaaaaaaaaacaaagagggaaggccggaaaaacccacacaaa

SEQ ID NO: 21955 - DNA, 346 bp, Zea mays
  Clone ID: cC-zmle18900083b08d1
acagggccccccctcccccaaaaaaacaatcacaagcaggcggggcgcccagggacagagccaaaaccaaaggccctacacacgttatagccaaatatctccatccaaattaacagagcttgcacaaaaacgggactagacgctaccgctagatagagtattcatccaaagtggaacctaccgcttcagccaccatggctggcacccacaatcataacttgcacaagcaacctacccttaattttcgggggaacgacgacactaccctgcacctcttacatttcaccctcaattgccttcccaacccctggtcagtgtcctgtccataagaggaaacatagcttgc

SEQ ID NO: 21956 - DNA, 497 bp, Zea mays
  Clone ID: cC-zmle18900083b09a1
ttttgtccattttcaaacatttttagcaagctgaatcaagctggggagtatcctgacaaaaagctagggggagggaaatcagcatccgcaccagcgcaaagttagtagcttacatagcactgcacggttaaacaaaaaaatagtctgatctgtcttcagcacatcaccgcaacagggtgaagggttggaacatcttcagcggacttcacacggcggcggcgttgatgatgtcgatgaactcgggcttcaaagaagcaccgcccacaaggaaaccatcgacatcaggctgtgctgccagctctttgcagttcgcagcagttactgaacctccatagatgatccttgtagattcagagacctcagggctgacattgatctttacccaatccctcagggaggcgtgcacttcctgagcctgagctggggtggcgactttgccagttccaatagcccagactggttcataggcaagaacaacgttgcttcagtccttgatc

SEQ ID NO: 21957 - DNA, 304 bp, Zea mays
  Clone ID: cC-zmle18900083b10a1
ggatcttgtcacggggggattattattattacccataggtgcggaccgcaggcccactaggctgcaatctacaactacaaatgacatgaccaatcgggggtattaactgggccgggctgggcatcgaagagggctttcctttcatgcaatgtaagcgcatggggtttttcttcttctcccttttggggccgaaacgtcacgttttgctcgccttatcatatccttggcaatggcaaaatggagctttggaaaccggcgacaaacctgctcctgctgcccctgcagcccttggcggacgacgacc

SEQ ID NO: 21958 - DNA, 82 bp, Zea mays
  Clone ID: cC-zmle18900083b11d1
caaaaaaaaaaaaaaaaaaaaaaaaaaaaaaatttttaaaatttttaaaaaaaaaaaaaaaaaaaagggggggccggggtaa

SEQ ID NO: 21959 - DNA, 480 bp, Zea mays
  Clone ID: cC-zmle18900083b12a1
atcagaacacatcaagagatattagccatatagggagttcttcagatctcagatacactccacattaagttcaactcccatcgaggctcaaagcagtttataagtaacataaaactcctagcacataatcattgatagcaaaaactagagcgataaggagtaataggcggtaggaccaccatcagatccccgcgaagcgcctagtccatctcctggagagacgcgccagtggcggcggcgccaccagcagcggcggcgacgtcgtcggcagtaaacttgcccttagccttgtcggcggcgcggccccgggccttgcggtcgaggagcgccttgcggtccttgtcaagcttcagctttgtaaccatgaccttggaagggtggatgcccacgttcacggtggagccgttcaccttctcgcgggtgatccgctcaacgtggatgacccagcgacggcggtacacctgcaccactttgccctca

SEQ ID NO: 21960 - DNA, 607 bp, Zea mays
  unsure at all n locations
  Clone ID: cC-zmle18900083b12d1
acacccaggcgcggcgcatcggcctcccaggtaagcagtattttccacctttgccgccgccatgaagcgcaacgggggcgtggggagctcccgccggaagtgccgcacggcgcacttcacggccccgtcctccgtccgccgcgtgctcatgttcgcggcgctatcgacggagcttcgccacaagtacaatgtgcgttccatccccatccgcaaggacgacgaggtgcaggtcgtgcgcggcacctacaagggccgtgagggcaaagtggtgcaggtgtaccgccgtcgctgggtcatccacgttgagcggatcacccgcgagaaggtgaacggctccaccgtgaacctgggcatccacccttccaaggtcatggttacaaagctgaagcttgacaaggaccgcatggcgcttctcgaccgcaaggcccggtgccgcgccgtcgacaaggctaanggcaagtttactgccgacgacatcgccgccgattatggtggcgccgccgccactggcgcgtctttccaggaaatcgactaggcgcttcgcggggatctgatggtgggcctaccggctattactccttatggcctagattttggtatcaaagat

SEQ ID NO: 21961 - DNA, 516 bp, Zea mays
  Clone ID: cC-zmle18900083c01d1
gcgcgaccggtaccgcatcttcgacgacgagaacctttacttcttcagcgacacgagagaggcgagcgagtcggggcggcccggacgccgccggccgccgtgggcagcgagtagtttgggggggaggcggcgccgcgcgctaccgcaacatcagagagagacctctctgtggctgtataggtagagtagcctgtactgtttaccacccctcttccttccatcctatttccacctagtatagaggtcaaacctcttctccgtgtagtgacggaaccttttcttaatttccatctttttactgttctgaatcaagtgattagaaagaacatgtggagggggacgagatacgttcatgttcaccgtgtttgtatatgccggctactagaactttgaatgagctaccacagatacatacagtatcagtatatataacagattatacatgtacgaactgatatagttttctactgatagagaaaggcaaaggcgcatttgtacctttgctgattttgaccc

SEQ ID NO: 21962 - DNA, 510 bp, Zea mays
  unsure at all n locations
  Clone ID: cC-zmle18900083c02d1
ctttttttttttttttttttttttttttttttttttttttttttttatttttttcaccaccacctttttcnggattaagggttttttttttttttctttttccccttttttcctttttcaaaaaaaaaaaataactcaaaaaacatttcaaaaaaaaataaacaaaccggtaataatccccccccttttttatccaaaaacaaaccccctaaaaaaaactaaaccaaaacctttctttcaaattttttccaaccccccctttttccgggttttaattttaaaaaccaaaaaaacgctcccaaattaaaaaataatccccccccccccaaaaaaatttttgggggaaagtttttttaaaaaatttttaaacccctcaaattttcctccttctcaaatatttctataaaaccacccccccctttttaaaaatcaatattttctctcccgttttttacaaaattaaatctcttttttaaggaaaccaaaaataaattaatagccccccttttt

SEQ ID NO: 21963 - DNA, 528 bp, Zea mays
  Clone ID: cC-zmle18900083c03d1
aagatgaaggagatggcgccggacaacttacggctggatttcgctgttagccgggagcagacaaacgcgggggtggggaagatgtacatccagacgcgcatcgaggactacagggaggagctgtgggagctgctgaagaaggacaacacctacgtctacatgtgcgggctcaagggcatggagaagggcatcgacgacatcatgctcaaccttgcagacaaggacgggatcgactggatgcagtacaagaagcagcttaagaagggcgagcaatggaacgtcgaggactactgatccatccttccgttgacgactgcggacatcaatcaaatcggtggcgcggggccgggcccgagtctgttagactcaggtctctatctaccgatgtacatataccttacgatgatgaaagacattctctatctatcaatgtacatacatacatacataacttactttcacacggattgcatcgtacatggattcatttatggatgagccgacaaatttttcttgggggcctctttg

SEQ ID NO: 21964 - DNA, 511 bp, Zea mays
  Clone ID: cC-zmle18900083c04a1
ttttactattttttattctagtttattctcgtattatttttctggccctccttggattctttcaatgaagaattatcttcgatttttttgattttgacttgattgaaattaagtggatgcagtgaaaaaagaagttgaattagactactatttcaatctactaatcgattctatgtagattcaagataatataatagaaagaatctaaagtgtggtagaaaaaactatatgtagttctttctaccacactttatgattccaaccagaccctttcatttaagacttggattttttattttctttaatccctttttcatttcttcaatgattaattggaattccaattaatcattttgactggctgtttttacataaataataagtaaaaaggcagtaggaactagaatgaacaatgctgtagcaataaatgcgagaatatttacttccataacctctttatttatttatttttttcacaataactcgggatgtaatcccatggagaggaaaa

SEQ ID NO: 21965 - DNA, 520 bp, Zea mays
  Clone ID: cC-zmle18900083c04d1
gcccacgcgtccggtataatttaggatactactccatttttattttgatatttaccctcatcttaacttcctatgggactctgatgaaatcgagtaccggtattttaccggaatccatacataaaccgtattcgtttattgttagagaatgaatttcatctaattagttactttttgggggttaaaccgcaccccttccattttctagttccaactttgtttgtgtatataattggaaagaatccacctcattctcactccatttgccgactcctttttttatggatttgctctcatctttagaccccaaaaagcgtatatggatagtaacctaataaaatagaaaccaagcaaacgctctttttcctaaatttaaatatgggatcctttttatttaagatcctcttttctccatctcatttctacttctactgcttattgggatgtttatgtgacccatagaaagttggtcatataatacatacataaatgtatgtataactataagaaaaaggaagtg

SEQ ID NO: 21966 - DNA, 489 bp, Zea mays
  Clone ID: cC-zmle18900083c05a1
agctgttgaatcacattgggaatgcactggggtgtgacaactactcgttgcagcgaatttgaactacaaaaggactctcctgcgatttcgagaaaatggaactacaaaaggacatttcctattttcccccatgtgcatccaatgtaatggtcattcatcctacaaccacatgacaatgtgtacaggaaagctataataaaccaatacatatgtaagaggtttaaataaaatgttaaaagacggtggaacctcttccaatccatgtagaaggttcagtttcatctatccttgatgccctattatagtattgagttgcatctttaaaatgtgattccttctgtggtgctctatcaacctttcccaagaaagtatggaaagcacccaaagcagtaaggattgctatccgttcatacttcacatcagcataatactcgtcaatttcagggccagatccttcctccagaattgacggaactgctctatctttcc

SEQ ID NO: 21967 - DNA, 495 bp, Zea mays
  Clone ID: cC-zmle18900083c05d1
gacgcgtgggccagggttgatgcaaatccagcatcatccttcaagattttcccccactctgcccggcctggggatccgggatagaatcaagctgccacaaccgcgctccagactcagaccgagatgcaccgctgcatttacacctgccctgacgaccgctagccgccgcctgtgtactccaattgctaagggctcaaaaagttgaacacccaattgccaagggcttctgccccccaatggtgaaggggagtgagaagcaccgagaagatgacgagcgtgtacatcccggtgcaggggacagaagaggaggtgcaggtggcgctggaccaacttccgcacgaggcatacgatatcctcgacatcctcaaagccgaacaggcccctcttcacctctggctcatcatcgccagagaatacttcaagcaaggaaagatagagcagttccgtcagattctggaggaaggatctggccctgaaattgacaagtattatgct

SEQ ID NO: 21968 - DNA, 380 bp, Zea mays
  Clone ID: cC-zmle18900083c06a1
ggggggtcctttaggaattccccccccctacccccccccttacccttttttttttatataatttttattaaaacttgacgtactcaaaaacaaatcccctccctaaataaaattgaaacccccttacatacccaaccacaaaacaattcggaaccaaaaataaaaaaaccggggccacctaaaaacaaaccccaaccaaattaatataccaggggccacggcccccataaaccttaaaaaaaaccttactcaacacaaccattaaaaaaacgaccacccccagggagcaggcaattttccaataggaccccaaagttaatttttttttacacagaaaaaccgcaaacagctgttgggcttctcccccccaacccctaaaa

SEQ ID NO: 21969 - DNA, 222 bp, Zea mays
  Clone ID: cC-zmle18900083c06d1
aaaaaataaaaaaaaaaaaaaaaaaaaaaaaaaaaaaatttataaatttttaaaaaaaaaacaaaaaaggggaaaagggaaaaattaaaaacccaaaaaaccccaaacccaatacataggaacaccaaaaatcaacccacccgccgacaaacaccaccgacgagccaaaaaaaacgcgggcgcccaaaaaaccaaacacaacaccaaaacacacccttttat

SEQ ID NO: 21970 - DNA, 541 bp, Zea mays
  Clone ID: cC-zmle18900083c07a1
aaactaaaatcctctatagcagacacccttaatttttttatttttattattatattttatttttttttttttttttttttttggtggattttgggatttttttaaataaaaataccaacataatccaaatttaaaaaaaaaatataaatctatttttttaaaaaaaaaaaaaaaaaaatcccccaaaaaaaaatgtgggcccccaaaaattatttaaaaaaaaaaaatcaaaaaaacacctcttaaaaaaaaacccttttttttatttttaaaaaaaaaagggggtaaaaaaacctggggggggggccccccaaaaaaaaaaaaaaaaaaatctttttttgggcccctaaaaaaaaccaataaaatcccttcccccgggaaaaccacaaaaggaaaaaaaaaaccaaaaaaaattccctaaaaaaaacccccaaaaaaaaaattttttttcccaacaaaaaaaagaaaaaccccactttccccttccccaaaaaaaggaaaaaaaaacccccttttataaaaaaaaacacctttttttttt

SEQ ID NO: 21971 - DNA, 386 bp, Zea mays
  Clone ID: cC-zmle18900083c07d1
acgcgtgggtgctgccaaatagatgcaaaccgtgcttgttctacattttttggggtcctggtccgcggcgggggcggggaggcgaacgccagggacccgccctacacgacggagaagcagaagattctgagggggctcatcaacggcagcttcatcgcgctcatccttgccctcctgggcttcccgagggagaagcgttagatgggccttctaactgggcccagtacaagcgttttgttcgtgttcgatggatggcacagccgcacagtatatacaccgccatgtgctgccaaatagatgcaaaccgtgcttgtgctacacggctgtgtaatgcattataggggggcattgacttgtgggttaccgaattgtacgtaagggaattg

SEQ ID NO: 21972 - DNA, 575 bp, Zea mays
  Clone ID: cC-zmle18900083c08a1
ggtcccgcccacgagctcgcactttgcgatggccttcacggggcggaggcgcttggggcccgctagagcggagtagcgcatggactcgctcaggacctcggggcaccgcagaccctgcagggtaaggtcaagcgcgtcgtgcacggccctggccttggccgacaggtagctctcgaagtcgaagctggtgccactgtcgacggcgacgtcgacgatggtgcctctggcagcacggtccgcggcgcggtgccgggtcatggaaacggatcggttctcaagcaactgcagcgaaggggatctctgaacatggtaggacttgaagatttgggtgtgtggtgctccgtgctggaggaagcaggatgccaacttgttcatggagccttgctgtgttttttgcgcgggtgtggactgtggagtgtggaactttggataccgaggagagaaggtttgggtacctataagttacagccagttaagttactagccagtcgtgccttgctacgtttattatatatcatataaataatattatatatttattaaatataattatcacttattaataaacactaaga

SEQ ID NO: 21973 - DNA, 343 bp, Zea mays
  Clone ID: cC-zmle18900083c08d1
aatcgcacggcccctcttttttatgactttcaccagacatctaggggttaagaaatatatttaataactataaccattattattatataacgacaagccgactgctgaacttaactgctgactataagtcccaccttcttctcgatccaaagtccactccacatccacacccccaaaaacacacaggctccatgaacaattgcatcctgcttcctccacacgaccccacacccaaacttaagtctaccagtcaagaccccttcctgcattcttgaaaccaccgtttcatgaccgcccggcccggccggctgcaagcccatctcactcgcgtcacgggcccact

SEQ ID NO: 21974 - DNA, 385 bp, Zea mays
  Clone ID: cC-zmle18900083c09a1
gggaaggaaaaaaaaatataaacaagccctgggcctcaaattatccaatgttcacagagttaaaatccctcttccccaatataccccgggtttcctgcaaaatttctggacaatttacaacttggctcattttttacgaaaacaaagaaaacggggaagccttaaccctgggttgggcagggggaacctggccctacaaaaaggagtactacccgtttaccctcctgaaccacataaacataggggggtttatcacaactgcatcgacaaacccataaaaacgggatgactggtcatgcaaacttcattgcagtgattgccaagaaaattaatgccccgaaaaggatcctcgtcacacttttttcttttttcactgggaccccgt

SEQ ID NO: 21975 - DNA, 573 bp, Zea mays
  Clone ID: cC-zmle18900083c09d1
gcccacgcgtgcgatcgtcgcatctctccacggccgcgagcattttcgattttgggggacctgtccctcctgggcgtcgggggcgccttccccgtcgtcctcccgccttccaaggagctccatggcgtgcttcctctccagggtaagagaccgcaggacgccggcgtgcagctctgcgcgccgttgcagcagcatccgccccaccatctagaggcggtgccttaccaccagggccagcccgtgcagatggtcgtgcccggcaaccatcagggacaggccctcccggcggcctaccaggccatcacgatgcccgacacggccgtgctcatcgacgtgcaagattctcaccctgactcggttcaacttagccttgggattgcggagcaatgtgcaaggcaagagaaactcctcaagtttctggtgtcaggatctgatgtaaaggaacttgatgaatccttgttagctgaattcacggggcaacagactctagcaataaacatgggaactcatccatatatgccggatgataagctatcaatttctgaattcatgttgaatgaaccccaacactat

SEQ ID NO: 21976 - DNA, 493 bp, Zea mays
  Clone ID: cC-zmle18900083c10a1
caacttctccagttaaaaaagggaatagcttagaagtcactcactgtcactggtagtggtagtacaacacaaccggcacagatggggaaagaaaactgtagtatcatcgacgagtttcaatggaaatccctcttaggcctgtagacgctggttcggttttcgaagtacctttcaaccctaaagacctctcaaaagactaaaggcatatgatgagctaaacgcctcttcagatcacagcagctggcagaggcgacatgatgtgccctccctactgctgacatcaccaaagccaacggtcaaactgctaccgtgctgctgatgctaggaaccggccgtatcatcttcggatgtaacgtagtgcttggggaacagcttctgtttccggccgttcctcttccggttggcgttcggacctcgcggctttggcgtgtcgctcaccagcaccactagttttgtcgggtactcaaagaaaagaacaaacatggagcatcag

SEQ ID NO: 21977 - DNA, 573 bp, Zea mays
  Clone ID: cC-zmle18900083c10d1
gctgattttgttttgggtatcactttcttggataattgttttggattttcacattgcgtcgtgcctttgcgggcttgtggggcactattttcctgttggaattctgttcacggtccccttagtatatagtaccttaaattgccattcacctggatgcctctgatgctccatgtttgttcttttctttgagtacccgacaaaactagtggtgctggtgagcgacacgccaaagccgcgaggtccgaacgccaaccggaagaggaacggccggaaacagaagctgttccccaagcactacgttacatccgaagatgatacggccggttcctagcatcagcagcacggtagcagtttgaccgttggctttggtgatgtcagcagtagggagggcacatcatgtcgcctctgccagctgctgtgatctgaagaggcgtttagctcatcatatgcctttagtcttttgagaggtctttagggttgaaaggtacttcgaaaaccgaaccagcgtctacaggcctaagagggatttccattgaaactcgtcgatgatactacaggtttcttttcccatct

SEQ ID NO: 21978 - DNA, 391 bp, Zea mays
  Clone ID: cC-zmle18900083c11a1
caaattaaacggatacctttgcatcagaaaaacaaaagggatacccttcctcctcgacgagggatgagggagaaaacgagaagttaataaaattaaaaaaaaagcaatataaaagagcagaagttgcagtacatctgcatgcatgcagatttaggcccatcaaaagaagcggatcgaacgtttgcttacaaggccaggcccattatcgctgccctcgaatgcagtgcatagacatacacaatacaaaaaacgcggaaggcagctaccatcttcaattcttgggcgagcgggcagggcatcaatggatgcaggcatgcacaggacggaggacgatcatggcgtctcggaggcgtccttgagatcgtacttctcgaggagggcgccgcactcc

SEQ ID NO: 21979 - DNA, 416 bp, Zea mays
  Clone ID: cC-zmle18900083c11d1
gcggcgccctcctcgagaagtacgatctcaaggacgcctttgagacgccttgatcgtcctccgtcctgtgcaggcgtgcaggggttgctgtcctgcccgctcgcccaagaattgaagatggtagctgccttccgcgttttttgtattgtgtatgtctatgcactgcattcgagggcagcgataatgggcctggcctcgtaagcaaacgttcgatccgcttcttttgatgggcctaaatctgcatgcatgcagatgtactgctacttctgctcttttatattgctttttttttaattttattaacttctcgttttctccctcatccctcgtcgaggaggaagggtatccgtttcgtttgtatgatgcaaaggtatccgttttgtttgaaaaactacaaaaactctatattaacctgg

SEQ ID NO: 21980 - DNA, 396 bp, Zea mays
  Clone ID: cC-zmle18900083c12a1
tttttttttttcttttttttttttttttttttttttttttttgggttttcttttggttttttttggggaaaaaaaaaagtaaaccggccaaaaaaaaacaaaacaactttccttccccccccttgtaagaaacaggcgtgtttaaaaaaccccccccccttcttaaaaaacaaaacctgcccaaactaaccccattgtcggggaccccccccccttaaaaaaaaaaaaaaaagccccacccaaaaaaaaaaccaccccgtgcttttcctccccccccacccataaataacccttgagccggcccccccatccaaataaacccatccctttttcccacgccgggggggaacaaaccaacccccccctgggagaaaaaaaggccccccccccccactt

SEQ ID NO: 21981 - DNA, 580 bp, Zea mays
  Clone ID: cC-zmle18900083c12d1
gtgcgacgacatcgagctgctggagcgcgtgaaggatttaggaagtttcggctgcagaagcagggcatcggcagctcctggggcgccgagaccgggtatttgcaggacctcatctacaggctcagcaaagtcgggcaggccattgacaacgacgacctcccagccgcgagcagcgtgctgggaccaagctcagacgcccagtgggtgcagaacatcaatgcagctttctccaagctcagctcaagcccggagcagaggaacgtggtcgacagcttcaacagctcgctggccacactgtttacatcagtgagcaagctcgaccctgaatcctccaagtcggcgttcgtgtcgtccgcgacggcgttggagaaatggatcgcgttagctggactgggcggccagctcaagggctactgatgcgtgcgaggggaagagaagcactgggttgttctatgtttgggtccggcatttgtgaatctcctgaagagggtaccgtgaccgagaactgcattcagataggcatgctatgctcatcaagaaactgtgactgtttatgagactctgctgttacttacaagtg

SEQ ID NO: 21982 - DNA, 544 bp, Zea mays
  Clone ID: cC-zmle18900083d01d1
cgcgtggggtcaacgatgccccggctcttaagaaggcttttatctttattgctgttgcggacgctacgggcgctgggaggagtgcttccgatattgtccttactgacccaggtcttagcgtcattatcagcgccgtcctcaccagcagatgcatcttccagaggatgaagaactacaccatctatgcagtttccatcacaatccgtatagtgcttggatttatgctcattgcgttgatctggcaatacgatttctctcccttcatggttcttatcattgccattctcaacgacggtactatcatgaccatctctaaggacagagttaagccatctccgttgcccgacagttggaagctgaaggacatctttgctacgggcatcgttcttggaagctaccttgctctgatgactgtcattttcttctgggctatgcacaagaccgacttcttctcggacaaattcggtgtgaggtccatcagggacagcgagcatgagatgatgttcgccctgtacctccagtgagtatcgtgagccaagctctg

SEQ ID NO: 21983 - DNA, 560 bp, Zea mays
  unsure at all n locations
  Clone ID: cC-zmle18900083d02d1
gagtagagaatttagttcctctttggataaaaattctgctttctttttctgcctatttgatgtcgatggggactccggattacaaagagtaccggcaatctatttgggtcaacctacacatggatttaagacagagcagcagatacccttccaaagtggttcagttgatatcgttactttcaaggggtcaaaactgaaaacgattaaagaagtctggatcggtcttgaatcaggttcatggagattagatggtttgagcttgaaagtaatacatggaccagttggtcagcctaaagaaataaatggaactccagaacagaagttcatcggtttgcaggacacttttgagaacgtaaatgtgttccttggagatgatggagcttcagtagctgaagcaaggccgacggctatcactgacctctcaggagtcggcctttctgatcttcaacaagggatgttatcctcaagaagcaaagcttcaagcattcangaagtaagagaggatgggttgagagagtacgccgaccttaaacaatctctgctgctctatgacgcatcta

SEQ ID NO: 21984 - DNA, 396 bp, Zea mays
  Clone ID: cC-zmle18900083d04a1
aagggtaccaaaaaggccctttcttgggtaggtacgaaaagtgaccttatttgctttttctgaacacgccgaacacatatagcctttatatcccatgcatgaccaccctgtgccctccaaagccctcaaaatttttccgttttaaccgatatgaataaaaaaataaaggccatgcagggcacgcataacacgctttgttaacttgccttaatcggtttttgcagatcctaaaaatcctaaaactttcaagaattacaaggaaaaggtcataccgaaccatcaaaaagattacaccgggggcatcctgggttaaaacagggaaaacctttgcgggcggaactggaggaacgcgctccatggcctccacaaaagtaacaaaggccctggacaccttga

SEQ ID NO: 21985 - DNA, 588 bp, Zea mays
  Clone ID: cC-zmle18900083d04d1
acagtgtatgcacacctgcaggcagcatggccgggtgctttcaggattacgacgccggcggccgttctcgggcgtcggggtccatggacagcagcagcaccacccacccgccggcgctatccgccgcgtcgtcgtcgggcttccggccgacgacgacggagaggagggacgaccttagcaccgaccttcagctagggctctgcagtctgtcgccggcggcgtcctccgccctcctggtggtagcggagagcaagagcgtcctttccacgccaaggggcagcaggaccacccaagactggcccccgatcaaaccattcctcagaagcgccttgacagcctcggcacgccgacgacggcggacactgttcgtgaaggtgtacatggaaggcgttgcgatcggccggaagctggacttgctcttgctggatgggtacgacagcctcctagcgaagctccgccacatgttcaaggcctccatcacctttgctgatgctatggagtaccaccaacgagttcctcacgagaagcctgcacatgttctcacctatgaagaccgggaaggagactgcatgatggttggggatgtac

SEQ ID NO: 21986 - DNA, 502 bp, Zea mays
  Clone ID: cC-zmle18900083d05a1
ttttccaggttttttgtccgcttttcttcaccattgcagcgtaggtgaaagaacactttatatgcagtggtcgacaacggatgatgtatttgaaaacatgctcttatgtgaggtttggaaatctagtatactgcttcagtaagagaacataatcaacttacaataaaagcagacaaaaggtctccccgttaggaaagaattccccaccatcctcacctgagggtaacataacaaaaacgaaacaacaaatctacacttcccgcctaggagctgctgtctgcctcgccctcttcagttgcatctggagcagcatctgctgtggtgccttcttctgcttcttgctcgaccagttcctcctcgccatcatcctcatcatcagtatagtagtcatcggaaacactggctccgtacctggagttgaggtagtctacagcagcaggagtaaagaagagcttgcgtgcgtcgagtatgtcgtacaggttcagcgtcctgggtgtgagca

SEQ ID NO: 21987 - DNA, 464 bp, Zea mays
  Clone ID: cC-zmle18900083d05d1
caggcgtccggaagggaaaagccccttgccatctccacgttcatcagtttgggccgccaaggaccccttcggggtttgggggttttaggaggccttctcgtccgggcccaaaaccagggatttcgtggccgctttgcaacggtgggggcttgacccgaagcaaaaagccatgttcttggccacggacttcgacaacattgtgcggttaaccggcaggaacattggttccctcaaaatgctcacacccaggacgctgaacctgtacgacatactcgacgcacgcaagctcttctttactccggctgctgtaaactacctcaactccaggtacggagccggggttgccgaggactactatactgatgataaggatgatggcaaggaggaactggtcgagcaagaagcaaaaaaaggcaccacagcaaatgctgctccagatgcacctgaagagggcgaggcaaaca

SEQ ID NO: 21988 - DNA, 513 bp, Zea mays
  Clone ID: cC-zmle18900083d07a1
ctatgtatgctttacattcgatgttccataaaggaattaagtctgaatagcatcacggtttcaacgaaagtaataatacttcatgaccaggcaaacattgccatcatagattacttgttcacgcgacaactgcaaggatgtcaacaagacgagatattttaagcttccacgaggtaaccaacatgcaagcacagcaccagacagatagatcatttcttcttggcagcagccttcgtcaccttggctccagttgggtccttcttctccacactcttgatgactccgacagccaccgtttgcctcatgtcacggacagcaaatcgaccaagaggaggatactgagaaaaggtctccaccaccatgggcttagtgggaaccatcttcaccataccagcatcaccgttcttgagaaatttgggctccttctccagctccttgccggatcgcctatcaatcttggtaacgagctcagcaaacttgacagcaatgtgtgaggtgtggcagtccagaact

SEQ ID NO: 21989 - DNA, 351 bp, Zea mays
  Clone ID: cC-zmle18900083d07d1
catgattgaagtcaaaaatttgccttagaacacgcatcagggcgggggcttgacaagctaggtgacgtaagagatacaatgtatgcctggaagtcagacacagtctactgactgtatgagccccggacaccggacttcatcaagaatatgatactgcacttccaagctgactggctgtctatcattgctaaccactgtggtttgaggctggtatctccaagatgccagacccggagcatgctctcttgctttcacactgggggaagcagagattgctgtgaacaagatggagctctcacccagtttaaaggcccgtatgagagattggaagagttcttctacctgaaagtg

SEQ ID NO: 21990 - DNA, 404 bp, Zea mays
  Clone ID: cC-zmle18900083d08a1
ttttaaacattttcataatctttttcgataaacaagagcagccgggaagaaatatggatgggcctagactattaactccggaacgcgccattatgaaagtccccaataaaacaccatgccaaccttgcgccaagaccagtgcaagaacatcttcactgcgagaacaacatcagggggtcaaccattcaatcccaccgtctgcgcccgtacaacattgtggtgggggcttcatgactgactcaccaaagccagaatccgacccagctcttctcttacgtactattgcggattgaggatgacccatatggtgctcagcatcaaaaccgaaaagggccatagccgtcctaccgtgatatggggctttaatggggtagtccgggccaataaacgccaccaggtctgca

SEQ ID NO: 21991 - DNA, 490 bp, Zea mays
  Clone ID: cC-zmle18900083d08d1
gccctgaaagccagaggaaccccgggacgattggagccatatatttaaactttttgggatgtcaactttcactgggctgaagggagaacaaaccgcagacatgaggcacgaacaccacactgatatgacatctgacgggaggatcagcatggccgatttgagcatgaagactgcgccccatattgcagatgccatacacactgcaaatactcaactgaaatgaggatagaatcacatcttgcgggaataaaacctgaatcacccacaacaatgttctaagcactcaactcagcggtatttactggttgacctacctgagtgcgctgtcagaataaatatctccgatgactctacgagcagcaaatatgtactggaggaaggataaggactcagattatggtgcgtccggaacttatcatagtgggcacatgacaacgtgctatcggtcgctggaaaacatccaacaacacccctggcaagagaaaagata

SEQ ID NO: 21992 - DNA, 319 bp, Zea mays
  Clone ID: cC-zmle18900083d09a1
atataaattcaaagagccaggggttcatcaggatccaaaccaaaccagatataagtttggaagtagccaacatgcaacacatagctgctcgagaacaacttatggaaaatcttagctaaaggcagttcatgacgctagtatctggcatagagcaaaacttgaagaccacatccgctctagtctcccttcctgcggaaagagcagccctcagtgagccttgcctttcctcctgtgggttggcagaggacagtttggcagccagggcacacaacaacagtctgggagtggctgaaaacagtggttatgctgaagcacccct

SEQ ID NO: 21993 - DNA, 324 bp, Zea mays
  Clone ID: cC-zmle18900083d09d1
tagcataaccactgttttcagccactcccagtttgttgttttgtgccctggctgccaaactgggctctgggggcccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgat

SEQ ID NO: 21994 - DNA, 271 bp, Zea mays
  Clone ID: cC-zmle18900083d10a1
gccttatcttggtatttacatgataatttcagcacgcgttcttacatgagcagagggggtggtaagtaatacaacctgctgctccgaaccacacctagtacacgtccgctaactttggcatgcagggagtacccaaaaaaggagctttacagtggagtggacacacccaaactgacgaccggtcgtggcccgacgcgacacgagcagtcgatcgttcgagcaaaaaagcggagtggctggtgcaagcaagaaggcaagggagcagcagcgc

SEQ ID NO: 21995 - DNA, 268 bp, Zea mays
  Clone ID: cC-zmle18900083d10d1
gccggtgctcccttgccttcttgcttgcaccagccactccgcttttttgctttaacgatcgactgctcgtgtcgcggggggccggggacggtcgtcagtttgggtgtgcccactccactgtaaagctccttttttgggtactccctgcatgccaaagttagcggacgtgtactaggtgtggttcggagcagcaggttgtattacttaccaccccctctgtgatgtaagaacgcgtgctgaaattatcatgtcgataccaagttatggc

SEQ ID NO: 21996 - DNA, 458 bp, Zea mays
  Clone ID: cC-zmle18900083d11a1
acaagatcgttcgttgcggtttatacttgtggacccaaatcagatcatgctggtgaaacgagattcaaatcggctggcatgattgatgaaacaaatacacaccccaggattacactacacgactcccaacaggaaatggaaagcggaagcctgtaccagttcggtgactgcatacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgcggcgccgggccacttggccgccaccaggtgcgccagatcaaccacgcgttggctgtaccccactcgttgtcgtaccaggcgacgacct

SEQ ID NO: 21997 - DNA, 572 bp, Zea mays
  Clone ID: cC-zmle18900083d11d1
gcctgcggcatcgacatcgtcatcgagggcaccggagtcttcgtcgacggctttggcgccttcaagcacatccaggccggcgcggggaaggtgggcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctgaaggggaagctgaacggcatcgcgctgcgggtgccgaccccgaacgtgtccgtggtggacctggtgatcaacaccgtgaagactggcatcacggccgacgacgtgaacgcggcgttccgcaaggccgccgccggcccgctgcaaggcatcctggatgt

SEQ ID NO: 21998 - DNA, 526 bp, Zea mays
  unsure at all n locations
  Clone ID: cC-zmle18900083e01d1
gaacggggagtttatctacaagtttgattctatttagaatgttcgttttggtattctcccccgctaggcaagggatgacaaactcatcagatggctccaactccctaattgtttcatattccataatgctaatgcttgggaagagggtgatgaagttgttctcattacctgccgccttgagaatccagatttggacaaggtgaatggatatcaaagtgacaagctcgaaaacttcgggaatgagctgtacgagatgagattcaacatgaaaacgggtgctgcttcacaaaagcaattgtctgtttctgctgtggattttcctcgtgttaatgagagctatactggcagaaagcagcggtatgtctactgcactatacttgacagcattgcgaaggtgactggcatcataaagttcgatctgcatgctgaaccggaaagtggtgtgaaagtacttgaagtgggaggaaatgtacaaggcatatatgacctgngacctgttacatttggtttaaaggccatttttgtt

SEQ ID NO: 21999 - DNA, 624 bp, Zea mays
  Clone ID: cC-zmle18900083e02d1
gggcgcgcttgcctgccacatttacatttgtggtcagagttttctcttttctagatggcattgggaaagggggtgatcgtaggtttgatattacagagattgctaagccatatgccaaggaattgctaagatttaatgacgctggtgttgaaatagttgtgaaggatgcaaagaagagatgggaaaggcagtcccgtgccttttacaatttgttccgccaacccgatagagttgaaaagctcgcacaaattattgaacgtttggagcaaggtgaactcaagcttcgtgtcagaacgctggaatcagaaagagcatttcaaagagttgccgctgtacagaaaacaattggatatggagttgctgcaggtagtttgatgaaccttgcaacaatgttgtacttcaattcaatccggggaccagcaaccattgcatactccctctgcgcattttttgggctgcaagttctgatcgggcttgtcaaggttaaaaagttggatcggcaagagagactgataaccggtactgcatgagctatgagttattcacgatcagtcggtgaagactggaatacaccacttttcagcgttgtcgcgacacctttttttctttgcccaattttacccc

SEQ ID NO: 22000 - DNA, 576 bp, Zea mays
  Clone ID: cC-zmle18900083e03d1
ccggcgccacgcgttcgagccacgaaacaaaattgttgagttttgttggacaactgatgggggcttggaccaggtatgaagatgggagacttgtcgtgaacaaggacgcgatggcgagggaaattgttgtcctgtaacgagtgccgagactgctctgtccgtggtagtttattctattagcgagctgtataaaagagtaagctgcggttgtgatatatttaaaactgtattcaacagcttatctatacccatattcacattcaaagtacactctacaaacagtgtaatatacaatgcaaaacagtatttttttgaccatatgggtgaactgctatatattgcacccatatagtcacctaaaatactgttttgcaccattttgtaatgtacattacacgtttgtagaatatagtttgaatatgtgtatgagtatgaataagttgctggagatagtagtactagtttggatagtggaaacttaaatctcttcgggattctcgaggaataagctcttcgggattcttcgggattaaagagaaaaataatctcaatctttagaaatcttgaagaggattt

SEQ ID NO: 22001 - DNA, 376 bp, Zea mays
  Clone ID: cC-zmle18900083e04a1
tacgaaggctacttcgtcgagcatgttcacttcaagagggaggagagggagcataagcgcaaggagcgcctcggcgaggtgggcgccctcgcgggcggcgcctttgctctgtacgaggggcaccgtgcgaagaaggacccggcgaacgcgcagaggcacaagatcgaggccggcgtggcaacggcggcggcgctgggcgccggcggctacgcgtaccacgagcaccgcgagcagaaggaggcccactacgagagcaggcagcaggagcacatggtgccgcacgggcacgggcacgggcacgggtactcctactactgcgactgatacgactgatcattccatcgatcgagatatgcatgcagaactcgatatatat

SEQ ID NO: 22002 - DNA, 492 bp, Zea mays
  Clone ID: cC-zmle18900083e04d1
agcttaattgctttcatgttttattagatatagtaacagtgggggatcgggacacgctgcagaagcatgcgcttagtcgttatttgcagacgataataagtagatcgatggagtagtgatcgagcaacacacacgtgacgacgtttgctcttatttacttacacgcacgcacgtgtacggcgctaggggccgtatatatatcgagttctgcatgcatatctcgatcgatgggatgatcagtcgtttcagtcgcagtagtaggagtagccgtgcccgtgcccgtgcccgtgcggcaccctgtgctcctgctgcctgctctcgtaatgggcctccttctgctcgcggtgctcgtggtacgcgtagccgtcggcgcccagcgccgccgccgttgccacgccggcctcgatcttgtgcctctgcgcgttcgccgggtccttcttcgcacggtgcccctcgtacagagcaaaagcgccgtccgcgaaggcgcccacc

SEQ ID NO: 22003 - DNA, 311 bp, Zea mays
  Clone ID: cC-zmle18900083e05a1
ttttacttttttttttttttttttttgaacaggcgtaacttgggtgatcttggcatatacaacacgcttgacacaacaccggaatgtgaatctctcttctgtaggccggccacttaatatacacaactaaaaatccctgtccaagaaaacagaccagacgagggccgaatccagagctcaatacaagcaaaaccttaacataacagcggagcaaattccaggatgctcatcttacccaaaaggccttaaaaagccaacaggctgcctgaataacacccccaattaaactgaccaacccctgaaggagacct

SEQ ID NO: 22004 - DNA, 534 bp, Zea mays
  Clone ID: cC-zmle18900083e05d1
ccgaataacaggacagggccaaacaactgactgggttttacgctttatccgaacgagaccatggggagggacaccgggatagttatggtccttcaatgcctatttcacctggaaacgaagactctgacaacaagataagagacaggtcttacacgcaaatacagcgttcactaagcaaaacgtctaatctgatgcaaaaattcaaaaggtggggaaggagcaaggatgacagcaatgatatagcctcctgcatcaaaggctctgccaggccgaaaccaaagggcccactggaagctctaatgctaaaaaacgctggagatggtacagccataacaacatacggagagagggatcccaatgatgtccttggatgacgaaaatgtcacgtcctcattccaattgatgcccaagacaattgaaggttttgctgatgagaagtatcctgcttacaaagataggcacaaaactgcaactgaacgggagaaggctataaaagagaaggctgggcaagcaagagcacaaaggttcggtggt

SEQ ID NO: 22005 - DNA, 395 bp, Zea mays
  Clone ID: cC-zmle18900083e06a1
ttttgagatgttcaagagatagattactcagggcccgtatacggttctttcagcgtcaagctcttgataagcatatatcctcacggtcgggcacagcccgaaaacaaaaaataacatatgataaacagaaacatactgagctagctataataccggaatcatacggtaatgaatcgcatcttcatcataactaccagctttgaaaactcaaaacgagcccacttgcagctaaactcagcagtcctgtagaattcactatccatagaatacttctttcttcgtggcaacaaagaaataggcaagagtgcacttcaccttactccatcttgaccgatgagtaaatcatcccttgtgaacaggaagcaagcatagaatccgattgtgccggtcaaggc

SEQ ID NO: 22006 - DNA, 497 bp, Zea mays
  Clone ID: cC-zmle18900083e06d1
gaaagagtggatcaagaaggtgcatattcctatttttcatggtttccatgcaggggccaaaggaaaggattcggggagcaaagatgaaaaatactccatccacaaccatctatcttttacggtgaaatatcacagggatgagcaaagggatgtttccaggattgtggcctttgaagtgaaaccatacagcgttaagcatgaatatgaagggcaatggaatgataagaagacccgcctgacaacgtgtgaccctcatgctcaacgtatcattacttcgtccgagtctcctcaggaggtcgaagttggcaaggatatcatatttacttacaatgtggatttcagggagagcgacatcaagtgggcatctcggtgggacagctatctattgatgacagatgatcacatccactggttctctattgtgaattctctcatgattgttctcttcctttctggaatggttgcaaagaacatgcttcgtaccctttaccgggata

SEQ ID NO: 22007 - DNA, 401 bp, Zea mays
  Clone ID: cC-zmle18900083e07a1
aacatggatcctctatagcggccgcccttaaaaatttctaaaaaaatttttttttttttttttttttaaagaaacctttttggattatttatttggttaataccccatacttttcccaaataattttttttaataacccttacacaaaaaaaaaccgggagaaacaaaaatttttgaaaacaaacaaaaaaaaccttacaaaaaaaaaaaaaggagggaaaaaacccttatcaagctttaaacaattgggaaaaaaaaacaaaaacctattttaaattccccccctccttttttacccaacaaaactcattaaaaaaaaaaagattaaaaaaaaaccacgcccctaaaaaaaaaaaagaaagccgaaacgaaaaaaaaaaattaaaaaaacccctaatatt

SEQ ID NO: 22008 - DNA, 388 bp, Zea mays
  unsure at all n locations
  Clone ID: cC-zmle18900083e07d1
cgcgtccgccacgcatacgctgctaccgattttccatataagggcaacaaggcaaatgcgggggaggggcaggattataccgacatccacgccgacaacacgacgagcatcnacgacgccaaggccgggaacgctctgaacgaccacttcgacaagcttgtctcgtggtacgacaacgagtggggctacagcaaccgcgtcgtcaacctgatccgccacatgtacaagacccagaagagggttttccccctgcttctcatggatggttgctgcttgtgtatgccgagaataaatgtggatgtcgccaggttcatgctgaaaaaaaggggggggggggggggggtatatatacaaaatctaaatacaaattttaataaaacataaaaag

SEQ ID NO: 22009 - DNA, 336 bp, Zea mays
  Clone ID: cC-zmle18900083e08a1
gtaaaaaaaaggcccccggatccgacatgggggtttggtatatataacacaaccgtagcaaacggggggctgcttgaattgatcatatcccggatgcaaaggctactagagacacccatatgtgtttaatcgccgatgcatgtatgcatggcatggcatggcatgctcataaaccaccgatgtacttgtctatgaggggggggagcgtggacttcgggacggggccgaagaccctttcctttttttcgccgccctttaaaaaaaacacgggggggatgctgcggatgccctaagtaaaccccaccttggggctgtcgtccgggttcaccttgcaac

SEQ ID NO: 22010 - DNA, 586 bp, Zea mays
  Clone ID: cC-zmle18900083e08d1
cggaactagtcacgttcgtccaccagagacaacaatttccatttatacgtgcttcagagcgtgggcggggcacggcgccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgcctgtgatcgacgagctggccaaggactaccccggcaagatcacgtgctgcaaggtgaacacggacgacagccccaacgtggcgtctacctacggcatccgcagcatccccaccgtgctcatcttcaagggcggcgagaagaaggagagcgtcatcggcgccgttccgaaagtcacgcttaccaccctcatcgacaagtacatctggagttcatgagcatgccatgccatgccatgcttacatgcatcgacgactaaacacata

SEQ ID NO: 22011 - DNA, 436 bp, Zea mays
  unsure at all n locations
  Clone ID: cC-zmle18900083e09a1
agctagaaggggtacgtgctggatttatattaattataagtctattagttctcgtactaatacatgtgtttccacattgaaccatacgctggcaagccagaagtaagcgcacaaaacgaaaccccatgcatggggatatacagatgatactgatcaaacgatctctacccttaacctccccttcagctaatgtacataccagtcactcctcagccctcgctcccttcagaccatgcatgcattgcaacacggcccgaatctgtaccctccagattgattaacacacacaaactgatccagaaaggaacttaaggtttcaatgtttgtcttccagtccatatcagctcaccagcgatgggatcgtattcctcctcgacctcgactcaaccggagaaggtctggatgatggtngctgtgccatgggtcaaacaggtgc

SEQ ID NO: 22012 - DNA, 421 bp, Zea mays
  Clone ID: cC-zmle18900083e09d1
ccgtccgaatggcttcgacccgttgggcctggcggaggacttttacattttgagctggtgaacgcacgcggggccatggggggcgtggtcggcatgctcatcccggacctgctgaccaaagccggacggaccaacccaccgcagtgggaccaccccgccaaatcggaacaattcccgtcagcgtgcacactgttcgtggtcgagcacattctgttccactacgtggagacccggccactgcaggacaatacgaaccccggaagacataaccaacaccccatcttgaagagctacaccctgccgccacaccaacgccgttaccccggcagagtgttgaacccggtgaactgcgcgcacacgctcgaggtcaaggacaacgatctaggccacggaaagctagctatgctaccgtacctgggct

SEQ ID NO: 22013 - DNA, 423 bp, Zea mays
  Clone ID: cC-zmle18900083e10a1
agacaaggctgatacatggattttattgggcggtgagatgtaacatgcaagaaaaactatggaacaagaggccggaatgaaagtttgtgtaagcgcctcaactcattctaaaacactcttcaaaatttatgtgatgacggtgggggcagagcgtccagtgtactcttgcatcttggagagcttgagcgcaacatcaaccagcggagcaagggcgtcctgtgaatccctgccggtcttagaggagtccctctcgtactgctcgatgtagacacggatggtggcaccaacagaaccggttccagagaggcggaacaccattcgtgaaccatctccaaagaggtatcggatgccctggtgcttggacacagagccatcaacaggatccttgtacttaaactcgtcagctgcaactacttcagaaac

SEQ ID NO: 22014 - DNA, 322 bp, Zea mays
  Clone ID: cC-zmle18900083e10d1
gagggggggactggaattattgctttaatattaggacttcttggaggagaaaactcgtagggggaagaggtagcatttaagcactgggccacatatggtccccattactacacacgctatgactatgataatgttgatgcaagggctgctaaggaactaatggcatacctagtaagcatgcagtcatcactttctgatgttaacaagttggtcaaggagacccggtctgatgtttctgaagtacttgcagctgacgagtttgagtacaaggatcctgtagatggcttctgtgtacaaacaccattgcattccatacctcttt

SEQ ID NO: 22015 - DNA, 315 bp, Zea mays
  Clone ID: cC-zmle18900083e11a1
tataaaaatctctttttttttttttttttttgggttttttttggtgtctttttttttttttttccccgttttccccccctttttcttccccctatttttaccctaaaaaaccaaacccaaacctcaaggctaaacaaaaaccccctataaacaaaccaaaaaaaaaccgaaacgaaaaaaaagccaaaacccacacccttcgaaaatatattaccccaaaaaactttaaaaaaaaaaaaacaacctaaaacaaaaaaaaataaaaccggaaaaaaacccaacaattgaaaaaaacccaaaccaatttccctaacc

SEQ ID NO: 22016 - DNA, 91 bp, Zea mays
  Clone ID: cC-zmle18900083e11d1
aaaaaaaaaaaaaaaaaaaaattttttaaacttttaaaaaaaaaaaaaaaaaaacagggcaaaaaagaaaaaaaaaaaaaaagaaacaccc

SEQ ID NO: 22017 - DNA, 610 bp, Zea mays
  Clone ID: cC-zmle18900083f01d1
gggcgcgcttccctgccacatttacatttgtggtcagagttttctcatttctagatggcattgggaaaggggttgatcgtaggtttgatattacagagattgctaagccatatgccaaggaattgctaagatttaatgacgctggtgttgaaatagttgtgaaggatgcaaagaagagatgggaaaggcagtcccgtgccttttacaatttgttccgccaacccgatagagttgaaaagctcgcacaaattattgaacgtttggagcaaggtgaactcaagcttcgtgtcagaacgctggaatcagaaagagcatttcaaagagttgccgctgtacagaaaacaattggatatggagttgctgcaggtagtttgatgaaccttgcaacaatgttgtacttcaattcaatccggggaccagcaaccattgcatactccctctgcgcattttttgggctgcaagttctgatcgggcttgtcaaggttaagaagttggatcggcaggagagactgataaaccgtactgcatgagctatgagttattcacgatcaatcggtgaagactgaattacaccacttttcagcgttggcgcgacaccctttttttcttt

SEQ ID NO: 22018 - DNA, 389 bp, Zea mays
  unsure at all n locations
  Clone ID: cC-zmle18900083f03d1
cgaaggcagtcataaaacacagatagngctcagtctttcatggtccagatgtgacaagccactgccggccatggggtgtggatcagtgctgcaaaaatatattggaacgtaaggaaacatcggaacttcaggaaatatatataacagggttgcttctatgttattacatcgaaggcgtcaggtgtatgcttcttcagcaaaaggatatatatgatacagattagctacaggcttcactcaaaaaaaaaaaaaaaaataataaaaacaacatataaaaaaaataataaaaataaaataaaaaaaaaacaaaaagggcgctccattttaaaggaatccgggggcggggggcgggcctgcaacacgatagattttttataggggcacctaaa

SEQ ID NO: 22019 - DNA, 394 bp, Zea mays
  Clone ID: cC-zmle18900083f05a1
ccttagaggggcgggaacaggtgcatatcagacaataacttggaagacagccccttccactgggcacaggcgcaaagctgataatttggaattatctccttgcccgttcaacatcaggcctgcacattttgcaaccaacacaacagtttatgtgactgctaggtcatcaggtttagactcataaccacccctcaaagcaagggcaagatggaggacagacccaccctccacgttgtagtcctttgcggtcctgtcatcagcaagctggttaccaacataaataaacctttgctgcacgggaggaatgccttctttctctataacacgctccttgatcctgaaaatagaggccgggggtgcaatgtggatctcgatctcttttcccccacgcgtt

SEQ ID NO: 22020 - DNA, 437 bp, Zea mays
  Clone ID: cC-zmle18900083f05d1
gtccgcggacgcgtggggggaaagagatcgagatcgactttgaactttctgactcgattgacaggatcagggagcggggtgaagagaaagaaggcattcctcccgtgcagcaaaggctcatctatgctggtaagcagcttgctgatgacaagaccgcaaaggactacaacatcgagggtggatctgtcctccatcttgtccttgctctgaggggtggttactagtctaaacctgatgaactagcagtcagataaactgttgtgttggctgcgaaatgtgcaggcctgatgttgaacttgcaaggagataataacaaattatcagctttgcgcctgtgcccagtggaaggggctgtcttccaagttattgtctgatatggaattgttccagattatctaaatacaaatactatttttaaaaattcataatttatttgg

SEQ ID NO: 22021 - DNA, 399 bp, Zea mays
  unsure at all n locations
  Clone ID: cC-zmle18900083f06d1
ggtgattgtaaagttgtattttaccctattaatctttcacctttattcaacttatataatctagaggggaaacggacagggcctaggtctccttgctgatactcaaaagcaccatggacatatctacatatttacaagaagtttctgacttccatgcatggatttgtgcgctcctaaatcttcagcatgccttccaacacacgaagaacatcagcacgggcaactatacctgttgatagtgtttagaaccccattaggcttgcaacatactctgtgttgtcaatgttgattaaggataatacaaatcaagtatgtacatgcagttttttttatctctagtttgtcagcattctgatactcccctattacttgttcatcctgattctcagctggccnant

SEQ ID NO: 22022 - DNA, 321 bp, Zea mays
  Clone ID: cC-zmle18900083f07a1
aaaaaaaaaaaggggaaaaaaaaaccttcatttatttttgaaaaaaattaaaagaaaaacctcccgggggaaaaaaagcctttacccacaaatgccaacacttcccttaccaaaaaaaaaaaaaaacgcatggcaaaaaaatttcttctaaaacccccccccccgggggggtccaaagccccccttttttaaaaggctttccgggcccccccaaaccaacaaaaattgaaagggggcccacccggggcaaatttttcaccccaaaaaaaaaaaaaaaaaaaaccttgggaaaaggttccccaccaaaaaaaaataaatggg

SEQ ID NO: 22023 - DNA, 434 bp, Zea mays
  Clone ID: cC-zmle18900083f07d1
gggcgaccaagtatgacgatggcatcttccgtggagtctttagctttgttttcaagtccgaggtcaccgggaggaagggcaatgtctaatgagacgatgcaccacatgtcatatctatggatcggagacactgtgccaaagtctgcttatctatctatatctgcatcaataattcagccacgtacgctaccatctgcatatatgtcagtataggtggcgcatgtattgcttttaataattggtgtcatctaagccatgcaagcatgtgtgctttatagctaatcatcttgcactacgctcgtctgtttatttgtatacgtaagtactgtacattgcatgcacatgcactctcatcacctgtaatgttttacttgaaatttattcaaaaataaataaaggcttgtctttgccacttgttttcttataaaaataaa

SEQ ID NO: 22024 - DNA, 263 bp, Zea mays
  Clone ID: cC-zmle18900083f09a1
tttaaggatttttggaaaaaccaaggccctgggttttttaatcgatcacctggccggacgggaaaaccaagctaccgcctcctcttgccccaattacccaaatttgacccccaatacctcattaattgctcgcattggcatgccggcatcattcactttcacgccaaactggttggaggggatcgccacccctcttgatgccttccggaccacccacttatttttcttgtaaaccacccggaaattggaattttattcccctt

SEQ ID NO: 22025 - DNA, 378 bp, Zea mays
  unsure at all n locations
  Clone ID: cC-zmle18900083f09d1
acgcccgtccgaagcacgttctttttatgagattcttcnntggcgcnacctacccgaggaaagggcgttatgggggactgtatatctcactgccctttatcgcaccataccccatctctcatctataatacgttggctttcatttcggctagccagcaacatgcctaccttncattatagggactttcgaccaaaacgacatttcattcatcatctaaagtccgacagtcagtcaggagtactcattatgaaaaacaattcagacctcgagcctcgaggaccgtcagttcattctatataaaaaaaccgatgctgtatatataacacattgtacctaaatatagttaaagaatatcaataatcaatctttacgatcaa

SEQ ID NO: 22026 - DNA, 419 bp, Zea mays
  Clone ID: cC-zmle18900083f10a1
ttatattttttttttttttttttttttgggggtttttttgggctttttggcggacccaccccccccaacccccaccccgaagccaaccagctacccccatttccatataaaaaagaccttgggagaaggagggaaacatggggttaccgaggaaaccggaaaaaccgtcaaaattccacacacccacccaaccgaaaacctaaaagctaaaacccgggttcccgaaggaccaaacgaacgaacaaacaaaagcttagggccgaccccccccttgccaggcttgaaacctgtaaccccatctggcctaaggaaaaaaaaaaccggcaaaagaaacgcccaaagcccctttgcccccagggcggccctgggccctccccgttaaccagggaaacgccgaacaacctgaacccctttacccc

SEQ ID NO: 22027 - DNA, 52 bp, Zea mays
  Clone ID: cC-zmle18900083f10d1
aaaaaaaaaaaaaaaaaaaaaaaattttaaaaattttaaaaaaaaaaaaaaa

SEQ ID NO: 22028 - DNA, 463 bp, Zea mays
  Clone ID: cC-zmle18900083f11a1
ttttgcatgtttatcaaaagcactaattgcatggacccgaaaggtttgcaatctcctcaaaactacaatgtttgaagttaaactgaacttactgtgacgttacagtatttagttaataactgtctgctgggaaatacaaataatgaaaaatggaaacctcgcacgcacaagggcaaaaataagtataattcacaacaggtccaactttgatgtatcctccagcctatgtagcatcatgtttgctttgagccttttgtggcttttggctgtggattactactcttgaggcttcatagccgggaatagaagtacttccttaatgttctgagaatctgttagcaacatcgtgaggcgatcaattcccaagccccaaccacctgttggtgccaaaccatactcaagggcagtacagaatgtttcgtccaaagccatagcttcgtcatcaccagattgacggtccttt

SEQ ID NO: 22029 - DNA, 599 bp, Zea mays
  unsure at all n locations
  Clone ID: cC-zmle18900083f11d1
cacgcgtccgcaggtgtgaagcgaggtgatattgtttgcatactctgatatccaggaaaaagcaaccggggggagcggagtgtatttccaaagagatttgtcgtcctctctccatgtcttcatatgatgcctcgacagaagggtgaaggaagtgcagtgcctgtaccgtggactccaggaatgggtaggaacatcgaaaattatgttttgagggaccaggaaactcggtatcgtcaaaggtatcttgatcttatggtaaaccatgaagtgaggcacatcttcaagacacgatctaaaattgtctcatttatccgaaagtttcttgatgaccgtgaatttttggaggtggagactccgatgatgaacatgatagctggtggagcagctgcaaggccttttgttacacatcacaatgaattaaacatgcggctttttatgcgcattgctcctgaattatatctgaaggaactgttggtggtggattggaccgctgttattaaattggaaagcaattcaggaatgaaagtttngatttaacacacaatcctgcattcacaacttgtgaattttattggcgtatgcaaattataatgatttga

SEQ ID NO: 22030 - DNA, 435 bp, Zea mays
  Clone ID: cC-zmle18900083f12a1
ttttaattgttctgccaataaataaattgtggggctgtatgtgcagtaccgtcaaaaagcagtacgtataagtaaacctgggcggtacgttctcaaacagtcaacagggcaaagtaaccaatcaggccgtccaacgggagcaaaatcagttccatcagcatcaccattattaataaagcacactttaaccaatgagttccacacatctccacagccacgattcaagcacaccataacggatcaggtccccatcagcgtagccacgattgaagcgcgccataatttcggttgatgaatagtggaatccatcatactgcagttttacacacgttcgccaattgctatggttcaaacatgctaacagacttacaagaaacaagtatcccttgggaatcgcgtcgtagctccatgtttttgttgtagatctccgtgctc

SEQ ID NO: 22031 - DNA, 475 bp, Zea mays
  Clone ID: cC-zmle18900083f12d1
cacgcgtgcgacaaaccattgttggacgcgttcttctcctgcatgcaacctcatctcgtcctccacaggcgggatgggcgtccttcttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccacatctggagaaatcgcgaaatcgtcgtcgttcggttcggagcgcatctgatgccacgatagatggaggcggcgggatctctcggtctgcatgcctgctccacctcgatggatgatgtctctgcgctgataattattggatcaaattccataattattagtagatctatgagatatgccccct

SEQ ID NO: 22032 - DNA, 534 bp, Zea mays
  Clone ID: cC-zmle18900083g01d1
gggcgcacggggcagggccacccccacaagctcgagctttacaacttgtactaccaggacgagaccgggggctggagcgagagccacgacgccggcaacgcctaccgctgcgaccgcaaggacaacaacagcgaccgcaacagcgacgcctaccacggcgacaaggctcacggcggcgtccatgacggtaccgacatcgtgctctggaagtggtgcgagggcgacaaccagcgctggaagatcctcccttggtgaacgaacgaaagaaactactagctggtaccctaataataattctgctggctgcggcgatccccaaataaaagaggcagggtgcgaggcagggcggccttctcgactctcgagtggtgtttgcgttagacaaccagccactgtgtggctagcgttccaacatttgtcagcctgcttgcgcgaagaaatgggggtgactgactcaagaaaaaggcctggccataggctgctgcattagaaattctgatcatgcttagtctgtactctgaataactatgtatg

SEQ ID NO: 22033 - DNA, 506 bp, Zea mays
  Clone ID: cC-zmle18900083g02d1
cacggtgctcggccaccccgtcaagctcgtgcctaacaacttgtactaccaggaccagaccgggggctggggggagagttttaacgcgggcaacgcctttccctgcgtccgcatggtcaacaacatctacctcaacttctacgccttccacggcgacaaggctcacggcgtcttccatgacggtaccgacatcgtgctatggaagtggtgcgagggcgacatccagtgctggaagatcctcccttggtgaacgaacgaaagaaactactagctggtaccctaataataattctgctggctgtagccatccccaaataaaatacgcagggtgcgaggggggggggacttctcgactctacagtggcgattgcgttagacatccagccactgtgtggttagcgttacaacatttgttatcctgcttgcgccatgaactgggcgtgactgactcaagaaaagggtctggtcttaggttgctgcattatgaactactgatcatgccttat

SEQ ID NO: 22034 - DNA, 499 bp, Zea mays
  unsure at all n locations
  Clone ID: cC-zmle18900083g03d1
gggcggggacgcgtggggaaatcatccccgagatggatatctgcgattttgacttcgaaccctgtggctacgccatggatcgcattctccacaatccatgtgacgccccaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctgcgcgtgtaccanagcttctgtgctgctgaagacgctgttgctaccttgcccaaatctgttttccactgctttgacggcgagaacgtggagagtgctccttcttctatgaagaaggactacaagctggctaatcttctctgctgggaagaggaagcggatg

SEQ ID NO: 22035 - DNA, 258 bp, Zea mays
  Clone ID: cC-zmle18900083g04a1
aaataaagccggaaataaacaaagaaacaccccattcctgaaaaaaatagccattcacaaacacttacacacaacaagccaaacgcaaaaaaaaaaaaaaaaggggggcctcccaaatgagcaaactaacacacattcattgccgctcactcactaccccttttcccgaaaagaaacctgtccctccacctaaattaattaacccccccccgcggggagaaaggcggaaaccttatagccccccaggttttttttttt

SEQ ID NO: 22036 - DNA, 264 bp, Zea mays
  Clone ID: cC-zmle18900083g04d1
cccgtccgaaaaaaaaaaaaaaaaaaaaaaaaaaaaaaaaaatttaaaattttataaaaaaaaaaaaaaaaaaacaggcacccggaaaaaaaaaaaaaccaaaacccccccaacccccccaaacaaacaaccaaccgccccaccccaaccaacagcaacgacaaaaacaacccccaccccacccaacaaaccccccccgaaccacaccccaccaccgacaaaccccgaaaaacccaaacagaaccacaccaaccgcccaacccc

SEQ ID NO: 22037 - DNA, 374 bp, Zea mays
  Clone ID: cC-zmle18900083g05a1
agcaagggaccactggaggttacaagctacagcagttgccgagacgtccgaacatttgtcatgttcacagtacatacataggactataataacatcaacaaagtagtcgcagaaaaaccaagctgaagccaacagacagatttacatatgccatgcaaaccacaagcccgattctcatgatacgggcattcacaatctggggcttatcctaactagttctgctttttggatttgaccgcacccctggggattttgctcaggaccttggcatccaacaccttgtactgcttgagggccttggtgtgtgccctttcagcgacatggtccaccttgtcctggtacttgtcgtacaagattggcaccgtgtggagcat

SEQ ID NO: 22038 - DNA, 468 bp, Zea mays
  Clone ID: cC-zmle18900083g06a1
agagccagaggaaacaatgggataatcaagggggaaacatagtatgtaccgattttcctgatcatgtgagcatacaatgaattcgctgtgtcagaaaggtttactgtgcttgctgttgtctctcttgagttgaactttcaactttttaccacctaattggtatccattcatcacactaatggctgcttgtgcagaagctggagaatcgtagcttacgaaaccaaagcatttactaacaccagttgccttgtctacaaaaactttagcactcagtactctaccaaaactatgaaatgcatttgcaagatcatggtcaccaaattctcgtggaatgtgatatatgaacaaattggctccaggagggccctctatctggggggcaggattgctgctgggacttgaagacggtaaattagcatttaaatttgaactttggttgaactgtgagacattgaaaaggggcgatga

SEQ ID NO: 22039 - DNA, 586 bp, Zea mays
  unsure at all n locations
  Clone ID: cC-zmle18900083g06d1
gtccgcggacgcgtgggtgctgatggggagttggaaagtttagagctttagctctccgnnggaacgctagggaaaaagggaacagatgctgaaatgatagacttattttcaaaatatgggaatatcaaggatttgcagattttgagaggttctcaacaaacgagcaaagctggctgtgcctttctaaaatatgaaacaaaagagcaagctgtggctgctatagaagctctaaatggaacacacaaaatagagggttcaagtgttcccttggttgtcaaatgggctgacactgaaaaggaaaggcaagctcgaaaagcgcaaaaatctccattccagtcttctaacatgttgaatgcaaatgctatgcggcagaattcagtgtttggagctctacagatgggatatgtgccgcagtacaatggatttggctaccagccacaaggaacctacgggcttatgcaatacccacctctatctcctgtgcaaaatcaagctgccttccagaatatggaccagcctattaatcaagcaagctcgacccgtggagctaattctgaacttcccctgatttagttcctagatcatt

SEQ ID NO: 22040 - DNA, 619 bp, Zea mays
  Clone ID: cC-zmle18900083g07a1
taaaaaattttttttttttttttttttttaaagaattttttaagaaattttttaaaaaattaaaacccacacttaccccccttttaaaatccttaacaccttctttatcacacaccaaatcaaaacaataatattcaaataacaaatcaaactatcccgcaaaaaaaaaaaaaaactccactaaaaaaaaaccccacccccaacaaaaacccccccaaaaaaaaaaaaaacccccaaaaaaaaaaaaaaatatattaacattatgattgagaaccaccacaaaaataaaaacgtcaacaaacacaccccccccccacagaggggaaaatcaaaaaactactcaaaataaaaaaaaaaaccccaaaaaataagaaagcaaaacaaaccccaccaaaaaaaaaaacactacaaaaaaaaaatacccccaacccacaacataccaaaaaaaaaaacccaaaaaaaaaacaaaacaaactacaccaaaaatttccccggatttagaaaaaaaaaaaaaatatatatctccccaaaaaaaaaaacaaaaccctctaaagtataccaaaaacaaaaaaacacggggtttaatatgtcatacaaacccctcataaaaacccaaaaa

SEQ ID NO: 22041 - DNA, 334 bp, Zea mays
  unsure at all n locations
  Clone ID: cC-zmle18900083g07d1
gggcggaacaaaccattgggggacgcgtacccctcctgttttcaacttcnatcccgaccgccagaaccagggggggccgggctgctttataccttgcctctccagtgctctcggtgagctactttgttttgatttatcaggaaatccgtttgctccatgttatgcaggctcacatctgattgctggattcggcatcttacgggcttgaatagagctaggactgggagaaaacaacaaacccgcgttggatcctgtatcggatagtccttgccttcaaggttcatgttgttttgttttggtggtcgagcatcgcatgttctgcttctggttccac

SEQ ID NO: 22042 - DNA, 365 bp, Zea mays
  unsure at all n locations
  Clone ID: cC-zmle18900083g10a1
cccacgggaacggtgtttcgaattaaagcaaattaactctggtcctggtacattcgactcgaataggatccaaaaatactcacgngaatatcactggccacacaaagcagacatatagctatggataaattaggctggggcattgcccaaccaccaccatcagcccttcccctggggaaggactgatcgaaagtcacccctaaatcttgttgaaggcaactatgtcgcaactctgtacgtactcgttaactggctcaacgcacaaatagtcctcaatgagagtgtcgacagaaacaagggcgccaacgatggtcatcatgatttgcagcttcttgataccatatccaactgggacaagcttggat

SEQ ID NO: 22043 - DNA, 533 bp, Zea mays
  Clone ID: cC-zmle18900083g10d1
gggaccgtgggcggacgctggtgatggcggtttttccatttctcagctccaggcagggcttaggggcttgtgagtaccttctcactcgcagctcatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttttggtgaggagacctaacatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaagaatgtccagaaggaagggttgctct

SEQ ID NO: 22044 - DNA, 329 bp, Zea mays
  Clone ID: cC-zmle18900083g11a1
agaaggatatatctggggtaagaggattgccacaacaaacgtttatcatcaaacagagttacaaagcaatgtttaaagtagccagcaaattcatggcgaggagtaccatccatttccacactcaaaagatgcaacacatccaaggagaaaaagatgatccagacaatgagaactcaagagttcaccctagaacaacttaaaacacgcaaggcacaactcctgctcaagttcaagactcatgatcctttctactcaatcagatcatcatcgtcatcaagaaaaggttgtgcagctgctgcaacaagctcaacttcatgctgctgctgcat

SEQ ID NO: 22045 - DNA, 515 bp, Zea mays
  Clone ID: cC-zmle18900083g11d1
ggaagaggcatctcactggagagtttgagaagaaattttataccattttttggtgtggaagttcatccgtggggtttcaggggtaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcaggactatgaaatttctgccaagagcaactacaactttgagaaacctttcctgtacctcgcaaggaagctggctggtgatccgaaccttcactttgttgaagctgttgctcttaagcctccgggagttaccatcgacatggctatgccgcagcagcatga

SEQ ID NO: 22046 - DNA, 291 bp, Zea mays
  Clone ID: cC-zmle18900083g12a1
ctctattttttttttttttttttttttttttttttgtgtttttttggggttttttttataattttttcccaccctttccccaacactattgttaaccccagaaatcccaaccctaaccttaaagaaaaccaaacattccaaaaaagaaactaaaaaaaacctaacctaaacaatggcaaaaacttttcccctgtaaaaataacattccttaacaattacacacaaaaaacaaaccgaaaaaaaaaaatataaaacacggcgggcccaaaaaaggaaccaactcaaaataaa

SEQ ID NO: 22047 - DNA, 601 bp, Zea mays
  Clone ID: cC-zmle18900083g12d1
ccgcggacgcgtgggttaaaaaaaaaaaaaaaaaaaaattatataaatttataaaaaaaaaaaaaaaaaaaaagagctccttaggaaaaataatttttcccgttttttcccttccaacctttcttccccttccttgcaactttttattttttctattgggtcaccttaatttatttaactggtcttcccttttccatcttttcttacttggtaacccttgcctttccccaccttaatctccttgcaccacatccccctttctccaatttgcgtaatacccaaaagcccctttccgatcgccctttccaataatttctcatctttattgtccattggaacccccctttttccttcctcttaagcgcggcgggggtgtattttccccccatttttacctgttcatttgccctatccttagacttcccttcctttcttggttttctttttttttcgcccttttctcttttttccccctaatctctaaactgggccttctttcaggttccctattattttttacggcccctttcccccaatacttcttttgggtgatttttcctttttggccttttgcctctataccgttttttcccttttccct

SEQ ID NO: 22048 - DNA, 539 bp, Zea mays
  Clone ID: cC-zmle18900083h01d1
ttcgtttcgtcgtgtccacacgcaatagcatcctatcaaattatccaaagagcaactgggagcggggtcgggaggcaacaatcggcggcggcatggaccggaacctgagcgggtttctgatcgggtgcctgggcgccgccgtgacgctgctggcgtaccagcagacggtggtgaccagcacgcagagcgtcgcggcgggcttcgtcgtcatcctcttcgccctcttcgtcaaggaaggattcatttccctctgaatctctggtgcgcgtcagccagccatgcatgaggaggcgtcatcgctccgctgcctgtatttctgctcgctagttcaggcccgcagctgccgctgtgctcgtcaggttcttggaaaaatactgtaatagcgtagtgacttttatgtacgacacggatggttgttgctggctgaaggtctactctgtcgaaatcgatgtatcttaatttatgctacttgaagaacagcagactgcacatcagcagagttcttgcctttttacgctaattataattattggtacacg

SEQ ID NO: 22049 - DNA, 391 bp, Zea mays
  unsure at all n locations
  Clone ID: cC-zmle18900083h02d1
cggtcagccgttcgttggcgagattgtttgctgctttgacggttgtgctcgcagcagtttcgctgggccgtgagcgcgccatatgttgccacgaatggttggttgttcggtacgttgaggaacgatgtgtatgtagtgtgcacgtttccggtgcatcttgttctcctcaagcctgtcctgtatgtttacccccctgcaccccctcctccctctttgtagagagagggtctgtatgttcagtggaagatggttgttctatttgatttttattttatggacatgtatgctcggtgatgtgttgtggtatgctgtatatcgggtatatcataattacgagggtgcagagtatatccctnagtaaaaacaagattatattttctcatatacttag

SEQ ID NO: 22050 - DNA, 383 bp, Zea mays
  Clone ID: cC-zmle18900083h04a1
aggggtaaatgtgggtttacttctgtttaagggctaaaatacaaaaaattcgggggaaaaggacgacgagccaaaccaaagtgctagttaatcaaccaaagcaagcaaccacctcgctcgacgcgcggcccgccgtcgatcaggcgcggaagcagccaacgaagcgcggcaggtgcaggtggtggtgctggtggtggtggtgcgctccgccgccgcttgccagggcgccgtctaggtccacgaggtgctgggcgcatctggtcccgcggaggtcctggccgatgaggtgctccacctggacgaagcggtcgacgcggcatgggatggcgagggcgccctgttgccggaagccgtactcgcgctcggccctctccagcagcgcg

SEQ ID NO: 22051 - DNA, 576 bp, Zea mays
  unsure at all n locations
  Clone ID: cC-zmle18900083h04d1
gtccggtaggccatgtccaacgtgcccacctccctccgttattcctttctcaccgtcttccgcctcgccaggtccaggggcgacccctggcccttctcttcctgcctgtaaccaccatcagcccccggccggccggcttcttcgtcctccttcctgatcgagcaaccaccacaagcaagcaaaaagaacaccgagctccttcctggtgaccatcatgcccggcaggcatcatcatcatcagcagcagcagcagctggcggcggtggcgcccaaggggtgcgtgacggtgcgcgtgggcctggagggcgaggagcagcgccggttcgcggtcccgctgggccacctcaagcacccgctcttcggcgcgctgctggaggaggccgagcgcgagtacggcttccggcaccagggcgccctcgccatcccctgccgcgtcgaccgcttcgtccaggtggagcacctcatcggccaggacctccgcgggaccagctgcgcccagcacctcgtggacctcgacggcgccctggcaagcggcggcggagcgcaccaccaccaccagnaccaccacctgcacct

SEQ ID NO: 22052 - DNA, 473 bp, Zea mays
  Clone ID: cC-zmle18900083h05a1
gcaaaagctgaacttcatgagatcgtaaagggtgggcattatcgggtaattttacaccaacaggtacaagatcctctatcagctacacaatttgtctggagcttgagaagctctgatcaacgaatacgctatttacatacaatacagccccactttcttccgcaacgcctgcgctattttggccttgggattaatcaagctgtctcacattttatttacctcttttggaagttgaatatcttgagcgagaggccaaagagcatggcaaagagcacaggaaacgcgaccaccaccacagtgaccacccacaggaggtcgtgatggtacccaaagttgtcctcaacgaagtcagatatacgcaccccaccgtcactgaacgtctcggatacatctccaaactgtgaagtgaccagcccgttgagcgttcatgcgatggggcaaatccagtagaaccatctccaccagactggaat

SEQ ID NO: 22053 - DNA, 493 bp, Zea mays
  Clone ID: cC-zmle18900083h05d1
cgtcgcacgcgtcgcgaatactcacagctttctttacagtttttgctgctgggaacaggcatgggtattgtataaacccttcatatactggtgtcaaatacttctacacgacagtgattgccctgttgtttggaacaatgttctggcgtgtgggcagaaaaagggatagtcaacaggacctgttcaatgccattggttccatgtatgcctcggttattttcatgggagtacagaattctggttcagttcagccagttgtatcggttgagcgaacagtcttttacagggaaagggcggctcatatgtactcgccattgtcgaatgccttgggacaggtcataatcgaactcccatacatctttgttcagtccttaatatatggcgtgctggtgtatgctatgatcgggtatgaatggacagctgacacgttcttttggtaccttttctttacgtatttcaccctagcatactacacgttctaccgtatgatggt

SEQ ID NO: 22054 - DNA, 464 bp, Zea mays
  Clone ID: cC-zmle18900083h06a1
ttttgtttttttttgaagagcaaaactagtggggttcgttccgggtgggagagcacaagaatactcgcatcccctcatggtacaaatcacgacagaaactagtggtgaacaacacattgtcctgtcacgccgcgtacccggtgctagcttaaaaccctgacgcgaacttggtggcgtagacccatgcgtcgttggcgaccgcgcccttcgaggcggacgaacaggttctcgaggggccccttgccggtgactatggcctggacgacgaagccgaacatggagaacatggcgaggcggccgaccttgatctccttgaccttgagctcggctaaggtgacggcctcgtcggtgaggaccagcgggtcgaagtactggcccacggggtaaaggtcgatgccctcgtcgacgccttcatgcccttgatgcggaagccctccacgaggcccatgaggatgacctggaag

SEQ ID NO: 22055 - DNA, 332 bp, Zea mays
  unsure at all n locations
  Clone ID: cC-zmle18900083h06d1
cgggcgcggacgcgtgcgcggacgccaacgacaaacaagttcgacacatcaccgcaacgccgaggccaagaggcggcnggggggacaagggcgagccgccccccccgcacccaaggccaccccaccacgggacgccgccgccgccagggccggcggacgaagcaccagagccaacgaccggccaaacgggccggacccggcaaagcaccaggcccccccgaccgcccaaacgccctcggacccgaccggggagagcccccgagacaacagacgggacaccgcccggccgaccacggacgcgacagcgcccgcccggaacacgaccccgaaac

SEQ ID NO: 22056 - DNA, 201 bp, Zea mays
  Clone ID: cC-zmle18900083h07a1
ccaaaaagggccggctgggttgataaaacaaatcccccccccaggattcccctccccgacccccaaaaggaaatggaaaggggaaccctgccccccccgttcggggccggcctcccccccatttttttttttaccctcccccccccaacaggaaagggaaaggggaaccccgccccccccgtttgggggccccgtggttcc

SEQ ID NO: 22057 - DNA, 323 bp, Zea mays
  unsure at all n locations
  Clone ID: cC-zmle18900083h07d1
aactggtggtacaggcttccgctttccattttctgatgttagtcgcaagccacatatatacnggcagtngggtgcagttaccgaactggcggtccacgctcccgctttacatttcctgatgggagccgtgtaaagtaatcctggggtgtgtacttgtgtcatcaaccatgcctgccgctttgacaaaacttaatcaaaaataaaaactcaaaaatctacaaaacaaactgaaactaaaaaaatcaattgaagcaaccaaagggggggccgattctagagatctcaatctaacgtccgcccccttggaatgttaaaattttttt

SEQ ID NO: 22058 - DNA, 498 bp, Zea mays
  Clone ID: cC-zmle18900083h08a1
ttaaattttctcttttttttttttttttttttgttttttttttgttttttttttaaaaattttccccttttttccccataattttttttttttttttatacaccttaaagaaaaaaaaaaaaaccctaaaaaaaatttgggtaaaaaaaaaaaaaaaattgaaaccccccaaaaaaaaaaaaagtataaacccccccaatattttaaaaaaatgtataaaaaagggcccaattaaaaaaaaaatatgaacaaggttacaattttcattgggaaggggttgccaaagagcaaattaaaacaaaatttttgccgggtgggggagggcaaaaaaaaaacccccctttggggccttaaaaaaaaccccctaaaaaaaaaaaaaagtttttaaccccccccaccccttataaaaaaaaaaaaaaaggggccaaaaatataaattccttccgaaaaaaaattaaaaaccaaaggttttttcccgaaaaaaaaaaatgctgaccc

SEQ ID NO: 22059 - DNA, 489 bp, Zea mays
  unsure at all n locations
  Clone ID: cC-zmle18900083h08d1
cgagcattcatggtcagggtgccatcattatgcttgttgtcacttttaggctgacatacaagaatgggccgacgggggacatttatctgtgcagggtctgtgagaacatccccattgttctttgtggtaacaaggttgatgtcaagaacaggcaagtcaaggccaagcaagttacattccaccggaagaagaacttgcagtactatgagatttctgccaagagcaattacaactttgagaagcccttcctttacctcgctaggaagctggcaggggatcagaaccttcactttgttgaagctgttgctctgaagccaccagaagtgcacattgatgtggccctgcagcagcancatgaagctgagcttgcagctgccgctgcgcagcccctccccgatgacgatgatgacctgatcgaatagatatgttatacatggcccttgttgatgactcttgttaaaaatctggggtggttcaatccttgttagt

SEQ ID NO: 22060 - DNA, 365 bp, Zea mays
  Clone ID: cC-zmle18900083h09a1
gggggcgccacgggaattgaaacctcattgtttatattcttaacaaagcacaaaagaactagaacttagtgaattcgttacaggacggttgcagattagtttaacacaaaaagacaacgtgtccaaaaccagcatggatccagcgtccaggggcaccgttcacatttattctcagcatagacaagcagcaaagatggtctgcgaccaaaggccattggggacgacccacgatagggaggcagaaatatctctctctactgggtcttgaacatgtggcggatcaggtcgacgacgcggttgctgtatccccactcgttgtccgaccaagagacgagcttgatgaagtggtcgttcagggcaatccc

SEQ ID NO: 22061 - DNA, 313 bp, Zea mays
  Clone ID: cC-zmle18900083h10a1
aggggaaatttgtccgcatctagggaggaattgtacattgatttaccatgtgcaatacagtttccggtctcaataagatcaatactagcttgttggtacaggcagcaggctggccatgcatgaatcatgaccgatgcaacgcttcaggttcctttacaacacgcatgcatttagctttccacagcaaacaactggcggcggcggcggcagcagcaggtatgctgatgcaccacgttctagtggaacttgaggctggtgagcacctttttgttgacggggtcggcgaggtggtcaaacacgttctggaacgggc

SEQ ID NO: 22062 - DNA, 605 bp, Zea mays
  Clone ID: cC-zmle18900083h10d1
ggagccatcgacacgatcgcgagcgcaagcacgtacgttgtcggattttcaagttagaagaagcaccagggggtgatcgggggcggtccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggctttcgtcgagcaccgccgccttcaggactggtaccacccgggctccatgggc

SEQ ID NO: 22063 - DNA, 336 bp, Zea mays
  unsure at all n locations
  Clone ID: cC-zmle18900083h11a1
ctaagnacgtacttaatgggttgcattaagggttgtacatgtgaggaaaacaagtagagatggatgcatcatccatcgacgggcggagtacatacagatcgagatgcatggaatggatagctagctttagttgactgtgatcttgccgaccattcctgctccttggtgcggctcgcagtagaagccgtaggtgcccggcacggtgagggtgacggagtaggtctcgcctggcgcgttgaggtactcctcctgcgagatcttggaggcgtngacgccgctcggcacctcgtcttcgtcgaacacgacgttgtgccgggaagccggcgttgttcttga

SEQ ID NO: 22064 - DNA, 579 bp, Zea mays
  Clone ID: cC-zmle18900083h11d1
ccacgcgtccgtgctctgatagcttgctccaggacttacgtactttcgtagatcgatccatcgatcgcgggctagcgggcgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactgcgtcaccctcaccgtgccgggcacctacggcttctactgcgagccgcaccaaggagcaggaatggtcggcacgatcacagtcaactaaagctagctatccattccatgcatctcg

SEQ ID NO: 22065 - DNA, 286 bp, Zea mays
  Clone ID: cC-zmle18900083h12a1
actagaaaagggccatcggagggcaatttatctgacaaacgacccaaacaatacaatagcttttgcttaatattgcagagtactggagtagcgagttcaccacgagagcagcaagacacaaacgagaagaaaatagcggcagagcacagggctcgcaatcatatacggccctttatttaaccgaccacggactcacgggaggacgaggcacccttcaacgacgggcagaggggtaaccttgacaggaacataagccgtagggccctcaccgtcgctggcttcctcc

SEQ ID NO: 22066 - DNA, 348 bp, Zea mays
  Clone ID: cC-zmle18900083h12d1
cacgcgttcgcagtatgatgaggaagaggaggatttcagcgtctgtgagggccctacggcctatgtggcggtcaaggggacccctctgcccgtcgctgaagggtgcctcgtcctcccgtgagtccgtggtcggttaaataaagggccgtatatgattgcgagccctgtgctctgccgctattttcttctcgtttgcgtcttgctgctctcgtggtgaactcgctactccagtactctgcaatattaagcagaagctattgtattgtttgggtcgtttgtcagctaaattgaaatgcgatggacatttactcgttaaaaatattatacctaattttttaatttcaaaag

SEQ ID NO: 22067 - DNA, 138 bp, Zea mays
  unsure at all n locations
  Clone ID: cC-zmle18900084a01d1
ggggaaaaaaaaaaaaaaagganaaacaaagaagagaaaaaaaaagaaaaagaaaaaaaaaaaaaaaaaaaagaaaaaaagaaaaaaaaaaagaaaaataagtaagaaaaaaaaaaaaaagagaaaaaaagaatggtt

SEQ ID NO: 22068 - DNA, 339 bp, Zea mays
  Clone ID: cC-zmle18900084a02a1
ctccccaatcattttagggtacactgggatttttttttattgataaaacccccaaaacccatcattaaaacgccaaaaaaacaaacactaactcaaaataaaaagccatcaccaaaaaaaaaactcacaaaatcatctaaaaaaaacacacaaaattgaaaaaaaaaacccacttattcggctaactaaaaaaaaatttaaatcctacaaactcaaagaaaaaattcctgaaacaatcaagcctacttacaaatcctaataatctatacaaaaaaataacgggataaaataatatacacccggagggggacacaaaaaaccaaacagaaacataaattg

SEQ ID NO: 22069 - DNA, 251 bp, Zea mays
  unsure at all n locations
  Clone ID: cC-zmle18900084a02d1
ggcactgtcaggaggtttgcaggagggccaggaaggtgtanatgttcggtgcaacggnggacggaaagaggcagcggtacaacacaaaacaagtgttgctgcactgcagcccgctgcgggttaataggtgtagaaaatatagcattcgttacgaggacacatatagaagtattatggaagaaaaccgctgttagataagaaatacactgctgtgtattagtagttaataacaagaattcttggtttttgtt

SEQ ID NO: 22070 - DNA, 382 bp, Zea mays
  Clone ID: cC-zmle18900084a03a1
ttttatctcttattttttttttttcccaacccaaatggtcggggggatcatgggggttaattaaacccttacaacccaaaatttgaaataaaatatcattacttcttcggacaggcagacactctctttagataacaacaccagacgcacccatgacaatacccagctaattgaatactatggtggcttatcgacccaacaccctttttatttcgataacggcaaatagatttttaaaccctcgcactcacacacaccatttctttattgatccggatccattgcattacttaaaaaaatgcagccctgcgtcaagatctaaaacgttaggcgggtgccgggccccaacttataccattcgaacacctaaaatgtatatttt

SEQ ID NO: 22071 - DNA, 514 bp, Zea mays
  Clone ID: cC-zmle18900084a04a1
tttttagttataaatcattttatcggggaccaattaatataggggtacagggggggcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattggtcaaccaccaccacaagctagatagataataatcatatccatggtcgtcgatcgatgtgatcagcagttgcaggggtcgcacttgcagttgccaccgcagctgcagccgtgggcggcctcaccggactccgctcgggactcgacgaacttgggcgcggtctttttcttcggggccacgccgagaacgacggtggcctgcgcggcggtgcttgtctccttcaggtcagggtacttcttggcgaacttgcagctggcaagcgcagcttgatccgcaagtgcaagacattct

SEQ ID NO: 22072 - DNA, 429 bp, Zea mays
  Clone ID: cC-zmle18900084a05a1
aatccgcttaaattatataaggcatagtttagaagttgttagattacccaaacaaacacccccttaagatcgattttttacagttttgatgagtaacagcagtaccacactctgaaagcacaattttgaatacaagcagttctctgttgcgttcactaacaatttgttcttcagtcagtcccaggttgacttccctgtttgcttcaatatctccaccgattattttatccgtaatcacaaacaattggctctttatttttatacagaacattgcatgcactgatacacacaaggtcccagtgtatgcaattccctatgaacgtttgcctcattggagcatataaaggcaaggcatgaggtccacaactttagcgagtgcctgtcagttactccgatttgttctcagagttaatctgctgggctagcaac

SEQ ID NO: 22073 - DNA, 472 bp, Zea mays
  Clone ID: cC-zmle18900084a07a1
gacatgatcatctaatattcaacaaattgggatagggtaataacagagtacaagtccagtcattatgaactttgacactagaataaattattagtttaaacttctttttttacaagcttcatgtggattgttgttccatttttcttctccatgtcagcttcaagtgttgcttccacttagcactcttcataaagtgcttctaaagagtagaaaagaggaaatggcttcttgcgaaaccttgcaacctttgggtgagcactaatcaaccttgcccaaacctctggttcagctaatatcatacatagggagtcattccaaccagtccaactttcttttcttgaatctcttactgctttataacttgatttaagttctttgtccttctcttgtaattgttgttttgtgaaatgagccaaagagaacctttcattaaacttagcagggatacactgtcatccctttgaattccatc

SEQ ID NO: 22074 - DNA, 445 bp, Zea mays
  Clone ID: cC-zmle18900084a08a1
ccaggcctggggtgaggatctcaaatctcaacatcaaccccgcctcgataaaccacaactgagaaaagaaactggaaggcaggaatagagaacatgcgattgatacagcaaacatctaggacagcaagacgaaggtgaaggtggatggcaagcgtagcagccgggcaaacgatcggaggatcaggacccatcagtagtcgtcgtcgccgccatagtcgtcgttgccgccatagtcgtcgtagccacccccgtagccgccgcctccgtacgactcctccctctccaggttgtccttcacccgctccgacacgcgctccttgaacttgtcctccaagtagctcgccccgccggccagcgccagccctccgagcacgcccgccgtcgcgcccactggcagccccgtccccatccccatcttgttcttcttctttccggcggaagcaac

SEQ ID NO: 22075 - DNA, 428 bp, Zea mays
  Clone ID: cC-zmle18900084a09a1
ttcttttttgactttaaaacatcatatatttagcccggggcagggggggcctccagcaaaataagctgctcgcccaagggtaaaatccatggcttttttctttccattctggtccaaacaataataataataataataataaattaacactcatctgatctcgcaaaattatacagcccaaaactggctgttcctcgcatctttggtactgcgttccttggacatctaagctacagagaatacacgacactgtctttcgcaagagacagcatctgaaaaagttggttgtccaaagctgctaaaaggattattccaaaaggctgttttaaaccttttattacagcagcatgtgagcctaaaattgtctggcccgtagggtttgctttcaagttttttttgacagcatcaaaaactgctttggcggacat

SEQ ID NO: 22076 - DNA, 386 bp, Zea mays
  Clone ID: cC-zmle18900084a10a1
ggggtggggttatttttttttttttttttcctttttaaaagaccggaaaacaaaaaaaaaaacttttaattacgggacaaaaaaaacaaaaaaaaaaaagggtaaaatttgaagacacactttaaatttgactcaagtaaaaaaaaaaaaaaatttgtcaaaaaaaaaaaaaaaaacgggggaaaaacagaggggttattaattaaaaaaggggaaaatactcttttgaaaacccaaggggggaaaaaaaaaaacccctaacaactcctttaggatggtttgggaaaacccggtaaaaacccttataatctcagggaaccaaccatttaaaggagggtatccccttgaaaaaaaaatatggttccttcaaaaggaaaaataaaccc

SEQ ID NO: 22077 - DNA, 393 bp, Zea mays
  Clone ID: cC-zmle18900084a11a1
tttttctctttttttccatcttactagtttaattggggttaaggtattgtttaaattgtactttgattttcataaacacacatgtcccaaaaaatcccacccgtaagaaatcatatttttcgagtaaactctgcatgcaataatagaacatcccctcaaccaattcataggactagggcgtgctgaacatggatcaaatggacatgttgtttaccatgcttcatcctgggaccttctgccaagactaacaaaaaagagcggtttttactatattagcctgaaacactaattcttcttgacgcccagggtgttaaagcactcctcaattaacccttctagctccttaatactggcaaccatctcctgaaaaatgggcttttccatgggctccaa

SEQ ID NO: 22078 - DNA, 234 bp, Zea mays
  Clone ID: cC-zmle18900084a12a1
cgtgaattctaacagcgacacgccctcccctttatttttttttttttttttcaaaaagacacaaaaatggggggcgggtttttttttaaaaacacacatgcctcaaccaacaattattaataataaagaacaaaactcaaaccacataaaacaccatactctttggtgactttagctaacttaaacaacccaccaacattttgaaaaaaataagaatggtactaaaaactccac

SEQ ID NO: 22079 - DNA, 509 bp, Zea mays
  Clone ID: cC-zmle18900084b01a1
aaaaaaaaaaaatctttttccataaatggaaatttccaacccaaaggggaaaattttgtaaatttaaaaaacaaaaaaaccctggaaacccttttcctttttaaatggaaaaaatcccaaaaaaaaaaaaaaaactttaaattgttgggcctttttaaaaaaaacgttttttaattaaagcccaaaaattggggccttaaaaaattaaaaaaaaaaaagcctaaacagcctggttggggttttcttttataaaaatgggcccccacaaaccggggaaaagggtccccccctttaaaaaaaaaaatattttaattttttcttgcgcccccgccttccctttacatttaaccttcccccctttaaaaatttcgaaaacaatcttttttttttttgtgcccaaaaattgtttttttttggaaaccaaaaaaaaaatcttttttcccccttatttttttggccccccctctttttttcttttaaaaaaaatttttttaaaaaaaaaaccccca

SEQ ID NO: 22080 - DNA, 541 bp, Zea mays
  Clone ID: cC-zmle18900084b01d1
cacgcgttcgtccacgcgttcgcccacgcgtccgcccacgtgtcttttgcgtgtcggagctggagaaggagggctgggccatgaatgaggacatcgagcggctcggccgcagcaggagcgcgggcaagagcatgttccccgttcgcgctcgccgcaaagccccacgtctgcggcaccaaggacaaggaggctgctccggaatcgtcaaagtcggagacgtcaaagtcgaaggcagcggcggcgaccaggagcgatgacaagttggctgtggtcaagggcggtgccgctgccgccggtgatggcgggccgcagctgaagcacaggaagcacaagacgagcctgtctgcctgtcagtttttagatatctacaagcacacagtataggccctgaatgaacaacgactgtgagtgagagacgctatcgatgtgatgctcatttcttttcttggacatttgctcagtgaaaaatgcatagcgttaccagcgtgtcttggactttcagctgtaccatgctttcccgttgtgggtgtacatgtccatg

SEQ ID NO: 22081 - DNA, 360 bp, Zea mays
  Clone ID: cC-zmle18900084b02a1
aaaacagaaaactgggccatatttttaggattaaccaaccgggaaattactcgtacaacaaccgtagcatcatgtgatatccaatggtttcccgtgattcgcagtggcatacctcaacattagggttacatacacttgtggggattcaaatcaactggggtcttcctaataattggggccgctattgcccattactgttgggttccgcttcaatttcggaggcctccctgatgctggtgggggcctaaaacttcggcccctgcagctgccttttcaccaaggccgtgtttatgccgtcgcggtccaaaaatttgtcgtgcgtgccgttcttcacaattaggcctttggaaatgacggcaa

SEQ ID NO: 22082 - DNA, 499 bp, Zea mays
  Clone ID: cC-zmle18900084b02d1
ggaaggtagcaccaggttcaaaggttgcactcgaagggctttttggttttggcaaaaccacaacaccaaaggggacggggcggatttatgaccctctaaagggaacgatcttgcttaatggagtaccgttggttgaaatttcacattaaatatcttcactgcaaggtaagcattgtcagtcaggagcctacgctcttcaactgcaccattgaagagaatattgcttatggactagagggcacagcgaactttgctgacgttgagagtgcagctaaaatggcgaatgcacacaactttatatgcggctttcccgaccaatataaaactgtcgtcggcgagcgggggatcaggttatacggcgggcagaagcagaggatcgccattgcgagagctttgcttatgaacccacgaatgctttctcctggaccaaactaccaagtgccctggatgctgaaaggcaaatatcttgtacaggatgcaatggactccttgatgaaag

SEQ ID NO: 22083 - DNA, 347 bp, Zea mays
  Clone ID: cC-zmle18900084b03a1
tttttatttttatttcattttttctttcaccaattaaaatagggggacattgggatctttttttttcccccaacaccacacacaaacacactatacttacatccagcgcattgaatgaatcacaaacactccatagagcagaaaacataggagactaacaactgtcacaccctctcttacacaaacctataaagacacaagtatggcactcaattaacacccccttatggtcggacaaacacctccacaagctagaaacattataatcccatccatacaggccaaaaccacccattaaaacaccccggagaggggccaaaaaaacatctttaaccttgggcccaaaa

SEQ ID NO: 22084 - DNA, 316 bp, Zea mays
  Clone ID: cC-zmle18900084b04a1
atagggcaaaattggggttgtaatttaaaaacttcaccccccatttctttttatataaccaaagccccccaaccccaccaaaaaagagaaacaccctcttcaaaccttaaaaaacggccacttaacgccctaccccaccaaaaacaatgaggcttacctaacccccttgaacaagaggtaggacccaaataatttcaaacaaaagaccctgtttgattttgaaaaaaaaaaccatggatcaaccaaatctgacttcttttgcgctgaccaacctgatgccacacaaacttgggggcggaaaccaactttgcaaagg

SEQ ID NO: 22085 - DNA, 170 bp, Zea mays
  Clone ID: cC-zmle18900084b05a1
ggttggaaaataagttccaacaacctcgttcaccaaataccccaatgacaaatgctgaaactgtcgacgaggcacaaaaacagcgggcagtacaaaaaccatgtcgttgagtttattaatgcttcggacaatagttgtttatggccaacttttgagctttgaaacacaat

SEQ ID NO: 22086 - DNA, 486 bp, Zea mays
  Clone ID: cC-zmle18900084b06a1
tttttcaatgtatagaattttttttttttattcctgttaaatggggggtaacgggtcttatgtacagttgcaggctacaggcctactcccactgaaaagaatcgccaccgaaccatcacgactctgccaccgccagcgccacagccaccacgttctgcccggcatccagttcttctgacaccgcgttctggtcgatgaagttgaacagcgcgagccccgcggcccacacgtcgtcgtccatcaccgactcctccggcgagtggttgatgccgccgcggcaccgcacgaacagcatccccatcttggtgagcctggccatcgccatcgcgtcgtgccccgcgccgttcatcagcacgggcgtctcgccggccgccacggtgcgccccggcattgccgacacggtcgaccgcgccgcgcgcttcagctgagacgatagctccgggtcgcagagcgtcgctgcggccgagtgcttatgctcgactttgc

SEQ ID NO: 22087 - DNA, 228 bp, Zea mays
  Clone ID: cC-zmle18900084b07a1
ccatgccaactcgacttgggatggggcgaaaaaaaagatcacaggcgggagcccggcttttgacctgggctatatcccagaatcccaacgtggatcctatagcttcaattcaagtaaaattctctactcatgtttctacaaaaggtcttccagccaacaacaaatttccgcacactacatactcaaaaaaaaaaaaaaaaaaaaaaaaaaaggggcccggacccgtgg

SEQ ID NO: 22088 - DNA, 488 bp, Zea mays
  Clone ID: cC-zmle18900084b08a1
ttttgcttcaactttaagccataactttggcgttctgggggaggcgcgttacacaggccacaagtttcttcagtcatgtagtttgggtgcagccaaaaccaacgtcactgcagttgcttatttgggtgtaaggtggaggaagcaaagaagggtaaaacaaacatctctcagcaggagatggactctccagctcgtcatgcctaactgggaaaagcataaataaacgcttaaaatccaaaaatggaacttgtacagggttgaacaagcaagaagcctccttatgaagcagactccttggcaattttctcagccttagcaatgacttcctcaatgccaccaaccatgtagaatgactgctcagggaggtcatcatacttcccatccaaaacaccctggaaactcttcacgctttccttcagctccacatactttcctggagcacccgtgaaaacttcagcgacatggaaaggctggctcaggaaacgctg

SEQ ID NO: 22089 - DNA, 425 bp, Zea mays
  Clone ID: cC-zmle18900084b09a1
ttttattttcatttttataaatttaggcaaacttcaggggaagggttgtttgactcctcgaattctgggatgtacacttattttgggatgcgtacttggttcaacaaaaaaaaaaacacctggactctcgagcgcagactcgacgtagaagtagaatttacaagttacaacagagcactcacagttatgattggactccttgacacaatacaacctccaatttacaagttgaaacagaacaatcacagttatgattctactccggagtcctgacgtacttacaacttcccccacctttttcgtagccttaatttcaccacgtcgctgacttttgggcattacatacgggggtgaaaaccttgactggtctcctgtaacatctgtctgagtttgttcacgactttttgcttggcaccatttgcttt

SEQ ID NO: 22090 - DNA, 460 bp, Zea mays
  Clone ID: cC-zmle18900084b10a1
aaaaagcgtcagggggccggtgctgtatttccagcatgttcacagcaccagcatttgttacaacgaaaagaatgcagtgtgttcaatgccatctgattatgagtcctatagaatatccttgcctgtcctggactgtcatattcccagtctaaaaagactcaaaaaggatcgaaagaccttagcaactcaaaaacaatggggggtcacatccaatatcgattcccgtggcgctacagattctaataccgatgatcactagcatttactctgccttcctcttccctgattggtttcgggcaccagctgtcaggcaccgccccacaaatttgagaacctcatcgatcagcaccactgggaaggccactgctatcaccaagagccattcgttcaaactgaggggcacaatcccaaacacttgagccaggaaaggcacgtataggatcaagaaatgcagcccaaa

SEQ ID NO: 22091 - DNA, 286 bp, Zea mays
  Clone ID: cC-zmle18900084b11a1
aaaagcccacaaatttctggggaggggatttcttatcacgtccatctgaaagataccctaacatataccaattcaaatgggtgaccgcgtgatatattctattgcacagtacgtacaagtgctggggttctgaaataataaaattcgtgagctactggcactgaacatacaatattgccagaccgaaacaagatacctcttattattctaatacagatgggacagcatgcttgtccctgcccacccaatcatccacatgtgcaatcgttggatatctactactgga

SEQ ID NO: 22092 - DNA, 512 bp, Zea mays
  Clone ID: cC-zmle18900084b12a1
tttttgttagctttggaaaaataatgcctaaattctgggcaggggtagaagttcaaaacctaataaattgaattatctcttccattctatggccccgagaatgccaatattagcacgaatcgtacggaaatgtaactcggtattcaaacaactattcagagttcctagagctccttgtacagcttgttggaaaacccgttgtcggacctgattcatcgccctttgtttttcaaaataaagggtttcgtttttagacttttctaattgttccaaactaatagaagtagcattaatcaaattttctttttctcgttctatttcagagtatccattcattcgatactcatctgcttccagttcgactttctgtaatcgaatacgagctttttcgagttgttcaagggtccctttacgcaattcttccgaatttcgaatagtacttaaaatcctctgttttcgattatctaataaatcttgtaatgaaagtagattatcttgctattaagtttaca

SEQ ID NO: 22093 - DNA, 287 bp, Zea mays
  Clone ID: cC-zmle18900084c03a1
gaaacactacttgtactcagggggcatgaggggtgcataaacagaattacacgactgggctaaaattgataaaacagttgtgggccccccaccagtatcctgtgatcgcataagtagcatcgctgagaaacaactaacacattccaacctcaaacgagttcatgcctcaggcagcaacaactgcggttgcagcttcagcaggtgcattgtcaccgacgagttcacgcctggcgtactccctcgccccgtccttgtcaacaatcttgataacaaagcccacgcgtccg

SEQ ID NO: 22094 - DNA, 320 bp, Zea mays
  Clone ID: cC-zmle18900084c03d1
cggacgcgtgggctgtgatatcaacattgttgacaaggacttttttatttagtacgccaggcgagaactgcgggggggaatgcacctgctgaagctgcaaccccacttgttgctgcctgaggcatgaactcctttgaggttggaatgagttacttgtttctcagcgatgctacttatgccatcacaggaaactggtggggggcccacaactgtcttatcaattttagcccagtcgcgtaattctgtttctgcactattcatgtctgctgagtacaagtagtgtttcacgcttgaacaaaaaaaaaaaaaatataatatag

SEQ ID NO: 22095 - DNA, 369 bp, Zea mays
  Clone ID: cC-zmle18900084c04a1
acacagaacctcgaatgggacgttggggtatttaccacatatttacagcataaagcacacaccggttttcattagtacaattggaaaagagtaagaacaccctaatctgcaattctgcatagatacaaatctaatcttaccacataccacaggccataaaaggagcctcagattaccatgctccaaaaactcccacaagggacactaggatggggggcaactcgattcagtcggtctcatgatcagggcgtggggtgtaccaatcagggtaccttcccatccttctcagcagcctcgggtatggagactccggcatcaacgccttttctttttcagcgagctcttcttgcgttttcgcccacgcgtccg

SEQ ID NO: 22096 - DNA, 532 bp, Zea mays
  Clone ID: cC-zmle18900084c05a1
ttttgaaggtttataacttttacaattcacatcttgttttggggggcctgggccatattgaacaaaacaactgaacacaacagctggaggactgttgcatgtacatcatcatttttcgagtcacgtcgaacaggctacagaccatggacactgaaatctaacggcacaattgtagagcaatctgtcacatcgtttgagttggcggtcaagaaaaaaaaaatgaatgatgactggcacggcggcacgcggctcctggacccttcttcataagctatgcatgggtcgtatgaggctgctgcattggctaacttttggactttctttccctcagattcatggcagagcgaaatcacgcacctctgtttgctggaataagcttgacaagctttgcaagatcatatgacttgaaatcccttccaaagcatagacttagatccagcgcagtcctcccatccttggttcttcttgtcttatccgcaccattgacaagcaagaccttagctatatctttattcctactctgaatggctaa

SEQ ID NO: 22097 - DNA, 560 bp, Zea mays
  unsure at all n locations
  Clone ID: cC-zmle18900084c06a1
ttagagcggccgcnacatcgcggggctgaccccgttcaaggttttcaaggcgttcgcgaagcgcgagaggaactggggcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggacatcatcatcgacgtggagctcgtcacccgcctcctccccagggggttcatctggcccgtcgccgcctaccgcgagctcatcaacggtgacctcgtcgtcgacgacaaggacatcggctactactagctgcgctngttcacctgcttgcactgtgcatatatattgctgctgccgagctgggcgcttggatagt

SEQ ID NO: 22098 - DNA, 393 bp, Zea mays
  Clone ID: cC-zmle18900084c07a1
ggcgggtcaggggtcgtttaaaagacatgctcataaacaaaatagttcgttggcgaatttcagcagaaaaaagaaagttttggagcctattttcaccattttctgtcagcgacagcctcggtgaggaatggggatcgaattgttcttcatcaaaagtacatattgcctaccacttcatcaaaaggcgggccatataaaaactccaggtcgcgcaccaccgtcattcattaggcagggactcctccatcctttgagcgatcaaacggactgcagcgttggcggcccaaaaagggccccggaaacttttcctgtaccacagcttgtccaggtcgcccgacccctgggcggactcttgggttcaccccggaatttcggaccggttcctgcaggcgt

SEQ ID NO: 22099 - DNA, 567 bp, Zea mays
  unsure at all n locations
  Clone ID: cC-zmle18900084c08a1
ttctcctccaccgtcgtttttccttcctccaccccgaccaggagcagctgcctggggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacccccatcatgatgagncgccgcgagctggagagcggc

SEQ ID NO: 22100 - DNA, 486 bp, Zea mays
  Clone ID: cC-zmle18900084c09a1
caagaatcaaatagtggggtgggggggattttaaattctgattatctcaataattcactacgtttcgaaaatattagactcaataaaaaactggggtctaattggcaaatcaatcaagacaggagaacacacttcagaacaataatagcttagtacagaacaccttgtaacagcatgtaccagattaaaaacgaaattacccacgattatttaaccacttcacatccttttacaagataacccaggctaaaccataccacaacataccagtacacgtcacgtaacaataaaggtagccgcaagcaaaagcagaagaacgcgtcacgtaacaatacaggtagccgtaagcaggaacagatttcttagatcttgtcgatgtcctcgtcctcgaactggatgtagtcgctgccctcctcgccttcctcgggcccatcgacgtcgacgcccttcttgagcctgagcgtgtcaggaagctccccgtaggcc

SEQ ID NO: 22101 - DNA, 560 bp, Zea mays
  Clone ID: cC-zmle18900084c10a1
gtaagctggatccttaagcggcgcctttttttttttaatcagttcatccaaggctgggatattaaggatagtacaaaacacatgcagattgacgatgtttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttctcgtcggcgaactccttggacagcggcggctggggcgtcaccttgaagttggggtcccttatccgcttcagcgtgtaggcctggaacacgttcaaggtggtgatgtaggggttgcgcacaccaacccctgcttaggaatgatc

SEQ ID NO: 22102 - DNA, 279 bp, Zea mays
  Clone ID: cC-zmle18900084c11a1
aaaaaaaaaataaaaaaaaaaaaaaaaaaagaaaaaataaaaaaaaaaaaaaaaaaaaaaaaaaaaaaaaaaaaaaaaaaaaaaaaaaaaaaagaaaaagaaaataagaaaaaaaaaaagaaaaaagaaagaaaaaagaaaaaaaaaagaaaaaaaatagaaaaaaaaaaaaagagaaaaaaaaaaaaagagaaaaaaaaaggaaaatagaaaaaaaaagaaaaaaaaaaaaaaaaaaatgaaaaaaaaaataaaaaaaaaagggaggggagaggagag

SEQ ID NO: 22103 - DNA, 428 bp, Zea mays
  Clone ID: cC-zmle18900084c12a1
cggggttggtttttttttaaaacagggaaaaaggctaattttttgtccaaaggatgggttaccccccctggccttttttaaagaaaaaattttcctttaccaaaaaaaccattgccattccttagcgacccttgctaccaaaaaaaaggcgacctttcccaatctaaaattggttttcaagccaccattcttttaccggatttggtttgagggggggctaaacaagggcaaaccaaagggttttgcaaaccctttgcccctgatagaacaaacctgttgataaaaaggctcttaaaacccccatcaaaaattactttccttgccaaaagaaggtggtcccataaaaaggtggaggacctcccccaggttgctgagggtaaccctcccccggggtaggggctggacccactgttggccctggggctccc

SEQ ID NO: 22104 - DNA, 469 bp, Zea mays
  Clone ID: cC-zmle18900084d01a1
ggagacaaaagggaatacgggtctggagttggctgtcaaaaaacaattttctgaaacccggagacagaaagaccgagatggttttgaagcaaagaatacaaagcttgtagagaaaatgtcatctactgatcttgctggaagtgagcgtggtgctgatacaacagataatgacaaacaaacaaggttttgtttttttagtatgcttggtcttctgcttattgggctcgggctgtatgatattcatttgttattatgcttacaccttgggccaaaattgggggtgcaaatgctctgcccaacatgctcctcggtgaactgtgaaaggagatagagtcatgccaaaggcctaaaactacaggtaatggatcagccattccacatacactcataatcggctaagggaattagcactatttaaaaaataaatcccaaccttaagaaccaaagggatttgaacattatacaaaac

SEQ ID NO: 22105 - DNA, 430 bp, Zea mays
  Clone ID: cC-zmle18900084d01d1
ggacgcgtggacggacgcatgggccgacacgtgggctgtctctcttttttggacagcggcacgcccaaggggattgggattgacttctacagcagagatatccacctcattttcggacagaagcaaatgcattactttccccaggaggacagcgaatgaaatactgagtttgagagctgaataaaccttggaggacatcataagtcattttggctatgttcagaattgttggaatatgtacttaacaaatgggtgcagcggcttaaaggtatagcactgagtgcaaggaatttggaagttcttcggttgcacaacggcaccaaatgatggccaagcaaccgcgtggacatttgcatgaacacaccggtgtctttaagttttgccagtgagcatttgcatggcataaaatggatggaatgaggcttcttct

SEQ ID NO: 22106 - DNA, 408 bp, Zea mays
  Clone ID: cC-zmle18900084d02a1
gagggttactaaaaaattttattcaggccaccaccttattggcgtaattcggacaggagctgagggcgggcacctaccaaagccaaggtccatgaccctgcacaacccggcaaccccagacattcataagggacccaggcaagccccaacgggcgtggatgccggcccccgggcggttcaattagccctggggaggaaactctccctgcgctcggggacctcgccggggcaggggttgatggcctttttgaccctgggctcgcgcaccacaaaaccggggccgccctggagaccatggggggggtgggggttggcccccgcccctgaaacccggtggacctcctagaactttttcttgaccacttgctggtggacccccccccccggggggccaaaaccggtcggggc

SEQ ID NO: 22107 - DNA, 508 bp, Zea mays
  Clone ID: cC-zmle18900084d02d1
acacaagcacttcgacgtcacacgggcgctgcgcacagactttcctttcgtcggcaccaatggcttactagcgggagggggactactgctcggaggaggtgacgtccctggccccggccggcttctgccgccacggcggcggcgtccagcagctcgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcatggagagcttcctcgccagggctaactgagccgcccggcggccggcatccacgcccgttcgtgcttgcctgcgtgccttatgtatgtctgtggttgactggttgtgcacggtcatcggactttgctatcgtacgtgcacgcactcagctcctgtccgaattacgacaataagctcgtgacctgaataaacctcctt

SEQ ID NO: 22108 - DNA, 246 bp, Zea mays
  unsure at all n locations
  Clone ID: cC-zmle18900084d03a1
ttttctatttttcttttttttttattntatatggnatccatggggttgaggcgatcaaatttgatctccttccatatttcacaagctgcggctagttcagcactccatttgcaagctgctttgataatttcattaccttcacgagcaagatcgcgcccttcgttacgagcttgtacacaggcttctaaagccacacgattagctgctgcaccaggtgcatttccccaaggatgtcctaaagttcct

SEQ ID NO: 22109 - DNA, 244 bp, Zea mays
  Clone ID: cC-zmle18900084d03d1
gaactttaggacatccttggggaaatgcacctggagcattttttttttttgaggctttagaagcctgtgggcaagcgcgtaactaaaggcgccatcttgctcctgaacgtaatgaaattatcaaagcagcttgcaaatggtatgctgaactatccgtagcttgtgaaatatggaaggagatcaaatttgatggcttcaaagcgatggataccatataaaataaaaaaaaaagcaaaatagaaaa

SEQ ID NO: 22110 - DNA, 363 bp, Zea mays
  Clone ID: cC-zmle18900084d04a1
aaaaaaaaaaggggacatgggtggtttacacatataggaggaatacttgacagattttgtcagcattacaccaccggcggcatatcatatatattacagacgcactttattcataagtttccttaatgactactacaagcgatcgaccccaccaaggccacaacttttacactggtttatgatacaataatactggtacatggttacaaaaaaatgcacaacccccgcagtttcatgtatatcacaagccggcagagcttatgcatatgaagctgcacatgcatgcttatgtatatgtgggtgttatatatggatgtatatataacttgaccgtacgtgtacatatatgatgtatatagttta

SEQ ID NO: 22111 - DNA, 582 bp, Zea mays
  Clone ID: cC-zmle18900084d06a1
tttattcattccatgcttataagcatatttcctttttcttaggcatgcccggaaaaagggcattgcaataaccttcttacaaaaaaaatcaatgatccactaatgacggtatggaaatacctaccatagcgacttctacattacttacacgcgtggaaaccgcgcaacatgcccagtaacagagtgttcttccatcatatacagcaactgcatgctgcgaagccgagcaggaaacagaaattacaaaacttacagcaacaacacggtcttgctgtgtaccataccatacgccgtgtgttctggcctgagtcgtcgtactggtacagactcggcacctcccttggccacgccggaagaaaatttatattcgattgcccctggataggatacccatgggtcgtcgtccggttcatccatgtttcagtgcttggcactgcctcgaacgaaaaacggtctgaaggtgaagacgaaaccgatgaacgtgaagatgttcagtatgaagaacaccaagtggtcgcctggaagaaatgcagctgtttgacgcctctgggcccacgaaaatatgatttctgcaacagctgg

SEQ ID NO: 22112 - DNA, 472 bp, Zea mays
  Clone ID: cC-zmle18900084d07a1
ttttatttgtataaaagaaaccaccaattcagataatggcatgggcaatccctagtacaacacaaaatgcaagattaaggcactgggaaacctcctgacaccgtactcgcaagtcaagcaacaaatttcaggcattcgctccatccaacagggactaatcgataacggttgacccatttttcacacccaacaggttgacccatttttcacttctaaccagaattcagttcagtcccaagaactcgtactctgaccaccaccatagccactgctgccgccgccgccataagcaccaccgtatcctgatgatccgccatatccttcaccaccaccaccacctcctccgtaggaaccaccactgcccctatctcgccggaaatcacggccacaaatctggcaccactaccttgtctggcgggttctaccaccttcacctccgtaggctgagcgggcagcgtacccgtcagccact

SEQ ID NO: 22113 - DNA, 486 bp, Zea mays
  Clone ID: cC-zmle18900084d08a1
aaacaactgggacacgtgtttgggtttgggttcatggatctgccccggtggcggaaataattgtgcatacacaattgacaaagtatttggcttttgtcaattaaacagatgtcagatacagattattctccgaactgttgatatttcaaagcaaaacaaacaagtcttggttccaattgtacaggaaacaaaagagcagtacttctgtgcttttgaacgaggttcgtcaacatccagaaaagtttgaggttgatcaataccctacttgccggaggattgttccacgagcttcttgtcgcggcgctccatggcgacgtcccacatatcgttcccgatgtgcttcggcctgccgtgcgcggccttgtggatgaaatactgggcgttgcccatgatgcagagcatgccgccgatgatccccagcggcaggacggcctcaagccagtgcagccgtgccatcgggtaagcccggacgcgggataggggggc

SEQ ID NO: 22114 - DNA, 192 bp, Zea mays
  Clone ID: cC-zmle18900084d09a1
ggacgtcatcatgaggggagggggatcagatatcacttgtgaaattcacaacggtaaacaagtagaaatcttagcacccaaccttttagagatcctagagcataacccaaaaatgctggagtactgtctcggctacacagccaatatagtggaccccagtatgcctgacaagcgaccgatcatgctttagtc

SEQ ID NO: 22115 - DNA, 474 bp, Zea mays
  Clone ID: cC-zmle18900084d10a1
gttccgcttcatatcaaaccggggccggtagatattatagatagataaataaaatagaaaaataaaccatgacaacatacacactacattcttcagctgagttcatcacatcttcgttcaagagaaaagcagacaacaaaaacacaaggccggccggcgacagccaccacactcttctggttcgttacgcctcagcaaatcccaattctgaaagcttcaggtgggcctcggcgtagtcagcaaagaaagcgtcctcgtccgctgcgtatttgtcaacaagtgggcggaaggatggatcaaagaggagggctttgtcacttggtagctgcagaaggccttccttctctccgctcagaagctccttgaagtaagagttgtcaaagatcaaagggttggacgtccaggctccctcaaatccagacctgtccttgtggcatcttcccagggtgtgaccaccagaaagcgcacccacgc

SEQ ID NO: 22116 - DNA, 310 bp, Zea mays
  Clone ID: cC-zmle18900084d11a1
aaggggtgaggaaaatttttgaaaacagaggtaatcctttacaatacagtttgaaacggacaaaaaaaattaattgcccagccagtattgaaaccattttttactctcctgtgcttgcaagtcgacctgataattggcggggctttattaatttgcttaagaaataaggtcatcctccttgtgcgtctcgatgacaacgtcggaggtggggtaccccacgcaggtgagcacccagccggcggctatctggccttttttaaggtagctttggttggactggtccacggagccggaaacaaccggaccttgg

SEQ ID NO: 22117 - DNA, 478 bp, Zea mays
  Clone ID: cC-zmle18900084d12a1
gactgctgaaccacgattgggacttgattccttgccatttacagccagaacacagaggtctaactcgtagcacgcttaatttgttccacgtaagaatcacaagaatctcgacgcagaacagtaaagatacggtggacaaccagtgtggtttcttattctaatggcggaaagcactcgtctgaattcccatggctggagatatacagtccctcagctgtcgcttctgcttggcttgtctgacgccgggtacaccgtgttagctgacgggatccactcgttggtagcagggtttcccctgcaagaagcatgtcgctcctctgcattgggatcttcagacagtttgaagggggcgcctttagctttgtccatcttgatgaaacccgttccggtcgtgtggtgctgctcgccgacgccgccgaggtccttgtagtactccgtcttcacgaactcatctcccacattggcgccctcgtacacc

SEQ ID NO: 22118 - DNA, 475 bp, Zea mays
  Clone ID: cC-zmle18900084e01a1
ttttacaatttcaaacaatatttctcaaaaccaggggattttgagagctagccaaaactacggtattgtcatgacaattacaaagtatagtattgtaaaaacatgattttgataaatattgttgccaaacataccctcaaccggatcataaaaaccaaactgcaatcttaccaccaggctcacaaataatcatacaaggcaggtgttttaaaggtcataccaaagtttgacaaacatagcacaattagatgacatccaactccatacgaaaactaccaagacagtatcccgcctcaacgcagcctcctagcctccctctcagactcgagcagtgtgaggatgtctccctcgcgaaccggtcccttgacgttcctcatgatgagacggttctggtcatccaagaacttcactctgacctgggtaacctgacccctggagccggtccttcccatcaccttcaccacaacagcaagct

SEQ ID NO: 22119 - DNA, 573 bp, Zea mays
  Clone ID: cC-zmle18900084e01d1
ccgtgcggcggtttccttcgtaagcccgtcgacctccgcccgtttcttttttcgagaagcgagagcatggacgcgcaagggaagcttgctgttgtggtgaaggtcatggccaggaccggctccaggggtcaggttacccatgtccaagtgaagttcttggatgaccagaaccgtcttatcatgaggaacgtcaagggaccggttcgcgagggagacatcctcacactgctcgagtctgagagggaggctaggaggctgcgttgaggcgggatactgtcttggtagccttcgtatggagttggatgtcatctaattgtgctatgtttgtcaaactttggtatgacctttgaaacacccgccttgtatgattatttgtgagcctggtggtaagattgcacatcgccttttatgatccggttgagggtatgtttggcaacaatctttatcaaaatcatgtttttacaatactattccttgaaattgtcagacaatcccccatcttggctaccttcaaaaatccttggcttgagaaatattgttggattggaaaaaaaaaaaaaggcggccctttaa

SEQ ID NO: 22120 - DNA, 266 bp, Zea mays
  Clone ID: cC-zmle18900084e02a1
aagaaaccaggaaaaaccccttttaagccttggtggggtacccttataccccccttaatacatatattatcgatttatagggggttgggataaaaaaaaaactaatttttattaaaaacaacccccccacatgggtgggggggggccaagagcccatgtcccccccaatttaaattttccagcatccccgagcacacaaaaccggtaggaaaacatactgggaacaaaaatggaaccggtcccacccctccggggacccggggggg

SEQ ID NO: 22121 - DNA, 405 bp, Zea mays
  unsure at all n locations
  Clone ID: cC-zmle18900084e02d1
gttccgccgnnaaatttanganntnttntcttctaaagttaaggcaaccacccgtccgggacgcgtgggaacggttgcagttttgatcacagtttgttttattagcggatttgtgtgctcgggggtgcggggagatttaaattggtgtgtacatgtgctcttgtgccaccacaatccatgtggtggggatgattttgatgaaaattagttattttcttatcctaacccactataaatcgataatatatgtattgaggtgggtatgagtgtatccaaacaaggcttgagatgtgtttctacttgcttcataaaaaaaaaaaatctaacaagtaaattaaatacacttataaatatgatgtttttcacaccttttatatatctgggcggccgcttttaaggatccaa

SEQ ID NO: 22122 - DNA, 463 bp, Zea mays
  Clone ID: cC-zmle18900084e03a1
ttttggctgtttgtgtctatatatgaacaagaagggatgaaggggacagttgccctacacagacagaatacatgaacaactacaaccaatttgatccatttgatcaatcacaaatttgatctccattttccctatccttaaacacattccctccctgtcaatcgctacattctctacacgcttatctctctctgcctaaacacctctttaggtgaaaatgtaaaaataaaaaaaaattgtacaacaaacatattacagtacaagttactaccaaccagacgttactgacgtcagtggtcaccagtagagcttcaccggtggcaccttgaagcccggcgcctcgtccaggaatggcaccgcctctggccgttcctggaggtcgcggtagaactggtactcggcctcgtagtcgtgcaggtcgagctccttttttggttggtgtggtaatggtgcttggcccccg

SEQ ID NO: 22123 - DNA, 513 bp, Zea mays
  Clone ID: cC-zmle18900084e03d1
ccgggcgggccccgggctgcgcctgccacccctacgggcgctttttccttttggccatgtacgactgccagcgggagcagggtctgtactcgctcatctgcaacgccacccctactccggagtccccgtttccgctcctcgttaacgaagcgcgcatctacgcgctgtgcgcgcgcatcgtcaagtactactcgatgcggcggttcgtggcggccacggggcagccggccaacaactggacccggaggcacgacgagaggtacttccactactcgtcaggcctgcaggcggtggtcatggcgctaggggcgtgccattaagagagcatgttccgtttcgggaaggcgccgggggccaatcaccattaccacaccaaccagaataaggagcttgacctgcacgactactacgccgaataccacttctacctcgaccttcaggaaccgtcaaaggccgtgccattccttaacaaggggcccggcttaaaggtgccaccggagaaactttactggt

SEQ ID NO: 22124 - DNA, 516 bp, Zea mays
  unsure at all n locations
  Clone ID: cC-zmle18900084e04a1
aataattacttaatctaacatgggccaaacgggcattatgacaatgttagccgatgatgacgacaatggaaacagtaatctaggtacaagcaggcgcctctgctggctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttgtgatcgccacggggccttgtgtagccgctccattgttggatgaagcacggtccattgtctcgaggagctccatcactcgtcatcatcttcatcctcctcactaccctcttcatcatcctcgtcattgacctccgacttggacttgtcagactcctcttcatcttcctcctcttcctccttggcaggagccttcttagctgcagtgctctcgccctttgtgtangcagcgatggccttgttgt

SEQ ID NO: 22125 - DNA, 411 bp, Zea mays
  Clone ID: cC-zmle18900084e05a1
ttttcttttttatccctttttttttttttgggcttttttggatttttttttttttcttaactccccctctcccctttttttttaaggtaaaaaccaaacaacatttacttatgaataacccttttgccgccccaccaaaaatttgggaaacaaaaacacaactggcccaaaaaaccattttaagcccaactcacgacacaaaccctacaaattcttttaaaaacacccccctcccttggcaaaggccaaaacccttaataccccaaatacaacagaacctttaaagacttaaggcttaaaaacccccccaaaaaccgaacccccgggggggggggccccccttctgaaaattaaaacctccaaaggggcccccaacctccacctggttgccggaaaaaaaaaaaccctttt

SEQ ID NO: 22126 - DNA, 342 bp, Zea mays
  Clone ID: cC-zmle18900084e06a1
ttttctttttttctttccccccttttttctttgggaaaaaagagggaattttaccaacagtaccccttcatttccctttaaactatacatacaggcgcagctgacacaacccaaggcatggttattatatacacacccttggctttgcttggctgctgttattctgtaaacaccctagctatcttctccagcttttcgggctttaaaaccaactccagcagacttcctctccgtatccctaaaacgcgcggccaacagttttttttttctttccgaattccgttccgttttcaggaacacttcacattccactccgcatgccggctatgacacctggggccc

SEQ ID NO: 22127 - DNA, 283 bp, Zea mays
  unsure at all n locations
  Clone ID: cC-zmle18900084e07a1
cccccccttttttttttttttctacagaatatatataggagggaanggtattattttggaccaattaatatatggttacagcagatgcaatcggatcaaccaacatgcaggtagacacccgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagat

SEQ ID NO: 22128 - DNA, 400 bp, Zea mays
  unsure at all n locations
  Clone ID: cC-zmle18900084e08a1
gaaccacaaacaaaaggggaagggagggactaaaagagcacagagtatacacccctttaatgaaaaaaacatttacaagaacccccaatattttgtatactgaacaagaatgctgccttccggcgccaaaataacctcaggtacatattctgcagaatgcacaatggaaaaggaagcatttaagtaaaccaaacacaaaactccgtgccgaacaggttttgggaggacggggccatgaaaaaacacattatgctcccccctttcaatgccgaacccancaaatggcatggggaaaaaacaaccataaacacaccttcggaagcactgtaataacatccgggcacaatggcttgccagggagaaatcttgcacacacactttacgtgctgcggggaaaacc

SEQ ID NO: 22129 - DNA, 314 bp, Zea mays
  Clone ID: cC-zmle18900084e12a1
ctaccccaccttttttttttttaaaaaaagaccggacaccaggggacaggttcatttttaccgatcacacaagcacctacaaactattcttcttctcaaggaacaaaaacgaacccacaaaggaaaaccacactccttaggtgtctcttgctaaatttaacaaacctccaacactttggaggaagtttgaatgggaatcaaaactccacgcacaaatgaacaaaaccaggaaatatcagacaaaacccagcaacactaccaaattatccaaaagggatacaaaatacaacatctaaaaaaaataacacaggggg

SEQ ID NO: 22130 - DNA, 374 bp, Zea mays
  Clone ID: cC-zmle18900084f01a1
ccggaaaaccaggccctttttgttcccaaacaactacattactcaaaaattttaatggggccctgaaaaccaaaaccgcatttgggtctaaaaaaactttaaacattggaaaaaaaggaaccgatccaactgccaaaaaaaaaaaagtttccagcgcaaagggcaccaaaatacaagctccgttaaacggggggccttggaaacaccccaaatttcgcccttttttttgagggccaaactgttgaataaacccttgggagcgtttatcaactaatttgcaaggccctcggcaatggttttgatgttccgaaaagcactttccctgccaccaggggggaggaggaaaatggcctgttttatcctcctcagggggg

SEQ ID NO: 22131 - DNA, 549 bp, Zea mays
  unsure at all n locations
  Clone ID: cC-zmle18900084f01d1
gtccggctttcagccgccgccgcgtccgcctcgccaagcgttttattttccgcagcacatctctctctcgaggggaggcgtggcttaggtggagcagcaacaggacactccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtattggtttcgctggtgttgtgaggaggcaagccgtggatatctcacccctgaggagggtgaaccangccatctaccttcttaccactggtgccagggagagtgc

SEQ ID NO: 22132 - DNA, 376 bp, Zea mays
  Clone ID: cC-zmle18900084f04a1
gggggggaagacttaacttaatactgacctaaaaaccatttaatcatggggatcccttattttgagcgctcacctgacaccacatttataattagcttgcatcgaaactggggggacccacattcacttttttataacagaaaaaaccacttgcccatcggggaccgggaccaaacatttaaaggcgccatgccaaggttcttggtggctcaattggcttccaatcttgatcggaacttaataacgactgcgtcgatgaactcctcggtggtcaaggaatggctttttgtgacccttgaaaaaccaaggacaaaaattgccaaaactttagttatctttccggacttcacggtctcaacccaagcagcctttaatt

SEQ ID NO: 22133 - DNA, 387 bp, Zea mays
  Clone ID: cC-zmle18900084f05a1
atacgggattgcgggtatgtaggagtacagccatggttacattacatggcgaggagcggacatcttcttcctcctcgtcaactagaagaaaaacgaacgctggccgaccgcccgaactgggtgctgatttatatctacaatacaggggcacccagaggccagagcagagcagcagcaacgaacaagagacccgtgctagtagtagcttacatcttacaggctacagcacaaacacaaaacctaataaccttgctgacaaaaccccgtaaacaaaaaatcacttttcactccctttgaccggctgctgtgtggtgtggtatcggcgaacatcaacctatagtacgactggagtactcttctttacttcactcatacgactggatcgcc

SEQ ID NO: 22134 - DNA, 447 bp, Zea mays
  Clone ID: cC-zmle18900084f06a1
ttttgcctttttttatattattataattgtaacagggcgatagggcagaacgatttttattcaattcggtaattactgaaatcaacgatgacgggtaaaactcgcaaaactgtcatgcccatacccaatacagctacaactgtggcattggagagcaaactaccatgctataacatatatattattagtattaagactcctccgttagtttagaccagcaacggtgtcgactttccctcacactctgaaacgagttaagcacatgagctcctgccaagtaggtgcggagaaaggattggcaggaagcccatagggcagaagacgatgggaaaacggcccccagacctgtttcggtcacttggagctgtggccggcctctgcgcgttcatgcaatctacatgcgaggagtctgctcccttaggagtctcatcactcgggaagattaag

SEQ ID NO: 22135 - DNA, 522 bp, Zea mays
  Clone ID: cC-zmle18900084f07a1
tttttttttttatatttttttaattttttttgggaaaggtaattttttataattttttttatttcaattcctttttttttatttaaattttttaaaaaaaaaaaaaaaaaaaattcaaaaaaaaatgaaggggggaaaaccgggtgaaaaaaaaaaaaaaaaccaaataaaaaaataacccgggttaaaggggcataaaaaaaaaaaaaaaaacacccacggggaaaaaaaatcctaaaaaaaaaaccctaaaaaggcgaaaagttggcacaaaaaaaaaaattaaacaaaacccaacccggggggcaaaccgaaaaaatcaaaaccaaaccctagggaaacacaatttttaaaaaaaaaaaacacaaaaaaaccgggataaaaaaaagaaaaaattatacccggaaaaaaaattttatatttaataaatcaaaaaaaaaaaaaaaccgaaataaaaaaaagaaaaaaaaggggggcccaaaagagaaccaaccacaataaatgggtggaaaaacccccact

SEQ ID NO: 22136 - DNA, 528 bp, Zea mays
  Clone ID: cC-zmle18900084f08a1
ctttttttttttatttttttttatattatttggggtttgggtttttttttatttttttttttttactatcaatataaaaaaaaaaaaattcaaatataaataaataataaacaaaaaaataaaataaaatttaataaaaaaacatcaacaaaaaaaaaaaaaaaaaaaaataaaaaaaaaacctaaaaaaaaaaaaaacaaaaaatcaaactaaaaaacaaatacaaaaaacccaaaaaaaaaaaaaaaaccttaaacaataaaaaaaaaaaaaaaaaattttctctaatttcccccaagaaagaggatgccgaaaaattaaatacaaatcctctaataaaaaaaaaaaatcaataaaaataaaaataaataataaaaattataaaaaaaaaaataaaaaaatcttccataaaaaaaaaataattttactcaaatatacaaaaaaaaaaaaaacaaattaaaaaaaaaaaataaccttgacaacaaaaaataaaaaaaaaaaatataatttgttaaacaattactatt

SEQ ID NO: 22137 - DNA, 294 bp, Zea mays
  Clone ID: cC-zmle18900084f09a1
ttttgtttaacgtcctttttcacattaaaggggaagaggaaccaagttggatattatgctagagttaaacatctacctatactgaatcaggaatgctaagagatccgggctaatcatctataacatttaagctacttttactacgctacataggaaacaccattcaaacagttctgacatttgcatattcctgctactccagcgctcaattttgtgtaggcaggaaatcccattagaggcatcaacagttttcaggcaccattttatggcatgtcaacttttttgccataatga

SEQ ID NO: 22138 - DNA, 283 bp, Zea mays
  Clone ID: cC-zmle18900084f10a1
tttttctttttttttaatatttttaaaggggagggtttttttttttttttaaaacgcaaccaaccaaacttcctcccacacaaccccccacccatacaataacacctggtttcacccagaaaatccagaccgataccagcaggcaaacaaaaattccctaaaaagaatcggaataaaaccggaaaaaataaagaaaaaaactctaacctgtggaaaaaagtaaatccattaaaaacccaaaaaacaaaaaaaccgaaaaaaaaaaattaaaaacctggggccc

SEQ ID NO: 22139 - DNA, 412 bp, Zea mays
  Clone ID: cC-zmle18900084f11a1
catgctattactagggcaggtttcataaaaaacaccatgcaaaattttcttaagaacaaattataagagcgcttggagaaacaagcataaactttcagcatcagtgggttactagctcgacctggttagaatccaattgggcatgctggctcaggccatggcaagcagggcattctcgccaagtttggtctgtcttgtggcgaagtctgacaacttaaatgggctgcgaggagcagtggggaacagaataacatggaacagaacggaggacaagaacaaattaagaccaggtacagctacatactaagtaagctagtcatcgtcagacattccaggaagaccttatgtccatttcacacattagcactccgtggccttattgagaaagagcataaatgcttcatggagattt

SEQ ID NO: 22140 - DNA, 329 bp, Zea mays
  Clone ID: cC-zmle18900084f12a1
ggggtgggtttttaatccaactaaaacgcacccttaatgggcacgaactaattagctttcaaaaacttagcatattttaggcgcaatttgaagcagccgtcatttcagaaatcagaatgagaagggtttttccccctctcgataatgtacacgcatgggcatggcacgttttttaatttaaacccttacacacagttttttccccggtaaaatcaaggacgggagcagcgcatgacttggcattgctgccggattggggcgcgtcctcacagggggggcgttctcttggtggcgccggaaatgaccgtgagcaggttgcggacccttgg

SEQ ID NO: 22141 - DNA, 379 bp, Zea mays
  Clone ID: cC-zmle18900084g01a1
caaccccaagcaaaatgggggaaaaaaaaattgccaaaaaaatacccatttccaaaaaaaaaccttacttttttaaccaaaagctaaaaaaaaggcgttcactccaaaaaaatccaagggtgcaaacaacatttgttttttgaaccaggcccttttgactttttaaaaacaaccctaagtttttataggtttgccttattgaaccaccaccccctttaaagggaagggtggcccatgggggggctttttgggaaaccccaaaccccgtgcttaaacttgaaaaaattcaaaacttttggacccacacccctggtcttggaaactttcaagggggagccaaacccaccacggggccctggtaccttaataaaaatggctt

SEQ ID NO: 22142 - DNA, 455 bp, Zea mays
  Clone ID: cC-zmle18900084g02a1
ggcaatgcagtatggggtcttaggggagggtaggaaaaatgtaatattaagcagtggtctctcttttttacaacatccaataatctgcagaaagagaacatgggattatgtatacttttctctcgattattaacagaagggtgcactatttcctcagaaaagaagcaaagaattcttgttgggcaacaatatgagagaggaaacgttatcccatgggttgtcaaactcaatatgtcacaataaatgaaggttctgattgaaggtaccactcaattttgaactgctgatagaaagttaggtaccatgatctcgagtagccctttcggattgtccacatgaacccagtggccagagttagggagaacgtgaagtgacactcttcctacatcaggcttggactctctcccggctaatgcttttagcctttgaacgtcattagggacccatcgatcact

SEQ ID NO: 22143 - DNA, 379 bp, Zea mays
  Clone ID: cC-zmle18900084g02d1
ccgggcggggacgcgtgggcggacacgtgggcggacacaatttttgactcgagagcggacaaggcacccgcgaggggaggggccaagaaggacgagaagcgggccacaaccaaccaccgaaagcgccaacaaacaaaaaacaaggggagagcaacagagaccgaggcgaaaacaccacgccacaccagaccacacggacgccccccaccagaccgaaacccacgccgacgacgagagccaaccgacgccggagaagccggcaaccgccacggccagcgaacagcacggccaccacggaaccggacgcaacaggcgcaccaacacacacacccacaaaaacgaacgccgaaaccgcacccccacaaacgagaggaggaag

SEQ ID NO: 22144 - DNA, 396 bp, Zea mays
  Clone ID: cC-zmle18900084g03d1
aaaaaaaaccaaaaaaaaaaaaaaaaaaaaaaaaaaaaaaagaatataaaaagagaaaaaaaaaaaaaagaagaaaaaaaaaaaaaaaaaaaaaaaaaaaaaaaaaaaaaaaaaaaaaaataagaaaaaaaaataagaaaaaaaaaaaaaaaaaaaaaaataaaaaaaaaaaaaaaaaaaaaaaaaaaagaaaaaaaaaaaaaaaaataaaaaaaaaaaaaaggaaaaaaaaaggggggaaaagagataaaaaaaaaaaaataaaaaaaaaaaaatataataaaaaataggaaataaaaaagaaaataaaataaaaaaaataaataaaaaaaagagaaattagataaaatgaaattaaaaaaaaaaaaaaataataaaaatgaatagaaaaatgaa

SEQ ID NO: 22145 - DNA, 418 bp, Zea mays
  Clone ID: cC-zmle18900084g04a1
actggaaaccatacatagggtcccagggcataaccacaacaaagaactgtagccattggatgttacagagcttttttatttgctggcagctatttccaaactactcacgatgaatctctccgattgtgtgcataacagaatgcagcgaaaattataccagctacatttgcagaaaacaaaaggctcctcaccagtgtctgaacagacgagataatgcatcatgtgacaaaaagcaagtatttggtccaaggagaggctccagcgtttacaactgagatgcagcggttggcggtcagtatcagttaactagtttcccatgccaaactccgctatgtctttattgatttgctacccacagaagttgagcttctttataacctgtgcgtaggccaaatgcaccaaagcaggcttccgaagt

SEQ ID NO: 22146 - DNA, 377 bp, Zea mays
  Clone ID: cC-zmle18900084g05a1
tttagaatttccaagaagttttattcaggtcacgggcttatgggcgtaattcgtacaggagctgagtgcgtgcacgtacgatggccaagtacgatgaccctgcacaaccagtcaaccacagacatacataaggcacgcaggcaagcacgaacgggcgtggatgccggacgccgggcggttcacttagccctggcgaggaagctttacctgcgctcgtggacctcgacggtgcaggtgatgatgtcctcttcgaccctggtctcgcgcaccacgaaaccgtggtcgacgtggtgaccatggtggtggtcgtggttggggccggcgcgtgagaccgggtctacctgctctaacttttacttgacgacgtgctgctggac

SEQ ID NO: 22147 - DNA, 476 bp, Zea mays
  Clone ID: cC-zmle18900084g06a1
tttttctaattaacatttgatttccagcagttacgtaatttacggacacactcacacaatgagacctgctttcatccatcacaattcacaggctccctcgctcccacctacgtgtatcggtttcgcttcccatatacaaaagagtatcaacagcggcatcactccatcactcttgagaacgacgagtgattgttccgctgaaataaatggaagccggtgccttctcttcaatcaaaagcatcaactttagcactcgtatatacatgaacacagcaactatagttcgctgtgcatatggtttcccggttgggagtctatcagcgatcacgttaagagaaacaaaacaaagaatggccttatggttttcctggtggctcttgatgttttgcgctgctccggaacagcagtcgctcccttatctccttgaaggactggagctcctcaagggcgttagatgtcctgcgggacgtgaccga

SEQ ID NO: 22148 - DNA, 489 bp, Zea mays
  Clone ID: cC-zmle18900084g07a1
ttttgtttcaaagcaagccaataatgattcgggcatggggtaggagaaaggagatgacatctcatacatagttgattcagagtacagacataagacatggatcagatattcataatgcagcagcctatgaccaggcccttctcttgagtcagtcacccccacttcctcgcgcaagcaggctgacaaatgttggaacactagccacacagtggctggctgtctaacgcaaacaccactcgagagtcgagaagaccgcgatgcatcgcaccctgcctcttttatttggggatcgccgcagccagcagaattattattagggtaccagctagtagtttctttcgttcgttcaccaagggaggatctttcagcgctggttgtcgccctcgcaccacttccagagcacgatctcggtaccgtcatggacgccgccgtgagccttgtcgccgtggaaggcgtccaaattgaggtaaatgttgttgaccatgcgga

SEQ ID NO: 22149 - DNA, 309 bp, Zea mays
  Clone ID: cC-zmle18900084g08a1
ccgaagctgatcctctaagcggcccccttccttcttttttttttacccccccaacttccactaggggatgggtttttttttttttttaccaagcccaaaccaatttccggtcaaaaaaaaaacaaaacccgcttgttgaaacaagcaaaagcctggccctgctaaaaaaatgacccaagcaacccttaaggaaccctaaaaacacccatgcctcttatctttctcaaaaaaaaaaaacgggggaggggggcgcaacaacaaggatcctgaaccaccccattttattggaacccaaggcctcccaactcc

SEQ ID NO: 22150 - DNA, 485 bp, Zea mays
  Clone ID: cC-zmle18900084g09a1
gttcaatcaatccagatatacatgggcagggtagcgctcatgtacaaatgcatgtaaaagaataatagttcatgatcctacaaattgaccatcgacctcatctcatctcatggatcctggaacctcaaagactagtactatgcgtcatgcccacgtcacgtcttgaagaaaccatgctcggttcatcaagtatgggtccaccgtctgcccagctctgttcctctccaccacctgccaaatgcttcacctctacaagaagtaggtcagctgctgtttcttcctggaccccccttcgccgtacaggtcgttccactgcctgagctcgttcatcacggcaccctcggcggcgaagctcgctgcaacctggttctttgcctgcctcaggtcttccatcgtcagtggcctaaagtcaacaacggccgcttccttctcgccctccgccttgctgtctggaccctcgttgcctttgccgccgccttttggac

SEQ ID NO: 22151 - DNA, 442 bp, Zea mays
  unsure at all n locations
  Clone ID: cC-zmle18900084g10a1
gggtatgggaaaaacacgtaagtacgtgcgcctgacctttattttattccatcttgaggggaaaggggtaccttaacaaaacatgcaaaacaacaacagcagcttgcttattagcgcctgcttgtaacaaaactaggcggacggacggaggaaaacatgcatttggaaaaaggatccatcggctgctggggccatgggggaattggatgaatttaggggatcttgcacccccattttttggggaggaaatttcggcacctgtacttgggggggcccttgcccgtggacacggggactcattttttgcaggggggggcgcacttggtgaggagggcgttttaggtccacacgcccgaccaggtgggggacttgccggaccaacactgtttntttggccctggagggcctttggccaccaccccaaagagcaaaagggcctgga

SEQ ID NO: 22152 - DNA, 454 bp, Zea mays
  Clone ID: cC-zmle18900084g11a1
ctacatactttttttttttttcacacatagggcggaatcggggggggaggtaccatttgcaaaacaactcccgcacacaaaaacaacaatactaaatggccatgacaacccacaaggctgcccacgcaagaacaatgagcgatgccaccctcatcgttcctgtacaccacacaagcatgtacctactcacagcaaacaactgggggacccagtagcacggatgctgatccaccaacgttataccggaactcgaggctggcgaacacctgcttggctaaggcctcacgacagttcgtcaaacatgggtatggaacgggccaacgccaaaaacgaacccctgcatgaagtcacacaagatggcaagcatggccagcctgccgtaattcagctccgtgaactggagcacatacatcacattcatggccttgcccaaaccgaccggtttgaagaaggg

SEQ ID NO: 22153 - DNA, 554 bp, Zea mays
  Clone ID: cC-zmle18900084g12a1
aaacttgcatcctctaaaacgaccgcccttcctttcctttttttttttttatatcccatcaaatcttcgggtttggttaatttttattttaatatcccccccacacccttaataatttaataaataactaaaattacacaaaacctggcgccccccccaatatacaaaaaaaaaacaatttccttccaaaaaaacaaaaaaacacgtcaaaaaaaaaaaaaaaaaaaaaatccccccaaaaatcccttcacaaaccaaaaaaaaaaaaaaaaaaattccccaatctaaaaaaaacctcaacaccaaaagttattaactaccaccaaaacaacttgaaaaaaaattcaaaaccaaaaaaaaaaacccaagtatttcttttcaactcccccacaaaaaaaaaaacctcccccaaaaaaaacacccctaaaaaaaaaaaaagaaaaaaacccccaataaattccaccccaaaaaaaaaccccctattccaaaaaaaaaaaaaaaaaaattacacattattttccccccaaaaacacaaaaaaaaaacttcaaccccc

SEQ ID NO: 22154 - DNA, 458 bp, Zea mays
  Clone ID: cC-zmle18900084h01a1
ctcccccccccttttcccctttttcccccccccccccccccccccggggccctgtgtttttttttctcccccttctccccccaacaccaccccaaaaattacccaacaccctggaccaaaccccaaaccccccaaaaaaaaaaagccccaaacacggcccaaaacaaaacaaaacccccctaacctgaaaccaaaaaccaaaaaaacggccccaaaaaaaacaaacattccggggaaaaaaaacccaaaaaaaacctcaaaaaaaaaaaacccctgcccctcttccccaaaaacctctcaaagaaaaacccaaccccaaaccccccaaggagggacccataaacacccccacacctcccaaggcggaaaaaaaaccaacccaaaaacccaacaccgccaaaaaccccctcaatgggggaaccaagggaccccccccccaaaaccaaaaaaacatcccc

SEQ ID NO: 22155 - DNA, 378 bp, Zea mays
  unsure at all n locations
  Clone ID: cC-zmle18900084h01d1
gtgcgcccacgcgtccgaccacacgtacgaccacgcgtacgtcncatttttacacccacgacgtcaacacacacgggggccnggggaaaaaataaaacaataaataaataaacaaataaatagaaaaataatgaaagaaataataaaacctatgaaaactggaaacatattatatggggaagtgaaactgatacccgcaagacccgtattttaaaaaaggactacaatgcatcaaacaatgaactagtaaggacacaaacccttgtgaagaaagccattgtgcaagataatgctgtcccatttaaacattggtactctcacttactatagacttgacattggtaagaacaagaaaacccctggtggaaagaaggataa

SEQ ID NO: 22156 - DNA, 350 bp, Zea mays
  Clone ID: cC-zmle18900084h02a1
aaaaaaaaaaaaaacccttttttatttattcccccgggcccgggggttccccccaaaaatccccccccctcccccgaaggcacccactttttcctaaaagaaggcccaaaaaaacctggcaaaaaaaaggaaaaaaccttttcctgggaaaaaaatatttcccttaaaaaatccccaaaaaaaaaaaaccggaaaaaaaaaaataaaaacccggggcccccaaaggggggggaaaccaaaaaaaaatgcggggggcccaccgccccccttccaaaaaaaaaaaacctggggcccaattttataaaaaaaaacccccacccccgcgaaaaagctctcttcattattccccc

SEQ ID NO: 22157 - DNA, 563 bp, Zea mays
  Clone ID: cC-zmle18900084h03a1
cccccccccccctttcccccttttccccccccccccccccccccctgggaaaatggggtccctttcatcccctcctctccccccccctacccccctccctcccctcccctcccccctcccccttaaaaacaccccgaaaaaaaaaaacaggggggcccaaaaaattccaaaaaaaaaaaaaaaacaaacccaaccccacaaaaaaaaaaaaaaccccccccaaaaaaaacccccccccttaaaaaaaaaccgggccaaaaaaaccccccccccccctcaaaaaaaagggggcccccaaaccaaaaaaaaaaaaccccccccccctgctcttttttcccccctggggggccccaccccccccaaaccccctgggaaaaacccagacccccccccaggcccaccccccgtccccacaccaaaataacccacccccccccgagggccccacaactttccccaaaaaaaaaaaaaaaaaaccgggcaaaaaaaagaaaaaaccctccccctgaaaaaaatgtaaccccaacaaacccaaaaaaaaaaacccgaaaaaaaaaagtaaa

SEQ ID NO: 22158 - DNA, 277 bp, Zea mays
  Clone ID: cC-zmle18900084h03d1
cccgggcggccacgcgtccgcccacgcgtccgcccacgcgtcctttgacttttttggcaagaaagaaggaaaaaaggggagggagtgtaaatgttttttttttaagatctgtacaacaacatgattgagaagggagggaaggtgattctgagcacaacttcgttggaaaggctgtctttaatttctggtggacgtaatatattatatgtatgtatatgcttagattcgctaatatatatgcatatatatgcacccacatgaatatgatttacagaga

SEQ ID NO: 22159 - DNA, 177 bp, Zea mays
  Clone ID: cC-zmle18900084h04a1
ccgcagccggctttgccagtttgagttccagcgacggggccgccaggggcagggagcacgacgacgccgacgccgacgacgactcgtacaccacggcgctcccgctcccgctcgccgctggagcctccgccaacgcctccgcttccgccgtcagctccggggcggggtagttggtgg

SEQ ID NO: 22160 - DNA, 402 bp, Zea mays
  Clone ID: cC-zmle18900084h05a1
gggggggggggccatcactgcaaagggcttttatcataaagagagttcatggccgccctggcacagtaacttcatacactcagttcgtacagcatacaaaatcagtcctggttgtctcatcgtcaactcatgagcaaccaccacatacggcagaaaacaactcaatgctcaaagcaggcggccaaaacccaggtattcttatacctccaggggtacaaatcaaatcagggcgagcaagcagactcacatcttccatcggtgcttaacagtatacatctccctaggattagaaagcagtacaggcaaaaatagcaagggcttattccaggacatttctcagctactagtagcttattacagtacgtagcagctagccatctagatccatacaataaccgcata

SEQ ID NO: 22161 - DNA, 539 bp, Zea mays
  Clone ID: cC-zmle18900084h06a1
ggtcgtcgagggtgccgtcttttctcggccagcgcgacggagcggagcctgcggggcgcggtgacgccggcgtcgatgtgcgcgggcaggcgccgctcgggcgcgagcggcagctcgacggcgaccaccacggcggggacggcgcacgcgaggcgcgcgtagaagtggtggtacatgagccaggacgggtgggagatgcagaagcccccgccgtggagctgcaggatgacgggcaggcgcgcgccgccggcctccacgttcgcctcggggaggtacacgcgtaggttcggctccccgggcaggtcgtggagcgtgtgcccgtctcgcggcaccgcgtacggcgccaccggctccatcagcgggagggcctcgcgcgggccggtccacgtgcggtccacgctgccgtcctccagcacgcgcagccagccggaaacctcgtccaccacctttcggccaaccgccgctaccacctgcggctgtggctgctgctggacattgggccgtgccatcggtgttgctgcggagactgtgatgtgcac

SEQ ID NO: 22162 - DNA, 510 bp, Zea mays
  Clone ID: cC-zmle18900084h08a1
cacgcgccgtaagctgatccttaagcggccgccgtttttgtttcttttctagctggacataaatcgggtgggggtatacatacagtcacaacgtcgcatagtgggcgcgatgcagccttgactggagcacattgatgccaccgaagcgcctgtaaagtccccgtgtaggaaactgccccttaggcccgggtcagccatctttgggagcttgcgcctgtcattgaaaaggggccgtgcccatgacacaaggttttgctctgacgctggtctggtgctgtcaatggccttccggccagtaatcagctcaagcaagacaactccaaagctgtaaacatctgacttaacagtaagttgtcctgtcatagcatattctggagcacaataaccatatgttcccataacacgcgttgagacatgagacttgtcaccaacaggacccaacttagcaagaccgaagtctgatagctttggatgggagcccctcgcccaacaaaatatttgatgacttga

SEQ ID NO: 22163 - DNA, 426 bp, Zea mays
  Clone ID: cC-zmle18900084h09a1
aaagggggggaagggaacctaaattgcacaaaacatagacagtgctgttctgaagcatggaacaattcataaacaacccgaccatggctacaaaacttggtacaatacggttacaaacaaaaatatcacagtttgatgattttgagaaatgggacttctttgaaccccagcaccttaccccttgagcttgccaaaaaacctctgcttttcatcggtaggatggaaacgaccgtgcccaaatttggacaatctgtcgattaacttgaccttgatctccttcagcgccaaccgggaagtctgcttcaggaaggactggctgagggtaaccaccctcttccttggacccaaacaaaaacccttgatcatcaggtactcacccttcacaataccataatgggggaagccacccatgggaatgattgcctt

SEQ ID NO: 22164 - DNA, 379 bp, Zea mays
  Clone ID: cC-zmle18900084h10a1
aaattaaaaccggacaagggtttattatttaaaacgggaacactcataaatgtgcacaatgattacggccatcattatcatcctaaaaccagcatcaacaaatgccattaataccataccaggttacaagctgagtcttcaccgacaaacgcaccacccactcatttcattccgagcaaaccaaccaccggacttagccccacatacacaaacaatccacggaggaaaattaaaacagagcctaacatcagatataacaagagtctgacaaaccgccccaatcatggggccaacacttccatcgccgccacattcattaatcgctgatagcaagcgacccctaccttgaccgtgacccaagaggtgacatggaccctgg

SEQ ID NO: 22165 - DNA, 387 bp, Zea mays
  Clone ID: cC-zmle18900084h11a1
aaaggggggcaggggtttatcatttggaaacaaaacccaccactattgcccaaacatggttcatcttaatgttcaacgccaacttattatttcgactggcctatgcaatgcaacgggaaacaaaaaacacacatgcctttcgaagcatcaatcaatccacgtacgtacaccctatccgatcccaaagacaatgaagtttcctaacataatccttgagcttaattgccggggacgaacttggtggcatatgcccatactttgactaagactgggacaacgatgtcgacaagtacgttctcgagccggtcctttccggttactatggcccgaaccaatactccgaccatggaaaacatgggaaagcggcccttcttgagctccttcacc

SEQ ID NO: 22166 - DNA, 495 bp, Zea mays
  Clone ID: cC-zmle18900084h12a1
ctcccccccctttttctttttcccccccccccccccaaattcgggctggggtttattttatataaacaacatcccccacccctgcacaaacacttccttatactaatcaacaaccccaacaccatcacccccccaaaaaaaaaaaaaaaaactcaaaacaaaaaacacacaaacaaaaaaaaaccccaaacaatcctcttacaaaaaacaaaaaaaaaccccccccccccaaaaaaaaaaacacaaccagaaaaaaaaaataaaaaaaaccacgcgcctggcaaaaaacaataaaaaaacatttcccgccccttgggtgtccaaaaagaaaaaaaaaatccttttcttggccggggcctttttcccccccaaaaatacaaacaaccccccccaaatacatcttcggaaaaaaacaacctccacccccaacaacctaaaaaacaaaagccccccccccttcccaaaaaaaaaaaattttccgccacccaacacccc

SEQ ID NO: 22167 - DNA, 281 bp, Zea mays
  Clone ID: cC-zmle18900085a07d1
atacttggtaccatatcgctcttgcaatcaaaaaataattcgaggttttttaggctggaggcattcaggttatccttttgggcgatgctgcgctgatatacccgctttctctccacaaagtttatcattcattctacttggactgggctgttcactccttcataattaccaactgcgacatccaggacaccacccacaatccacacccacatgtgctactccaactttaactacatcatccactccatcatctacattggacgcggacgtgatcaccattg

SEQ ID NO: 22168 - DNA, 294 bp, Zea mays
  Clone ID: cC-zmle18900085b12d1
ggacggacgcacaacacgctgaccaaggacctttatcactcgaattatgcaaacaaccgcctgaaggagaccattggggagcacaagtccatcaccccccgccttggcgaaaccgcttataatactaaccaactatcatacccgttcgtactacccacacaaagacatgactgaaccgacatgtccttcccaccaagtcggacctatgccaagaaccgaatgcttccccattatgactgaaccgcccactgcacatgaacacttcccggtggaaaccacaaatcccatctaaca

SEQ ID NO: 22169 - DNA, 52 bp, Zea mays
  Clone ID: cC-zmle18900085c11d1
aaactaatagctaactcccccaatacaccaacatatatatattcttacaatc

SEQ ID NO: 22170 - DNA, 99 bp, Zea mays
  Clone ID: cC-zmle18900085c12d1
gagtgatgtgttctatgcggatgacatctatacttcaaagcttttgtgcacgaaaactttgaggtgcctgttatggatcactttgctgattgtccctct

SEQ ID NO: 22171 - DNA, 615 bp, Zea mays
  Clone ID: cC-zmle18900085d11d1
aaaaaaccaaaaaaaaaaaaaaaaaaaaaaaaaaaaaaaaaaatataaaaaaaaatttttaaaaaaaaaaaaaaaagaagaacaaaatggggggcccttttaaagaacccacccttacatccccctcctttctattttaaaactcttctataggggaccctaaattcaatccactggccactcgtttaacaccctcttcactggaaaacccctgtttttacccaccttaatccctttgaaaaaaaaccccctttctccatctgtcttataaacaaaaaggccctcccctatcgccctttcaaacattttcgcaacctgaattgtaaatggtaccccccttttaacgctcttaaagcccggggggtggggggtttacccccacaataacccttccccttgccaactccctatccccccctccttttcctttcttccctccctttttctcccactttttctggtttctcccgttaatcttatattgggggccccctttaggtcccccttatagcctatacggcacctttcccccaaaaaacctcttatggggatttttacacttttggcccctctccccttaacacctttttcccccctttcccttggaaccccctc

SEQ ID NO: 22172 - DNA, 400 bp, Zea mays
  Clone ID: cC-zmle18900085e11d1
aggtattgtttgatacgtacaggaactctctattttggaagcattttttccacaatggagtgaggggcgacgcaatgagcaatattgtggcaaagtgaaactctgtggaactaccgtttttttaagtggattttgtgcaactatttgtgtgtcgttttccggttgataccattgagaaaatacgaataagttacaggatcagtcatagtgcatgtaattgtcgccacatttggcgttaccttgttattgtaattgtaacatttgtaccatttgttgtatcattataactgtgagatacaatacaaatattatacggtctcggcattataaatataattacatttttatttgtttaatttttatattttttttaattaataaattttaatttttttttttt

SEQ ID NO: 22173 - DNA, 547 bp, Zea mays
  Clone ID: cC-zmle18900085e12d1
ccgctccaaagttcttagctgatcagtttctacttttttctccgtagttttgttgcaactgttgatgggtggcacattctgggtcttcaattattggaagaaacatttttgcgccaattacatgtaagtggttgcagttttaagggtctgttcaatccctctccaagatattgtaggtgtatgaaatcttctaagcaaactgttaaatacattgcacccgatcaggtatataagcaaagactgtattctctcattactagacaaaaaaaatgaaaggaagcagttgtaacatatttttgtatgatgcagaagggatgctctataatgcagcctggtaaacctccctcctaggcccagctgtcctctgctttcagtgtgaaactactgatttgggtgttgctgattttcatcatgatcctttcagcttgcgtcatcatttatcatgtaatttgctaaaccctttgggcacaatgttcatcatttatcatgcatatgctattttctcttgaattggcttagggtgcgatcttcgtactacgtgctccag

SEQ ID NO: 22174 - DNA, 612 bp, Zea mays
  unsure at all n locations
  Clone ID: cC-zmle18900085f11d1
gggcctctccatccccatcccctccaatggcgttttctgccacgtttttcgccactctcgccgtcgggggctcggcgggggagcggtccctccttgcctccaaggccgccccctcgccgttctctctccctccgcggcgcccgcctcccctcgcagggcgtctccttatctgggggcctcgcggcgtcgccctctcatagccgcgcgcgcttcgccacatcagccagcgccgagcccaaggaagcagaccttcagtctaaaatcacaaacaaggtgtactttgacataagcattgggaaccctgtgggcaagaatgttgggaggatcgtcatcggctcgtactgtgatgatgttccacagacaacagagaacttccgtgctcnttgcactggagagaaagggcttggatacaagggatccagtttccatcgtggcatcagcgactttatgattcatggcggaaaatttgacaagggccaatggtacccggggggaagagcatatatggacgccccttcaaagatgagaacttaaaattggttcacactggacctggagtgctcagcatggctaatgcctggccaacaccaatggcagccagtcctttatttg

SEQ ID NO: 22175 - DNA, 549 bp, Zea mays
  Clone ID: cC-zmle18900085f12d1
cggcaatcaccacacgagagaagagaagctttctttcaacagttgaagaagcgagagagctgacgggaatcgactggcatcaatggctctggcgccggcgcctctccagtgcttcctcactagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtccctcagcatggtcggcgggcaggcgttccggtcctctccccggtcgttcggccctcggatcaacaactccaggaccaacatctacatcaacccgccggtggcgccgccgctgggcggattcgggtacgggagcccgttcttcggcggctacggctaccgctggtcgccgttcagctttttcgtccccgggccgaagcgcgccgccgggtc

SEQ ID NO: 22176 - DNA, 581 bp, Zea mays
  Clone ID: cC-zmle18900085g12d1
gagccacaggagttttgggatgcattttcaagtttgctgcctaatttatatactaatacaaagattaggagggaccagagcgattcatcatccaagagtaacccaggaagccggataattgagtcttatgacgctgattttgagcttgtctataaagcaatcaccgggggagtggttccagcgttctcaacttctggggctggggatgagacccaccttccagccagagagagtagctggagtttactgaggcacaagttcatctccaggtcgctagctcgtgtttattcagattctgctctaatcagggattttgatccacgggtagaccgtgtacagcacctggctgctgaggcatcgacctcacctcctttcctttctccaagctccttctcatcggattcaagcgccagctcgaagtatagtttcagattaaccctccctatcacctacaacttagcttcccgcatcatttggcctctcgcctgcttcatctaatttgcctaaagctcttgggccatcgtccaaggtctcctctttctcaatcatctaatgcaggggccttaaagccttttggcctg

SEQ ID NO: 22177 - DNA, 433 bp, Zea mays
  Clone ID: cC-zmle18900085h07d1
ggagaggcgtgggacggctgcaccgcctgatgttttacgggtcatttgcgagctgctgcggcactggcgtgacctgtgggagagcttcagtgagcgaacgacgcctgacccgagacatttatacacgaaagggaaaggcgtttgcatcgacgatgacgactacgactacgacttggatgacactgacgacgaagacattggtgcgctgaagagatcagcgaggaaagggtccggctggacgctcccatggattcccggcaagcggcaaggggactcgggagccatcaggatcaagtaaatagcaggaaaggcctgtgtatattgcaggaataggttcgggtcttggaattcgaattggaatttatttcatacctttgctattcctcttaaaaaagagaatgctacagcaaaagtcacaagtcgccacactagg

SEQ ID NO: 22178 - DNA, 169 bp, Zea mays
  Clone ID: cC-zmle18900085h08d1
aatttaggaacggagtgtactgacgatgcatttttagatgtatgtaataattttgtccagtgaaaggtaatgagcatggcgtctatagttagggtcagttgcaaacagccaaaaaaaaaaaaaaaaaaaaaaaaaaaaaaaaaaaaaaaaaaaaaggtaaaaaataatg

SEQ ID NO: 22179 - DNA, 468 bp, Zea mays
  Clone ID: cC-zmle18900085h09d1
cgatctgggatgagcaggacgaggacctaaatgtttcacaacctgttttgaatgaaaaacgcatggggggtctctctggggagaactttcgctgcttgaacaggaatcacttccagattgattatagagtattgggcttgtgcaacaatactcacttacagaatcttgacaagcaaaacaccaaggggaacctgcctatcagaccccctgcatcgaagaaaacaataaatgggcactggaatcacagcgcgcgaagccccagcctgaatatgcgaaagctattctccgatcgagacccccacacgttcaatgaatgcttgcacaggtatcaggaatacctacactgatagaaggaatttagactgaagcacgacttttcatagaaacgcacctaagagactgcatcatcaaacgtcacaagtggtgaagcttggctcctgaattcaaccttgcatcgccaacctttaa

SEQ ID NO: 22180 - DNA, 619 bp, Zea mays
  Clone ID: cC-zmle18900085h10d1
gggcggccaagtcctcgggccccaagaagcgggtttttgacggacattctttgagacgctgctcacgccgcggttctacaggagggacttcgacgagatggagcgcctcttcaacgctgagatcaacaagcagctcaaccaggcggagttcgacgcgctgctgcaggagttcaagacggactacaaccagacccacttcgtgcgcaaccccgagttcaaggccgccgccgacaggatggagggcccgctccgccagatcttcgtcgagttcctcgagcgctcctgcaccgccgagttctccggcttcctcctctacaaggagctcggccgcaggctcaagaaaaccaacccggtcgtggcggagatcttctcgctcatgtcaagggacgaggcgcgccatgcagggttcttgaacaaggggctgtcctgacttcaacttggcgctggacctggggttcctgaccaaggctaggaagtacaccttcttcaagcccaagttcatcttctacgccacctacctgtccgaaaagatcgggtactggaggtacatcaccatctttaggcacctaaggcgaacccggagtaccagggtaccccatctttaagttttcgagaactg

SEQ ID NO: 22181 - DNA, 592 bp, Zea mays
  Clone ID: cC-zmle18900085h11d1
cgcaggagcagactctattgtaagagctcgatgcttttggcgaagactgcattcccaggccttgggtgggggattacacggggagatgttacttatgatgggaaatggattctgggaacaactgacacatacttgatcttgatatgcactatcttcaaggacaaagatgggaaagaaaagactgggtttagtggccgaatggggaataggattgctgcaccaaggcttctgaagctcactccacttgattcagttttagccgggaccgacaacaaattccacggcgggcaattctcatgggtaacggagaacggaaagcaggaaaagcaccttgtcgctacagtcggcaaattcagcgtcatttggaattttcagcaagtcaaggacagcaaccatgagtgctaccgtgatcagcagggcctcaagagctgctactgctacaaagttgtcctcaaggatgaatcaatcgtcgacagccgcttcatgcacgaaaagtttgcgacgagtgactctcctaaactccggtcgttgtcgctacgcccatgaaagtcagctccttcagatagcaaatcgacgctgactccgaagctct

SEQ ID NO: 22182 - DNA, 514 bp, Zea mays
  Clone ID: cC-zmle18900086a01a1
tttttgcttctcttttttttttttttttttttttttttttttgggttttttttgggtttttttttttttttaaaaaaaaacataaaacccaggtttttttgaatcccttatatgccggcctttacttgttaaccccataaaattatcccttggggggtcaaaacattggcaggggccaatttggaataatcaaacccctttaagggttcatgacaaaaggccttaaaaagcccctttgtaaaaggggcatggccaaaaccctgtttaaaaaccaaaatattggctgggtcagttgggggctaaagcccattaaaaaagggggcttttttttaaaagccccgggtatgtcaacccatcccttggctgaaaaaaacctgcttaaaaaatggggggcttttgcatggccccaaatcctccgaaagcgtttaaaacaactttttgtacagggagccatccccaaaagacttttttagcccgacaccggaaagggattttttattctcaaaccccccac

SEQ ID NO: 22183 - DNA, 472 bp, Zea mays
  Clone ID: cC-zmle18900086a02a1
agcagcaagttgaacagggggacacatgtgggtagtccatacataattggcacataacaaggaattacatgatttatccgaaccttcatggtcttctgggagccatgggacctttttttacacagcaacaaacccgcaaatcatcaagcagtctttcacagcaccaagtctataatggcatacaaatccacagtagtaggccgagtccatgatgcatgatcatgatgcctagcgagcccgatccttgatctcatcagggctgatttcacttgcatcagtagcctgcagttccacctgaatgccattgagcccactcttgaatttttggtttgagcttgcataaagcatcttgctcttcaccttggcggaggatggggaccataggatatagaagatcctgctcttctggaccggacacttgggcggacgcgtgggcggacacctgggcggactcctgggtcgacccgggaat

SEQ ID NO: 22184 - DNA, 365 bp, Zea mays
  Clone ID: cC-zmle18900086a03a1
atctcttaattttttttttacgactttcccttcatggggacaaaacgagggccactttggggaacaaccaccccggacccccaaaaatatttttctctctgcgctcccaaagagatcttgtacagaccttcggaaactccaagttaactgacacacagggaaacaattgataagagctacccaggcaacaactccttatggcaagaccttaaacggctcaacaccggggggcccaagaaatgcttcaacccgagcgtactgcctgatgggccattctccactaacttgaccaaaaacccatccagccaccacaattaataaaactgacccaaccagatagaaaacgtaaaaagcaacaggcgccc

SEQ ID NO: 22185 - DNA, 338 bp, Zea mays
  Clone ID: cC-zmle18900086a04a1
ggcggcggaaggcatggcttttgccaccttctaggcgaacgagagcgtgagcagcgtggcgagcggccacacggcgcgccgcgcccggtcccgggccggcgacccgggcgccgcccgctcgtaggcgcggaggcaggcgaagaggaggagcagggtggcgcaggaccccgcgacgaagaggacggcggccgtgtcgcccctcgcgcggtagatggcgaggcccgagttcacggcgagcaggcccaggcccgcgccggcgagcaaggtctgcccgtggttccgccggttgttgttgtccgccatggcttgggttggagggcagggtcggccggtgtcag

SEQ ID NO: 22186 - DNA, 481 bp, Zea mays
  Clone ID: cC-zmle18900086a05a1
ggaacttagtacagcagggatcgaacagggaatatcaccacgagtaatcctaaacactcgttacaaataatcttaattttaaacttgtttcaagacaaaatcttagggctagacgaaaacacatagccaagacaactctataagttcacgtcataagcaacctcatgtccagactcgcctagatatagaactagcaaacaaactactcggcagcagcaacctcctgcccagcctcatctccctcgacaggcctctcaagcttcacaccaacatcctctttgtagtcgccgtgaacctccatgagcttcccaagatcgaacttgggggccttgagtatcttcaccttgcggatgaagacgttttgaagtgggaagatgctggaggtagacttctcaatctccttaccaataacttctggaatgaacttcgaaacaagttctttcaggtcacatgtagaagcctgggtgatcataatctcaac

SEQ ID NO: 22187 - DNA, 364 bp, Zea mays
  Clone ID: cC-zmle18900086a06a1
tttttcttcttttttttttttttttttttttttttatggtttttttttggttttattttatatttaatcattttattccctctttttttttttttttttttttttttttggggggaaaaaaaaaaaaaaaaattccaccccaaaaacccccgaaaaaaaggggccccaaatttgtaaaaaaaaatttttttaaaaacccccggggggttttttttaaaaaaaagaccccaaaccccccccggggtgtcaccccaaaattttggaccgatcccctcgggatttcaaacttttctttaaaaaaaatgacttaaacaaatggcttacataaacaaaaagggctccccagaaaaaaatttatcaaggc

SEQ ID NO: 22188 - DNA, 391 bp, Zea mays
  Clone ID: cC-zmle18900086a07a1
agaactccggagtgcatccttaagcggcgcctttttttttttttttttttttttggggaaggacaaggggccatttgtctaaacatattagggcaaacataattaaagcgaggcatcataaacaaaacggtcctgggttaaaatccagatcagagcatacaggacaggccagggcgtataaccaaatggatcggcctcctctttgcttgctttggggccctttgatctgtcctccaagcggcctcctctcggcttgtccgctccttctttcataccatgcctgtccgtttcgtcctttcctccccttcgtacgttcacgtggccttttccttgggtgctggaggggtcacctgctaggctcctttgggagggtaaggctaaagaattgacc

SEQ ID NO: 22189 - DNA, 380 bp, Zea mays
  Clone ID: cC-zmle18900086a08a1
caccttcaaacgggaaaattgggggaaattttccataaaaagggactccacacgtcaaatgattttgtaaactaaattaccaagttcaaaccaaccataacctgatagcatcagaaagatagcccaaaatgaacataatttggcacaatgcacacatccatacagttttcaagttcgtaatataccaagtacacaagttctgatagatgcaaatacagcgcatttcttataaccaccttggacgacacaccttgcaaatcaaactgaacactccctggacacaaacctggagtacgaacttctgctattaaaaaggctttcccttgaatgacaactcttgccaaaatatttgctacccgagggttcccttttactccctt

SEQ ID NO: 22190 - DNA, 497 bp, Zea mays
  Clone ID: cC-zmle18900086a09a1
gtaaacaagtttcatccaatgggctgggatagtaattaattgttacaaaacagcatgcagattgtacgatgtttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttctcgtcggcgaactccttggacagcggcggctgtggcgtcaccttgaagttggggtcccttatccgcttcagcgtgtaagcctggaacaacgttcaggtggtgatgt

SEQ ID NO: 22191 - DNA, 413 bp, Zea mays
  Clone ID: cC-zmle18900086a10a1
tttttcttcttttttttttttttttttttttttttttggttttttttgggttttttttttttttttttctttttttttttttttttttttttttttttttattttttttttttttaaaaaataaaaaaaaaaaagggtttttttttcctctggaaaaaaaataaactaaaaaaaaaaaaaagggggacccaaaccccttaaaaaaaatttaaaaatatcccccccccccctttatttgtaaaaaaaaaaaaaatatcccccccaaaaattgggaaaaaaaaaggggttcccttttttcttcctggagaaaaccaaaaaaaaatacccccccccgggggccacatctttttaaaacctaaaaaatatatggccaaactctaattgtttcccctttttttttataggtagctttt

SEQ ID NO: 22192 - DNA, 198 bp, Zea mays
  Clone ID: cC-zmle18900086a10d1
acgcgtacggatgttttttttgtattattattagtaaattttagtttctccactattatcacgacgatgaggggcgggatgagatgttctgtagcagcaggccaggcggaggggggatgatgtgacactgttttccaaggtattgttggcttccctttttgctttgtcctctagtgtctcttgctctgcgccaaggga

SEQ ID NO: 22193 - DNA, 279 bp, Zea mays
  Clone ID: cC-zmle18900086a11a1
tttttctcctttttttttttttataaacaaatttatggtgttatttggggtgggacattaagtactaccccacaattcaccactttaaccgacacgaacacactcatatagaaccattgacccacagtcggaaataccagactagtacgtaccacaaatatccaaacgggagcacaaaccgaccaacatgcatacacatgcagccctatcacatatgattccaccaatcaaaaaatattattcctgcgtaaaaagcaaacctcataaaacataaacaca

SEQ ID NO: 22194 - DNA, 219 bp, Zea mays
  unsure at all n locations
  Clone ID: cC-zmle18900086a11d1
gggtgcgatttattgagataatgccgcgcgaacacttttatattatccatcgaccgaaaaaggcganggaaaggcntcaatacaaagatatattctatccatcccaaaaaaaaaaaaaaataaaaaattacataaggttgtatcaaaataaaacaataaaatataaaatactcatacaaaaaaccacataatccaatgaaaaagaaaaattaattgaat

SEQ ID NO: 22195 - DNA, 407 bp, Zea mays
  Clone ID: cC-zmle18900086a12a1
gggaaaaaaaaaaatttaggtccctttaaaccccccccttttacatgactacccattgacagaaatttgactgaattttatgccttggtaaacatcaaactttcaaaggggattgtttctccccccttcccccaacaaaaacatggttttaaggatagcattccaaacaaagggcaaaaccttttggggaggaaatcccccctgcatccttttaaagcgaagaattctctatcccgctttttggattcttttatccccgaacgggagggggacaagttttttagccccttgcggatgttctgtccctttgtataccttgggggggggaaataaattttttcccaacctttccttggggagcatgccacaaaccgcatggtcaaagattctttctggaattccttttt

SEQ ID NO: 22196 - DNA, 544 bp, Zea mays
  unsure at all n locations
  Clone ID: cC-zmle18900086a12d1
acccggacgggggggctggggcnggngccactcgctcgccgagcctcattttttacggccgacgacacccatacnggaaagggctacgacttcaatccgcgccactcccaccgccgcctgacccggaccgcgtccaaggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgaaaagacatgggatggtggtgatgcaacagacaacatcctaggcaggctagcatccaccattgcagtacataacatgggaaagaaagaacccacttacactcccagcgtagacatgggagctcttggtattgagggcaatgcagaaaaggttgctgtctctggtaaaaagcgggcacaaaagctttaaggaagcacccccgaaggcctggaaggatgaa

SEQ ID NO: 22197 - DNA, 298 bp, Zea mays
  Clone ID: cC-zmle18900086b01a1
ctcttctcccccttcttttcctcaaaaaaaaaaaccccaatctgcctaaccgtggccaccaaaaaacccaccccccacctccccaaaaaaaccccgagctccttgggccacacataggctaaattgtccccggccaacccctctaatttttccttggggccaaaacccccacctgggatttaaacccccacacaaaagaacccccttctttgttaaaaaaaaggggccccccccatcttacccattttaccccccctaaccccactttgaggtgggttgcccgcccctgtttttcccc

SEQ ID NO: 22198 - DNA, 422 bp, Zea mays
  Clone ID: cC-zmle18900086b02a1
tgacaaatttaaacaacaattcttgcagtactgtacgcgggggtacagaatgggcactataaaacaaccaacctcccgacacccccacaactatatataaaacgcaggaggtaacgaccccatatgtattgcggctccacgctgctgctacgacatatataatcacatcaatccccaaatactagaacgaacacaacggccctgccccttccttccgacaacgctaggcaaccatccaccgtccagacataaaacactacggccccccaacctttcaagaaactgagccttgggccccgcttgccagccaaagctactttcatctccgctgactaccagccatcaaacgactgggcgcgtctgaacagagctgctttcacgaccccgtcaagaccaaactacaagacgcgctgcaaagagca

SEQ ID NO: 22199 - DNA, 427 bp, Zea mays
  Clone ID: cC-zmle18900086b04a1
caagcttcaacattaagggggcagacgagatgccatgtttacaattacatgatcaaaaccctcgagtaaattcatcacaggcttttgtatcaccggtcattatttgagttcatcaggcatttcacatgtaacacgaaggaaagaagaatcaaaagatactacgcgaagcattccagagatgctcctaacacttaacccagcattatggctaggcacaggtttccacaaaaagaaggcaaaagcaaggtgcccgcacttcatgctagttggagggtccttcagtattccttcttaccaaagtttttgcaccacagttgagatgggattggccggactgggtgatgcgggcgttgctcgagctctgcggacttcatagcgatggggatgcacatgaggaagacgccgaacatggcgatggcggtgttac

SEQ ID NO: 22200 - DNA, 384 bp, Zea mays
  unsure at all n locations
  Clone ID: cC-zmle18900086b05a1
gggaaaacactgagtatttatataactgataacattacaagacagaaagttcaactagacacatgattaagccttataacataagatgagcattattttatacaccctggccgacagaacataagagaagagtcccgaacagcgacaatttttggagaaaccaggagggtgatttaacacagcagcagatagtagaggccctgtaatttttaaagcaaccaggtaggtagtaaatgtgaatgttgttgaaaggcaaccacattcttcttggcttgttgccaaccagccccaactgacaacctcaaatgtatgggggggtggttggngggaggcaatcattaattgtggagcatgtgcggggcgcccatgggcattggggcagcc

SEQ ID NO: 22201 - DNA, 497 bp, Zea mays
  Clone ID: cC-zmle18900086b06a1
ataaaggattttgaagattgcaaaccgccgaggcgccaaggcacgaacatagtatataaatattacattgttgactccatagcgctagggtgatcatctgcagtcaaccacagaaattgacaactagagtcttatttattgtgtactctaacgttgggaatcagtgggctactatcagcaatgggaaggaccacttaattctcagatctgtcgacgaagatgcgcaataggaagaaccgcctaattctcagatctgccgaagaagatgatacgttgtattagaaattacgtgtcatctttctgaaccttgcgctgtttgatcttcttgctcagattgtcgcacaaactgtcctcggacccgtggccgctgctcagcaagcctcttcctgctttggtagcgaacctttttaccaaagttccgatctttccgcttcagtctgacattgttcaatgcagcttttcgttgcaggaaccgattctgatacatgtcattgcca

SEQ ID NO: 22202 - DNA, 78 bp, Zea mays
  Clone ID: cC-zmle18900086b07a1
attcaggcaaagtgttgggcccttttgggggacggtattaaggaacctgcaactgactggaataatacgcgttgatcc

SEQ ID NO: 22203 - DNA, 474 bp, Zea mays
  Clone ID: cC-zmle18900086b08a1
cacttcggattatccaagggagtcatcgggtaattacatcaattttctgtacaacagtttgagaatcgtacaaagctcctgtataagtgtggatctggatcaatactaaacaggtatcttcttcggaaccagtccaagtatacctgtatacccaatagaatccgagtattttggttatcacaataaccaatatacaggtgtcctcttcagaaataatccattcatatactcataaatctgaaaattttgtctatcacaacatgccaagtataagctcaatcattcattagggtaagctgtgtcgtgagttcaacaaagtataattagtatttggttgtattttgacccgtttagtggactccataagtttgacaagcgatggaagaggtctaggaacagggatattccttgacctgtaaaacctcttcaaacttgcatttcaacatttcgatgatccaatatagcacaaaggtt

SEQ ID NO: 22204 - DNA, 252 bp, Zea mays
  Clone ID: cC-zmle18900086b09a1
gttgcaaagcaaagccaataatggttcattcatgcagtaggagaaaggagatgagatctcatacatagttgattcagagtacagacataagacatcatcagaaattcataatgcagcagcctatgaccaggcccttctcttgagtcagtgaccccccttcctcgcgcaagcaggctgacaaatgttggaacactagccccacagtggctggctgtctgacgcaaacaccactcgagaagtccgagatgcatc

SEQ ID NO: 22205 - DNA, 444 bp, Zea mays
  Clone ID: cC-zmle18900086b10a1
gcaactccgggaaggcaccttaagcggcgccttttttttttttttttttaacattttatagataccatccaggtggtatagatatatacggggtgcggcggcggaggtaagaagcattgggatagatagcttgatacaaacaagttcattccacgtatgacgcgccatcagagtatattctttcgtagtgtgctacaaccttctccttcatgtcgatggcttatagctatacgactagctagttgtcgtagatgcggcactcctcggagtccgggttgtccttgcagtacttctcgagcgggtcgttggcgttggtctccttgaggctgacgcgggcgtggctgtcccttgagctaatctcctacaccttgttccacgccgccgggcacttggcgtcgcccttctggtcgtacgcgcacgtttcctccggctgcttgatgctct

SEQ ID NO: 22206 - DNA, 262 bp, Zea mays
  unsure at all n locations
  Clone ID: cC-zmle18900086b10d1
gcggcgacaaccgaggcgagccncaccgacccggggacgacggcgaccttcgcggcggcggcggcggcgggcggcgccgacgtgctgaacgacgtcccgaggagggcgggcgccgggcgcgacgtcaggatccccgcggcggcgcgccgcggcggcgggcggaaggaccccgtgcggaccagcgggccggccacgccgaccgaaaacaccgacaaggtggcggagagcagcaaacaagcggaggagacatgcgcggacgacc

SEQ ID NO: 22207 - DNA, 481 bp, Zea mays
  Clone ID: cC-zmle18900086b11a1
aacacaaatacatgcatggaaatattagggccggcacgagacggacatgaccgcgagcccgttacacagatgaacatgaaccccaggagcgaccatggatcgataatggcgggtgcagttgacaggatcttatttagacgctgctattaattatatttatacgcctcgtcgtcgtcgtcctctcgactctcgtgcgccatcgccgggccgggcgggccggctcaattgcagctgcagcaggagcagccgcagctggtgccgcagttgcaggtgttgcaatcgcagccgccgccctcggtggccgcctctaagccgccggcgctggccttggtggtcggcgcaacgaggaccatggtcttgatgctgctggcggcggcggtctccacgtcaggggacatgcagttgcatgagctgccgcaggagcagctggagccgcagttgcacttgccggtgcttgcagacatgatcacagaccaagggg

SEQ ID NO: 22208 - DNA, 524 bp, Zea mays
  unsure at all n locations
  Clone ID: cC-zmle18900086b11d1
cctcttgctcctgttcctcctcctagcacagctatcgctttctccccttcgactgagatcatggggggggggagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggactacgacgacgaggcgtataaatataattaatagcagcgtctaaataagatcctgtcaactgcacccgccattatcgatccatggtcgctcctgggggtcatgttcatctgtgttacgtgctcgcggtcatgttcgtctcgtgccggaattaatatttatatgcatgtatttggngt

SEQ ID NO: 22209 - DNA, 344 bp, Zea mays
  unsure at all n locations
  Clone ID: cC-zmle18900086b12a1
gaaagtacctgattatcgtcatgacaagtgagcatcatgggctgatatagacagaaccctgattttcatgacaatcgcaagaagcgcatcattggatatccttaccggagagggcgctggtgttgtagacaggagggcgccgccgctaggatcccagcgagggtgacggcccacatagaagcccatggttccaccantagacgtcgccggtgggagaccgtatcctcgtgagattgggctgtatcgttaccttcggccgacttgtcgacgaactggtacacgcccttgccttccctttctccgtggcgtgacgtcacggtaagcccccccatcccgtaggcttg

SEQ ID NO: 22210 - DNA, 502 bp, Zea mays
  unsure at all n locations
  Clone ID: cC-zmle18900086b12d1
cgcgggggcgagaagcccaacaggacagggggcggccttaccgttgacggcgacgccaacgggagaggggcnggggcaagggcgagaaccacgacgcccacacgcacggcgcgaacggcgacggcaacagcccaaacaacaacgaggaggaccgggcacccaccggcgacgccaacgacgggggaaccacagggccacagaacagggcacgcacccacgcagggaaccacggcggcggcgcccgcctcggagacaacaccagcgccctccccggctaaggaaatccaaagcaggcgccacaggcgaaacgccacggaaaaacacgggggcgggggagaagcgagcccccatggaagctcaacctccggcacgcaacaataatcaagggccaccctgcaagacaaaatggggatgccaaaaagagataccccaacccaccccaaaaaaaaaaaaaaaagggcgggccggtcaagagaacccagcttacgaacgcgggcaagcg

SEQ ID NO: 22211 - DNA, 148 bp, Zea mays
  Clone ID: cC-zmle18900086c02a1
gattcattcatgaaatgggtccggatcgggtgactgtcactcccaagccacataaataaattgcaggattacaagataccaagaggtaatagcttcggcatcaccagactcgcactcttttaactcctcatgtataaaaatagggggg

SEQ ID NO: 22212 - DNA, 487 bp, Zea mays
  Clone ID: cC-zmle18900086c03a1
agagcgagagcgacgacagggcaccaataatggaatccgtcttgaaggccacgagcacagctacgagttccaattctatcattacgtcgagcacgtggtgagcaccacgcggactttactgccttctccattcacatcaaaaattttctggctacatgctgatttgtttccttttatgtctaattttctcggattttttggcgcgaacatatgtcgtggatggcgtggttgtcgcatggttgcgcgtagcggacaacagtgaacgttgaaagttggagatggtgaggacgtgcaatacgcgacaaacgacactagagcgtgtcgcgcaggacatgatgctgactagaacatgacaccggcgagctccggaggtgtgcatccgacggggcaaccggaaccgaacacaacgaggaacgtggcaacagggacaacatggtgttaggcgagccttgccatcgagccgatgcagcgatgtatcttgacggca

SEQ ID NO: 22213 - DNA, 571 bp, Zea mays
  Clone ID: cC-zmle18900086c04a1
ttttctttttagctattttagtacgatctactccaatggcaacatggggttacataagtaggttttacttcggcataatattataattaagtaggtacatagattgcatttaaaataggtaacgttttcgatacattttgaacgcaaggtttttttttaattcgaatattaatatttattcaacaattttagtataatatttattcgcacttaaaaataaaattatgctacaaggattattttattgatcatttaggaaacaaattttctgtataaaaataaataaaaataatataaataacctataaataaataaaatagatcagcaaagaattagacgcctaagttatctagttgaggcagacctttttctaggagttcttccatgttgacttgattgagtacttcctgtactttatctttaagaggttcttcgatagcgtcgacaatgatgtgcctaattaaatccggtagggcgttaacgacgacgacgatgattgcgttgaattgtccagtaccgtccatttgaagtttacttttcccaaattcaagtcgagatcttctagaacgg

SEQ ID NO: 22214 - DNA, 361 bp, Zea mays
  Clone ID: cC-zmle18900086c05a1
gggccaaacagccggggtttttttataaatcaataaatgtaaacagggacccagggtgggaggctcttttccatacatgttttattagcagagcaaagggattttttttggagccctactcctacccagggaagccaaccaaagcaaaggaagcgaggacctgaggcctcacgggaggcctcacccttttctcgcggaggaaggcaacgggggcaacaacaaggagcccgaggaggtctcggtaaacccaaaaaacaacctggttaatgcccaccttgaggacggacttggcgaggacctggtaaccgctgttggcaaacatgacgaggaccatcccggggtgggcccgccaccgtttgcc

SEQ ID NO: 22215 - DNA, 439 bp, Zea mays
  Clone ID: cC-zmle18900086c06a1
gactcttttttctttttttttaattttttaccgtttcctgcgggggggccagttggggggaaaaacacagcctatccccatttcaaagttcaaaccaacaatttacagagggccaacatgttcctaggggggacaagaggacctcaaaaaatcccttaccccttcaattacattacaggactgccaaatgcgcgtctaaattcacatgtaaaaaaccgcacttacttgaaacaaaacccacatgtggtcctgtaacaccccaaaaggaaactatgggtcctatcccccctccctagacagcaccaacaacttggtcgaggaggctacacctaaatccaaggcacttttttcagcgagaggggctgaagcttcaccaccaccgaatccacgcagagggcggctttcgcgggcgtgccccctattggaataatcccgaacc

SEQ ID NO: 22216 - DNA, 483 bp, Zea mays
  Clone ID: cC-zmle18900086c07a1
attgcattgcttaggcggcgtagtctggaaacattattaacaggagaggatggatcttagatgcaaatagccatgtctaaatttacaccgatgaccgccaccatgtttacattcagatcattaacaggagagggtggatctagagcgagaggccaccggactcctcgtcctcgtcgaggtcagaggtgtagatggtgtagagggaccagatgaggccgaagacccccaggaggatccaccccagcaggttgttgctgagcccgaggctcagcccggtgccctccgtggacatgcgctcgtccacaagcgccagcgcgggccccgccgacgcggtcaccgcgcccgctgcggcgagcagcgacgcgcctgcgcccttggtgctgactggggccgcgtccttggcgtatctgcaccggaccctctcgctcctcgccctagcgcaagcagccctaaagcattgggcctggcgatcgcggcgcgggc

SEQ ID NO: 22217 - DNA, 496 bp, Zea mays
  Clone ID: cC-zmle18900086c08a1
tttttctcctttttttctcttttttttttttttttttgttttttttgggtatttttttacaaaaataaccaaaaaatcccaaaaaaaaacataataaaaaaataaacaccaaattcctcaaatacattaaaaaaaactcaaccaaaaaaaaaacaaaacacaaaaaaaaatacaacactaaaaaaaaacaatacttaaaaaacaaccataaaaaaaaaataaagtatcaaaacgcaataacaaaaaaactaaaggatacaaaccaccatcttgttacaaaaaacaatgattatccaaacacccaggggggaaaagggataaaaaaaaaactaaaccttacaatcggacaaccctttctaagtacccccaggggaaaaattttctcaaaattaaaatttaaaaaaaagtggaattaaaacccaaaaaaaacaaatcccacacttaacatcctcttcggaagcttccccctgctcccaaaacatttaacactatttat

SEQ ID NO: 22218 - DNA, 386 bp, Zea mays
  Clone ID: cC-zmle18900086c09a1
atcccaaaccatccctgtgggaagcacagggattacctttatccacggagctgatcaccgctggggtgaaatgaaacaaggaccacaccacctacataccatgcagcttgagaggaggaccggtcggatctatatatatacgcatttttgaggatccttacctgaagaactaagggaggtacggcacgtacaggagaaaggaggcccaaaacaccccgcatatgccgcacgaagaataatcccccggtgaacttggcccatccgtccgaggtctgtaacttgttggacaacttcttcctgcccgcgagcgtgatccagggcgccgaggaccggtacccctttttgaaggaggcgactacccacatggtgaagcacacgctgaggat

SEQ ID NO: 22219 - DNA, 449 bp, Zea mays
  Clone ID: cC-zmle18900086c10a1
tttttctctttttttttttttttttttttttttttttggtttttttttgtttttttttttttttttttccttttttttttctttttttttttttttttttttttttattttctctcccacctggagggggggaaaaaaaaaattctttttttttttccgggcctctcaaaaaaaaaaaaagtttttttgggcccccccccccaaaaaaaaaaagagggggtttttttttcggtaaaacctgaaaaattttttaaaaaaatttacacaccccccccattttacttttttaaaaaactccaatttgggggggtgttgggccaaataaaaccccccatttttctttttttccccgtttttcccaaacccaaccaaaaaaaatatatttgggggcgccgggaaaaccaaaaactttatgggttctctttatgggtccgggccccttttttccc

SEQ ID NO: 22220 - DNA, 402 bp, Zea mays
  unsure at all n locations
  Clone ID: cC-zmle18900086c10d1
ctaacttgaggagaatccaacaccaggcggtgctttattgccanccacangaaaagccgggacaggttatttctgcaccatctgctcacccaaacacaccagatttgccagatgaaaagaagcaccttattccttttgcatctccaccgccagttgttgctactccattggaaaaaactgatacagttccctcaccttcaatgtctcctccagtgaagccaacagagccaaaaatctccacaaagcgggttgatgaattggccacacctccagtacctcccactgattatacgttcacaaaacaaccagaacaagtacggccaatctcttcctagagtgaagcaattatcgacttggaccatgtactatctgctgctcagacagctgctgaatcagcggagc

SEQ ID NO: 22221 - DNA, 440 bp, Zea mays
  Clone ID: cC-zmle18900086c11a1
aagggatgcaccggggggggctttgaattgttttaaatgcaactgtaaaaagtccgtaaccgaaaaacccatgcccgtttttggcacatgcacttgtaaagtgccatgacagtttgacaccccttacacccatgaacatttgacctgtccggggacactaaaatgtgccgtaaacaaaccaaggcgaacccgtctaattttacagaccaaatgccataaaactctaaattctgaaatggctctagttgaagtcaggcttttcagggtaagggcagccaaaacgttggataacaacattggcggcgtaacaggcagttttgacacactcatcgatgctcttctcttgtaccaactgggacaggaagcctccaacgaacgcattacctgcaccattggtgtaaacaagcttctccttaggcaagaggatcacagggaaagtt

SEQ ID NO: 22222 - DNA, 370 bp, Zea mays
  Clone ID: cC-zmle18900086c11d1
cccacgcgttcgggcggaggcacgtgaggctgccgctaggaatctcctttctccgggtactctgttctccctggcagtgcgactttcccactgccgtgaccatcctcacaccgaattctccggccggcgccgccccgtccgtccgtccgttcttccgataccgaactcgccagtcgccacagcgatctctctcgctcgctccgccgacgcagcgctcggcttcagctcgagaggaggaaatggccagcagcggctacgaagggatcctcctggggatggggaaccccctcctcgacatctccgctgtcgtcgaccaaggctttcttgccaagtatgatgtgaaaccgggcaatgtcattcttgctgagga

SEQ ID NO: 22223 - DNA, 397 bp, Zea mays
  Clone ID: cC-zmle18900086c12a1
ccaaatcttgaaggaatgcaccgggggggcttttgaatcgtttccaatgcaaccccaaagagcccccaacccaaagactcatacccgttcctggaccatgcccttgtagagcgccattacattatgacacgccttacccgcataaccatttaccctgtgcggggacactaaaatgccccattaacacaccaaggggaccccgagctaattttccacaccactatgccatatgaccctaaattctgaaaaggctctaggacaatgcaggcttataacggcaagtgcagccagaacagtgtatgacaacattggcggcataacaagcaccttttaccaactcactagagctcttgtcttgaaccaactgggacaggaaccctccaaataacgcttcacc

SEQ ID NO: 22224 - DNA, 571 bp, Zea mays
  Clone ID: cC-zmle18900086d01a1
ttttgatcattttttcctaattgccattaaaggcgccaacagagtacattgtgggtccattcagagatcagttcacacacacgcacagacacagagagaggggggagctttattttgtttcggtctacacggtggtactcagccactgtaacagttcagtcacggtactcagccatgaacgcctcatggaaagccttgaagcgggtgatcaccgcggggattttatcttcctgcggcaggatcgtgcatctgacgtgccatgttccaggaacttggccaaatccagatccaggaaccacaacaattccagttgattcaaggagacggagcgcatagaatgcatcaggtgctttcttggcagctttagcagcctcaattgccttatgtggcagatggatctgagggaaaaggtacattgctccttcagccttgttacatgaaaatccctcaagcgtgttgaatgcatcttccagtgcctttgcacggcgagctaaagactgaaggattccatctttctttgccttgaagaagcatatgatccgtccccaacctttggtggattcatgacgag

SEQ ID NO: 22225 - DNA, 456 bp, Zea mays
  Clone ID: cC-zmle18900086d02a1
agggcataataatatggaaaagaggctgagggggtccaacatgtttacatcattcattccagttttcgaaatgtttgaacaaacacacagaaaaagttcacgacgtcaacatacaccttcaaaaatcgcaagcactaatttgcgagcttatttcttgaaccatgccaacccttatgagctcaccccgagctggatgcgccaatcctaaagctgctttttcacttgttctgaaccagtagagccataggatatgaacttgtttacagcgttttcaacccccaggtattcatagacgtcatcctcaaatacaggatggacagattttaggtcagccaattcaagctcagctagctgacagttcttggagacgcatagagcaacagacctttcaactatctcgtgagaagttctgaaagggactcccttcttcacgagataatccgccagcgtcgttgc

SEQ ID NO: 22226 - DNA, 197 bp, Zea mays
  unsure at all n locations
  Clone ID: cC-zmle18900086d03a1
tttttcaaacaacaaacttatnctggatttgtcatagnncnggggagcacccacagggaacactaccggtccattacccaaccaacacttacactaacatttttattctttttcaaccctccatatggagtaggccaccaatacaactcatagcacatttcacatcctttaacttacctataactttactgaccacc

SEQ ID NO: 22227 - DNA, 397 bp, Zea mays
  Clone ID: cC-zmle18900086d04a1
aataaattttcacaaaacttttgctagctcattcgacaggttcgactggggcaatcacgaggggggcaagggcaagtggcccacacaactgagcagactccgactcggcgtacatgctaacggcagcgcacacaagactcaaaaatcagatcaacagctcgcacacatgtcgcaacaagagctcgcaacaccactcaatgagttcacaactcaacaagagctctagatgctatcacaatgaaccacatgcgcggaatccatgtctcggcgcttaggaatgtcgtaggaatgcttggtgtcctcctacatgcgcctaggggtcccttttatagccccgctgagaacaaatctggaaggccattcttgccttctgtcgtctggcgcaccggacaacact

SEQ ID NO: 22228 - DNA, 538 bp, Zea mays
  Clone ID: cC-zmle18900086d05a1
ttttatttcaacacaatttcaaatgtccaaatctgaagtagccacatagatagtttgtaatggcataattaatagtaactagctgcagttagtaatgcagcaaatatgctaaattgctcatgcaatctagcaatagctactctccctgtctcccgtcgctcaaaaatcatcatcaaactctcctgggatattgggtgcctccccttcttcaccatcattgccaccattagattcatcttcacaatctgtgatttctgcatcgtcatgtggaacatcttcatcttcatcttcatcttcctcttcagcctctgacatgttttgtgcagcaacagaatttcttcttgaatacacattatgggcccttcttggtaagtttcggccacgaagtgcttgcgatgctccaatggcattatccacaaggtcccatgtaaggtcacactcacacccacgcccacctttagggactacatgcaaagaatcagcccactcattgtcccagttgaagtcctcatgaaccaatggatcaaagtttttcccc

SEQ ID NO: 22229 - DNA, 405 bp, Zea mays
  Clone ID: cC-zmle18900086d06a1
cccacccggcccggccccctggggcccacccggaaaatccgaaccgggccctggagggggaccaactttcccaaaaaggaggcgaaaaaaaaccgggggaaaaaaagggaaaaacggtcccccggggaaaaaaggtatcccctaaaaaagcccaaaaaaaaacaagccggaaaaaaaaaagggaaaacccggggggcccaaaaagggggccaacccaaaataaatgcgtgggccccactgccccctttccaggggggaaacccgtcttcccaaatgcaaaaaaaaaaaggccaacccccggggaaagggggcctgccaaatgggccccaaggggggtcttcttttaaccaaaaaaaagggcaaaaagggatgggccttccaccctggcccgaaaaaaaggaaaaa

SEQ ID NO: 22230 - DNA, 439 bp, Zea mays
  Clone ID: cC-zmle18900086d07a1
acaaaaaaacgagttttcttggggacttttcgatcatgctcaacaaaaaggtagcacttccgtcactacatcaaaattcggatttacagcaggaagcaactagcccaaattctacaatctaaaacagatgagacaacaaaaggggagaagaagcttttagccgctgaacaaacccgcttgaaattgaggttgcggcaaacaatgagccatttgaactccactacttcgggggcgtcattcaagccgttttggcagtggctgaaaaaaccgtcctctaggcaccataaatacgttcgtttttactccacctcctgtgcgcctcctggaagcaaatgactatgcaagatgatcttcatccttcccatgcatatttttaacaaaatggacgggtctcaccaccccagtttagaaccattgccacacatgatggcccgcaaca

SEQ ID NO: 22231 - DNA, 575 bp, Zea mays
  Clone ID: cC-zmle18900086d08a1
acactcaaaaacaaccaacctctaaaacaaccaccctaccccccccccccccctctcccccctttctccccccccccccccaattgtcaaatttggaattataaaaaaaaaaaccccacaaccccccccccccaaaaaaaaacccccaaaaaatcaatcccccacccccccacaaaaaccaccccccaaaaaaaaaaaaaaggggcataaaaaaaaaaaaaaaaacaaacccccccccccaaaaaaaaaaaaacaaaaaaaaaaaccccccccccccccccccaaaaaaaaataaaccaaaaaaaaaaaaaaatgttacccccccccccagaacaaaccccaccaaaaaaaaaaaggggttccccaaaaaaaaaaaccccccccccccccccaaaaaaacaaaaaaaagcccaaaaaaaaaaattggcccccccccaaaaaaaaaaaaaaaagggcacacccccccccaaaaaaaaccctttcaaaacccccccccaacacccaaaaaacaaaaaatgtaacaaaaaaaaaaaccccccacaaccccaaaaaaaaggtgggaaaacccccccccc

SEQ ID NO: 22232 - DNA, 369 bp, Zea mays
  Clone ID: cC-zmle18900086d09a1
ccataaaggggttttttgggaacccgcaggaaacaaaaacccccagtattgcacaaacgtggttaattttaggggacaacgccaacaaaacatctggacttgcctttgcaaggcaaccggaaacaaaagaaaaacaagcacttcggaaaattaatgaatccccgttccttcacccttttcaaacctaaaaaaaatgaagccgaatataaaacccacggatcttattttccagggacaaagggggggggatttgcccacacctttttttttgctggggaaccaagcgcataaaaaggatctttagcgggcccttgccggagaggagggcccggacaaaaaagcccaacatggaaaacatggcaaggcggg

SEQ ID NO: 22233 - DNA, 235 bp, Zea mays
  Clone ID: cC-zmle18900086d10a1
aagggcccccggtaccccccaaaaatatcccacccccctaaacccaactcctcctttctaatctaaaacactccataaatcgtacctcctgcccctatcaaattgaacccccctccccccacatataaccccctacctttttagaggggggggttcttaaccccttttttctttttttcccgcggaaaccccctttttttgtaaccccggccctcttttttcaaaagcccccccc

SEQ ID NO: 22234 - DNA, 343 bp, Zea mays
  unsure at all n locations
  Clone ID: cC-zmle18900086d10d1
aaaaaaaaaaaaaaaaaaaaaaaaaaaaaaaaaaaaaaaaataaaaataaaaaaaaaaaaaaaaaaaaaaaggaaaaggggaaaaaaaaaaaaaaaaaaaaaccccaccccaaaaaaaaaaaaaaaaanaaaaaaaaggcgcccacccaaaaaaaaccaaaaaaacaaacccacaaaaaaaaaaaaaaaaaaccccnaaaaagaaaaaaaaaaacaaaaaaaaagccccccaaaaaaaaaaaccacaaaagaaaaaaaacgnggaaaaacaaaaaaaaaaacacaaaaaaaaaaaaccccaacaacaaaaacaaaaaaaaaaaaaaaaaacccccaagggggg

SEQ ID NO: 22235 - DNA, 497 bp, Zea mays
  Clone ID: cC-zmle18900086d11a1
tttttttttttttttttttttttttttttttttttttggttttttttggtttttttttttttttttttcttttttttttccttttttttttttttttttttttttttttctaaaaaaaaaccccttttttaaaaaaaatttttttggaaaaaaaatattaaaaaaaaaacccccttttttaaattaccctgacaaaaaaaaaaaaaaaaaaaagggggtttttccccccatttttaccccccccctttttttttttggaaaaaaaaaaaaaaccctttattttttttcttaaaaccccctgggggggggggggaaaaaaaaacctttttttaaaaaaaaaaaaacattccggggccctttaaaaaaacaaaaaaaaaaaggttttttttggggaaatttttaaaatgttccccccccaagggggcaacccaaaaaaaaaaaacccggggggtttgggggcccctttgggttaaaaacattttataatcttctttccc

SEQ ID NO: 22236 - DNA, 152 bp, Zea mays
  unsure at all n locations
  Clone ID: cC-zmle18900086d11d1
gaggaggccgacancgacccagaccgcaagagaagccagaccgagaaccgcaagccccaacggacagcgagcacgagcaacgcacccagcccaaggggccccccaaacccacaggcaccgngaaaaccggcccggccaccagggaggagcaa

SEQ ID NO: 22237 - DNA, 488 bp, Zea mays
  Clone ID: cC-zmle18900086d12a1
aagctaggatcctctagattgtttttttttttttttttttttttttttctcttgggttaacccggggattcctggggggaacctgggggggaccccgtaatcccacaccgagacctgtaagcgctcgacttaaccataaagatagccgtataaaaggtgaaagtgatattgggtcacaatgccacacaagaaaaaagccgaaagcataaaatttcaacccagcgtagcctccggagggaaaaaactaacatccgggggggcccaatgagtgacctatttccaattaataaacctgccctgacaacccccttaacaaaccggaaaacccgcggggaaaggggattaaagaattggccaccccggggggaaaggctttcaccatttagaccgccaagaggttatttcctttcaccacttgaacctgaaaaagttgattgccttttaccaccctggcttgaaagagtaggcgaaaaaccctcccgctggtt

SEQ ID NO: 22238 - DNA, 543 bp, Zea mays
  unsure at all n locations
  Clone ID: cC-zmle18900086e01a1
ttttggttttttttttttttttttttttttgggtttttttttgggtttttttttttttttttttttttttttttttttttttaattttttttttttggggggggggggggtaaccggaaaaaacggaaccggaacctgaaggggtaccaatttttttaaaagggaataatataaaagctgggggaaaaaaagggaaaaagtgttaaggggggaaaaaggaaaaccggaaaaaaataaaaaaaaaaaaaaagccgaaaataaaaaagttaaaggggggggggcctaaagaagggccaaaaaaaaatttttatcaatgggcaaaaggggcggggtttaaaaaaaaaaactttcggggaaaaattaaaaaaaaaaaggccaactcgggggaaaagggtttttgtaaattgggcccctatttgttttttttttaaaaagggaagagggaaaaatttttttcccctacaccccttgggcttaaaaaaaantaaaaaagcgggcccaggcgggacccccacaaaagaaaaaaaaatttgggagggggtg

SEQ ID NO: 22239 - DNA, 437 bp, Zea mays
  Clone ID: cC-zmle18900086e02a1
gcaacaggagctatatgtgcattggaaccaagatggatgcaatgtacacgtacgcacgcacacacgttacaaagtcaccacctgcaggcacctgccggccggcggcgcgatcgaggctgctgagtctgatcttaacaacgacgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgccttcagcttcagccccgccgtcgccttgcggttcgccgacggcgccagcccgaaccgccccgcgaacagcatcagcgtcgtcgtcgtcaccatgatcaggttggtggcggagccgatgtagtcgcagcggatgccct

SEQ ID NO: 22240 - DNA, 384 bp, Zea mays
  Clone ID: cC-zmle18900086e03a1
ttccttttttttctgaaaaaaaccggcttaggattgaaggcgggaggacataagggctctcctaaccttaagcccaatgtactatttatcccaccattccacatgatgaaaagaatgtactgcagggagggcctaccagaacctcctccagtaataaccacactaaaattcgacagcgtgcccactctcaaagcacgcaccgctacacccgccccttcatataaaaacccatgcacacccaatccaccggcgtaaccccttcctgccagagaccgtgtccttgacagcgccaacggacaccaggaacccgaccaaagacgagagcgccatcatgtcatccctatggaacgagcagcccggcttccccatgaaggaggcgaggac

SEQ ID NO: 22241 - DNA, 340 bp, Zea mays
  Clone ID: cC-zmle18900086e04a1
aaaacaaaaaaaattgctcttgcatttgggaggagggggggttctaatacaaaaacaaaaatttttccctttggccaaacaaaagggccaaaaattggaagcctatataaattggcttgaaccccctaaaaaaagggggctgggacaaaaaaaaatcaagagttgggaagggacaccttttttgttagtaaggggggggccccccccgcctcacaggaaacttgcccaacaaaactttttcaaaaacaacgggttgcgggcccaaaaacatacggaattctttcctttcaaggccttggctgaaagcaaaagaattgtaagggccttggattaagcagcc

SEQ ID NO: 22242 - DNA, 394 bp, Zea mays
  Clone ID: cC-zmle18900086e05a1
ttttgtttatatgctctgcggcggagggccagccaagtgcagtatatattaccagtgggtcttctccacaccatggtacaattcataaaccacacccaactcaatttgcctctgctaccagcaagaaccacttcaaagacctatataactctatctctgtttcttcacccacacagctcctcataaaccgaaatggagcagcatgtatgtagattaccaaaaacacggtggaaaaaggcacaaacacgcgctgctccgataacaccgggaaataaaccaatgcacgcacggacctgacttgtacaaatagcgtgcggtatcagaccggacaggacacatggtttgcccccaaagcaactcttacaaaatagaccgaccaagaatgaaatgcaaa

SEQ ID NO: 22243 - DNA, 508 bp, Zea mays
  Clone ID: cC-zmle18900086e06a1
ttttgtttttatgctctgcggcggagggccagccaaggacagtaaatattaccagtgggtcttctccacaccatggtacaattcataaaccacacccaactcaatttgcctctgctaccagcaagaaccacttcaaagacctatataactctatctctgtttcttcacccacacagctcctcataaaccgaaatggagcagcatgtatgtagattaccaaaaacacggtggaaaaaggcacaaacacgcgctgctccgataacaccgggaaataaaccaatgcacgcacggacctgacttgtacaaatagcgtgcggtagcataccggacaggacacatgttttgcccccaaagcaactcttacaaaatagaccgaccaagaatgaaatgcaaagacaatgcatgcggccaaagggaaaagaatgctatgaaataaacagcctactaccagcagcagcagggaggatatgtctgacataaagaacttggcaccctgatcgaacaaaaa

SEQ ID NO: 22244 - DNA, 189 bp, Zea mays
  unsure at all n locations
  Clone ID: cC-zmle18900086e07a1
atcagggtcatgcccagcatgacatcgagccggtggcctgancctgaatnctatggtgannactcacgccgccgcgatntngccggtggtcaacccagctttttncgggtaatcgggcagatggcgttaatggccttcgcgctgtgccgtccgcattccctgcagnggcttcaggcctgtcgacacatt

SEQ ID NO: 22245 - DNA, 370 bp, Zea mays
  Clone ID: cC-zmle18900086e09a1
ggggaaagggaaaaacgccttccgctcgatatccattattgggtggtgaaaaacgtgatcaaacagcctttacaaaagcagcaccaaaaatatttcctggcaccggctattagaccacctctttaagcttatggacaggtattgggaaaaacttcatgacacaagggaaaaagtgcctgggtgggggagcctaataccgcggcctacttgggattggcaatccaactggcccccccccccgtgatttccacccccggggggaaccccttaggggaagcatcctcgtgcgccgcataagccaacggaaatggcccgacctttccagcttgatcccccgggcggactccctcttgcaagggaacaaggaaca

SEQ ID NO: 22246 - DNA, 441 bp, Zea mays
  Clone ID: cC-zmle18900086e10a1
ttctctttttttttttttttttggtttttttttggttttttttttttttttttcttttttttccctttggggacaaccaaaatgccggggaacacacctcccttcattaacccaaaaaatggcccccaaaatggcaaaagaaaaagcaaaccgaaaaaaccctttttttttttttttaaacaccccaaaaaaaacccttttttgggggcccccttggccccgcttttttttggttaaccccccccccaagcctaaaaaaaaaaaaacattttcccgggcgcccacccaagggaacaacagtgggggggggcccctttcaattgccaccccaattttaaccgtgggggggctctccggacatccccccggggctcaaaaaaaacgggggcgggctttttttttggggccccccccaaaacaaagggggccctcccggggggg

SEQ ID NO: 22247 - DNA, 216 bp, Zea mays
  unsure at all n locations
  Clone ID: cC-zmle18900086e10d1
cacaaggacgaggacggcggggagggggggatcaagcagcggcngcggcccaagccgcaagggcggaaagaagaaccccgaccaggaggagacgagcaccgccgcgcaggccaccgacgnccccggcgaggccccggagaagaaggccgcgcccgagaacgacgaggccgcggcggaaaccggcgaggccgcccacggccgcagcagcggaggcaa

SEQ ID NO: 22248 - DNA, 445 bp, Zea mays
  Clone ID: cC-zmle18900086e11a1
catagaaccaggttcacaggcttatttaggttggcacatcaatcacgaccgtacaatacagagtttcgccgacgtgaacaaattcataggaaccattgacccacagtaggaaataccagacgagtacgtagcacaaatatccagagtggagtacaatctgacgatcaggcagacacatgcagcactatcacatatgattccaccaggcagaaaatagtagtagtacgtagtaagcaaacgtcagaaaacagaaccgtcgacggcggggaactcgtcgaagctccacaggcggacgccgtccatgccgttgcccacgtcctgctgcacggcctcatctgcggcgaaaaggccgtccagtgagtcgtcgtcgtacccacccgagttgggcatctgcagcagcacaaacgggtcgaacgccagctcgtcagcgagctccagcgcggag

SEQ ID NO: 22249 - DNA, 350 bp, Zea mays
  Clone ID: cC-zmle18900086e11d1
cgggcagactcgccgccgccgcaggccgaggacacgacctttgcttgcagcaccgccacgacagagacgggggagggcgcgaagaggccgagaagcgaccaccacccgaccgagggcggcagcggcaccgcgcaggagcacgcagacgagccggcgaacgacccgcacgggctgctgcagaagccctactcggggggggacgacgacgactcactggacggcctcttcgccgcagatgaggccgcgcagcaggacgagggcaacggcatggacggcgtccgcctgtggagctacgacgaggtccccgccgtcgaccgatccgctttctgacgggggcggacgacggacta

SEQ ID NO: 22250 - DNA, 425 bp, Zea mays
  Clone ID: cC-zmle18900086e12a1
aaatgacaatctgggatcagctatggcaatagatcgagctagaacaatacagcacacacaggttctcaagaaccaccccacacatgttatctggcctcagataaaatacagtacctgtacacactagggaatgggaatctatacaggcagaaacaaccagtcgtggcttcctgaaacctaatgcttcctcaaatgctccacacggaataccgaacaccaagcctcacgtcatacaagttaacataatagcatatcactcaaccaataaatatgacagcctaagagatgtcaatagaatcaccctatctcagcatgctcaattgttttggactggaactgcagcagaagtttccttcaggacagagttcttcatgtcatcggagttagttctgatgctgagccacgtttgcgcagattcgagtgcc

SEQ ID NO: 22251 - DNA, 435 bp, Zea mays
  Clone ID: cC-zmle18900086f01a1
tgcttggtttcgtgaataggtttgctcggcaaagaaaagacccagcacaaggaagtaggagacaaaagcacacagacttgtggctcgctctatgcacgaagggaagttccgccttattaatcggcagtcagctccgcgcgcatcgtctccctgatggccatggacgccacggccttggcccacgcgaccagctcccgcttcatcctcccctcgtcactccacagcaccggcacgtccacggacacctccgcgcccggcgcggacgaaacgccgccaccgttcccggttcttcgcgttcccgagcagacttcgagggcggggacggacagcaccggaagggacgtcgcgtccagtgccatggcgcgcacaaccgagtccgcaagagccggccgatcggcagcacgacgcacgttcttgcaacaggccggggggggg

SEQ ID NO: 22252 - DNA, 522 bp, Zea mays
  Clone ID: cC-zmle18900086f02a1
ttttagctattatttttttcactctttactggaatagtacacggcttgtccaaagaatcacagttcgttacatcggaagcagcatctcgacttcgatcattcgaaagaattataccctcactcgcatacatgataatacttcgccaccttacattcttgaattgacggaacccggtcacacacacacaccaatcagaggtctcaggaggctggccaggtcttcaggcacagcccgcctgcgaaaaatgaagaatacgctacgctctatactctgtgtcaatcagatttttgtgcagaggtgttcgttttcgagtcagtttggtagtacactacgtctccggtgtcgctaacatagtggtcttgctttaagctttgtgctagcaccccaaacaggtgccacgggagaggacccgacttctttggttctttgtagtacttgccaagaaccggttttgctgcctccgtcgcctcaatgagatggtaatgcgggatttgagggaataggtgatggatgacatgagt

SEQ ID NO: 22253 - DNA, 511 bp, Zea mays
  Clone ID: cC-zmle18900086f03a1
gtataaatggcagccacgggatcagcctgggacctataggaagcacgaccaccaccaccaccacaaaactatctagatggcaaagcaaccgtgtggaggacgagttcggttcggtgctgtctggtcttattcatcaaaagacattgtaggcaatgtgtatctcaagcttcttcgcatctatataaagtagagactacagacaagtaatggaacttccaagtttcctcaactcaataccataaggcgacaactgtacacacgttcctatctcacgtgaagatcctcatcaagaccagcagagttccccctttccttcaagacgccagtgcgtgcgtgcgtgccaacgcccaacggagtgtgcctcatcgggcggctcttggtgccaagttcacggcctctgaacctttcatcagacgaaggcgctggcaggtttccacgaacatctttcaggggacgtcgccgacgagcatccagtcgccatccttgtcctcgtacgtgggtacgtactccg

SEQ ID NO: 22254 - DNA, 401 bp, Zea mays
  Clone ID: cC-zmle18900086f04a1
gcggacagtcaacggatgattattccgttacagctgtaaacaaatcaggatctgatgtgatcatttcatcagacaagaaacagcacacagagagacgtatacgtactgtacatatgcacaaggcatccacacacgatgctatctatacacgtccgtggtaacaccataccgtacccctactacatttgcttggccatggcgttgatgatagcgagcgccatggccgtgaggtgcatggcgccggcgacgttcctccgcacggcctcccttacgacggggggctggcccttgaacccctccatgcacatgccgtcgttcgtcagcgcggcgctcgcccacgtctgcacgctgttcacctggaacctgacgctccgcccggcctgcccgctggcgctggcgct

SEQ ID NO: 22255 - DNA, 343 bp, Zea mays
  Clone ID: cC-zmle18900086f06a1
aacaaatggggttctcttgggttttttttttctgtttatcccggaaacacccaaagggaacaacaggggtaccaacacctaacccaaaggcagaacggacactaacacggggacataagcgaacggcaacaccatgctataaatagatcacataacgaagtcgaaaccagcatggacccacacataaaaacctccaaacatgggcgccaaaaaaaaaaacgtcactaccacctaagggccgaccgaccaataacaaaaccactcctgagccgccgtcaccaccattgggccaaccgctgtaacccacaccgaggacataacccccctcacggtggacgccatc

SEQ ID NO: 22256 - DNA, 527 bp, Zea mays
  unsure at all n locations
  Clone ID: cC-zmle18900086f07a1
ttttgttatactgngacagagcaactgggcagctactggtgcactacatttgacggcaacggcaacggcaagaagatgctacactagcgagcagtacactccaagcatgtagcgtcatctagtgcaagtgggccagccgtcgccggataatatcggacgatgcggctaccagagcagggcaggctacggagatattttttacatgaacttatccacagcgacgccggaacagtacagagcgctactctataccttgcttcgttgcgtgtgctcgctcctaccactaggtctctgctgcttgcgatggccatgggcccatggccacgcccatgctcccctccgtcgtccctcacgcaatgaccacggcgacggtgtcgctgtccgggcggcgggcgctctgctgggccactcccctgccgcctgtggcactggcactggcaggcttggcgtccatgacggggcggcggcacgtcgggcacgagccgcgggacagcaaccaggcgtcgacgcacgggacgtggaacgcg

SEQ ID NO: 22257 - DNA, 427 bp, Zea mays
  Clone ID: cC-zmle18900086f09a1
actataaataagtatttgagtaaaagaaggggatttcacagacaatataagggaaactttttcatgtaaaagaacaaaaaaaacttaatataaataaaaaatttacaatttataaaattcgaaatggcttttattcatcatagttaaatggtagagttgatttgtctaggtcgtcaaagtattgatgtttgacagcttctctggcagttatgcgttgactggggtcgtacatgagcatttggccgagaaggtcgatgccttctgagttgatgtttttgacctggctgggcaaattgtagttagtccaggatgggaaggtgtctgaatagtcaggaagtttgctgacgcctggccaagtttcttctgttggtgtcatgagaacgcggaagcatctgaaaagctgatcgatttccgagtcgccgtgaaa

SEQ ID NO: 22258 - DNA, 334 bp, Zea mays
  Clone ID: cC-zmle18900086f10a1
ttttattttcaaaagtaaatatagtgaacaaaccacaggagacaagaaacaatacaagatactttcttgaggtttggttgcccgtcaacaatctatgtcctttgaagtgccacaagacactatgcagccaaattgatacaaaaggacactgaacacgggaatccaatattacatgtatataaatagtgagccatatacatgagggctttttaacttcaatgaatctcgagaccaaatccaggactggcgtcactataatccagagtttgggctaccggtacacctacaaaaatctcaagaggaatttcagcggacgcctgggcggacgcgtggg

SEQ ID NO: 22259 - DNA, 351 bp, Zea mays
  unsure at all n locations
  Clone ID: cC-zmle18900086f10d1
ggcacgcgngcgcccacgcgnccgccgaaaccccgctttagatttttgtaggagcaccggaaacccgggggcggattatattgacgccagccctggatctgctctccagattcattgaagtgaaaaagccctcatgtatatggctcactatttatatacatgtaatattggattcccgcgttcagtgtccttttgtatcaatttggctgcatagcgtcttgtggcacttcaaaggacatacattggtgacgggcaaccaaaccttaagaaagtatcttggatctgtccttgtctcgtgtggtttgttcactatatttacttttgcaatcaaaaaaaaaaaaaaagggcggc

SEQ ID NO: 22260 - DNA, 480 bp, Zea mays
  Clone ID: cC-zmle18900086f11a1
ttttattttccaagatctacagaaaacttgaggtgtgagctaaagctcatacagtgtaattggtttctcttgccgttgacctgatcatacataaaataaacataaaaaatgtccattcaaggtcaagacagttggttcgagcacaaccgtgctaacatgtcatcacaagtttcttcccttttcttagccaccaatcagtgatcaaaagcacgtttagcttccggcagcagtaggaatggcggttggtttcgaatcctcggccttctcgtgctccttgtttagcatcttattgttgattaaattgtgaagcgcaatgacgctccggatcagagaagacaggtatatcaccaacatcatgtcgtttgttttcactgcaaaggctttaattagctcatttacgttcaaatttggaaggagattaaagacatcctgcaaatggtacaaaatttcgtgattcagtgggagcttcccgtcaattac

SEQ ID NO: 22261 - DNA, 454 bp, Zea mays
  unsure at all n locations
  Clone ID: cC-zmle18900086f11d1
ccgtgcgcgtttgaggaggatgacaaggatcctacgatctggtttcttttttccaattaccacgagtcaatgtggggcggggtcaagaggattaatgccaaggagcatgttgttggctggtacagcactggcccaaaactaagggagaacgacttggatgtccatgcattattcaacagttatgttcctaatccagtcttggtgattattgatgtccaacccaaggagctgggtataccgaccaaagcgtactacgctgtggaggaggttaaagagaatgcaactcagaaaagtcagaaggtatttgtccatgttccttcanaaattgcanctcatgaagttgaggaaattggagttgaacaccttctaagggatgtcaaggacacaacaataagcacacttgctacagaggtcactagcaagcttgcagccttaaagggactcgatgcaaggc

SEQ ID NO: 22262 - DNA, 433 bp, Zea mays
  Clone ID: cC-zmle18900086f12a1
tttttctcttttttttttttttttttggtttttttttgtgttttttttttttttttttttttttttttttttttttttttttttttttttggggggaaaaccgtcctttttggaggcccccatgacaaaattcccaaggggtttttttaattcccccagggtgggaaagggggctaattttccattcgagggggaaaaatgcaacttttccccaagaaaattttgcggcttttttttgctaacccccctttatttaacccttttttttggggcccccaaaagggacatggtagaggggggctaaacagaaaccgaaccaattttaccgggaacaaaaattttgggacatagtattttgaattttttaacccaaagggcccaaaaaaaaagccttgtttgtcttccccctggggggggggccaccatttttaaa

SEQ ID NO: 22263 - DNA, 445 bp, Zea mays
  unsure at all n locations
  Clone ID: cC-zmle18900086f12d1
gggcggaggccctgtggaggaaagcagangatccgcnncctttttatttgcaaattnggagcagcagatgaggggcggggtgcgatgtgaaggtcagaaaggggaacgcctgttgaatatggtcgtgcccccgtcagttgtacaacatcataggctttcttttatggccatttaggttataaaatttcaatatcatagttccaaaattgttgttcccggttatctttgttcctgttctgttttgcttccgtcttccatgtccctctgtgtcgtaccatgaatgatggttcaatttagtgggtttaggcataagaagctgcagaattatgctgcggtaaagttgcattttctgcanctgaatgtgatactttgcactgtctccatccttgtgtacatttcagagatcctttctgtatcttcgtcttggtgctttcaacatgtacag

SEQ ID NO: 22264 - DNA, 494 bp, Zea mays
  Clone ID: cC-zmle18900086g01a1
ttttgttgattccttgtaaagatcctatgttgttcttccacccgaaagatatcatccgatatgttattcggaacgatagcatggaaatcctgtcttccattgttatcataattccttgcattcccaggtggcccatcagcaaaaacccaatcaaacagcaatgccctttcaggtaatgtaacttctgcataccaccaatcaccttccttttcatgagatttgacaagtctttcagctattgagagtccatcaatccagttgttgtaacctccatgcatccaaatctcagtgtcatgcattagtggtcttgagcttctgtgatagtacaatctaaccctgtcccctcctctgtaggtgttcggttctatgtaccataagttatcagcatatctactggctgaactcaacaactggcgcaatttctctttcttcatctcaacctcggatcttgcctgtgctctgtcagcctccatcgcggccctttcttcccctcg

SEQ ID NO: 22265 - DNA, 464 bp, Zea mays
  Clone ID: cC-zmle18900086g02a1
gacgctatgctcattacatttcactggacgaaattattacatacatctcctgatgcatcgtcagtacactccgttcctagaattccgcacgggaaaaatttcgtcatatattacacgcacacacgaaggtgaagtatagcaggagcttggcactgataatcaatagtcgtcgtaatcgtcgttgttcctgttgaggaaccgcctgacagctccgacgacggcgcccagcaccaagaagaggacgagcgtgtcgaagccgccgccgaccccgacggcgacgctcggcccgggggcgaagaagctgaacggcgaccagccgtaaccgtagccgccgaagaacgggctcccgtacccgtatccgcccagcggcggcgccaccggcgggttgatgtaaatgttcgtcctggagttgttgatccgagggccggacgaccggtgcgcggaccggaacgcctgcccgccga

SEQ ID NO: 22266 - DNA, 150 bp, Zea mays
  Clone ID: cC-zmle18900086g04a1
ggacaagatggggatagtcgaattaaagcattacagctagctgcaaacgctgttcaagaaccaaaagcaacaaaacatgatgataaaacgtcttgggaaggtagctctatatccttgcagataaaaataaaactagacatagcaaaaagc

SEQ ID NO: 22267 - DNA, 492 bp, Zea mays
  Clone ID: cC-zmle18900086g05a1
ttttggttgtaacaaaactagtaaccgtatatggctggccagatgttcggataagtcttaaataacactctggttttaacgaaaataacagttctaaatcgaccaggcaaacgttgcgagcatagttcagacaatgacgtgaacaagacgagatattttacgtttccactaggtatccctcaagcaaacacagaaccagccagacacatcatttcttctttgcggcagccttggtcaccttggctccagttggatccttcttctccacactcttgatgactccgacagccaccgtttgcctcatgtcacggacagcaaagcgaccaagaggaggatattcagaaaaggtctccactaccatgggcttagtgggaaccatcttcaccataccagcatcaccattcttgaggaatttgggctccttctcaagctctttgccagaccgcctatcaatcttggtaatgagctccgcaaacttgacagcaatgtgcg

SEQ ID NO: 22268 - DNA, 349 bp, Zea mays
  Clone ID: cC-zmle18900086g06a1
tttttctcttttttttttttttttttggttttttttggggttttttttttttttttttcctttttttttcctttttttttttttttttggagaaaaaaaaaaaaattttctttggtgacccaaaaacgtttttaaaagccaccccctggccccattttttaaaataaaaacgggaaccgggttttttttttttacacccatcccgggcttttaaaaccaaaccccaaccggttaccaaatgccgggtaaaaacccggggggttggaaccccttttgggggccccccccctttagggggggaaaaaatttcttttttttccacgggggggtttccgggaggaaacccgga

SEQ ID NO: 22269 - DNA, 382 bp, Zea mays
  Clone ID: cC-zmle18900086g07a1
ttttattttgctattcttgtgattcggtatgggatcggtcgctttgaaaccataaaattggagctgcttccatatttcacaagctgcgggtagttcatcactccatgtgcaaggcgcttcgatgatgtcattaccttcacgagcatgatcgcgccctgcgttactagcttgttcacaggcttctaaagccgcacgattagctgctgcaccaggggcatttccccaaggatgtcctagagttcctgcaccaaattgcgatacggaatcatatccaaagatttcggacaaagctggcatatgccatacatgaatacccccagaagccaccggtttcacacctggcatggatacccagtgctgagtggaaaagataccgcgagaa

SEQ ID NO: 22270 - DNA, 489 bp, Zea mays
  Clone ID: cC-zmle18900086g08a1
ttttattttcaaaacaaattttattgggatcttttgtgaatacactaacctatagcataccgagtatgataattatacagctatggttactatacaaacaaatccctgcggacaaaaataaagagagagaaaaggattttattacaggatcgaagagtgttgttacacccaggctcgcctttaactatacacatacttttcttataagctttacagccagtaaacgtcatacttatatgttgtattgacgtatctactattgcatcagcagaagattattcacagtcgcgtttatgttggttgtcctcatcaaatcctctataattagctcgtcaggaatatgaggtagaacttcccgcaccctatctaccatagtgagtacctctgaaagacttccattgcctgtgcctgcactaccacggagccgcaatcccgaagcagatgcactacccggcaccattgaggaagtggatggaacaagagaggacc

SEQ ID NO: 22271 - DNA, 462 bp, Zea mays
  unsure at all n locations
  Clone ID: cC-zmle18900086g09a1
gccgcncctttctttttttttttcttttttttttctttttctttttctttggttttttctttggggttttcttttttttcttttctccccgcaaaggtgccatttgcatttgctttaaaggggtcccgtatgtccccaacacattatttaaacgggaggaggggtgggtctttaagatgcaaaatagccactgtttaaattttacacccgatgacccccccccatgtgttacacttaaatcatttaacaggggggggggtggatctaaagcggagaggccccacggacctccccgttcctcgttgagggcaaagggggtataatggggcaagagggcaccaaataagggcccaaaacaccccaggagagaccccccccagcaggtgtgttgtctgagcccgtaggctacaacccggggccctccggggacaagcccccgtccacaagcgccagcgggggccc

SEQ ID NO: 22272 - DNA, 365 bp, Zea mays
  Clone ID: cC-zmle18900086g10a1
aaggcgttaataacaatttttacccctaacaacccctccaattcaaagacagcaaaaacataaaaaaacctgaaaaaagcaaacgcaggggggacatatttttgtaaaaaaaaactgaacatatatagggcccaacatgggtaactggggtaacaccaaaacaccataaaacccccccaaaaagggaaaaaagtcggacccggggccccctccaagccataggaaaaaaccagggacgcttgaaccttgaccccccggacggggggggggaacccgaaattccctaccggtacctggaggcggaccagggggcccaaccgggaatcccagaacagctcggcgaaaccatccacattcccctatac

SEQ ID NO: 22273 - DNA, 304 bp, Zea mays
  unsure at all n locations
  Clone ID: cC-zmle18900086g10d1
ggagcatgaaggacgaggcgaccgccgcaaccgcctatttcaagttattgngccacaaaaccaacagggggggngggctcttatggacacaaggagaccacccgccccaccagggacccatgttgggtactatatatgttctattgttatagccacaactatagctgccctgcctgaactgaactcaggtttttttaagaaaaaactgtccaagattggattgcttgttaaagctaaatattgttattgacgtgttaaaaaaaaaaaaataaaaacaaaactaaaacataaaaaataaaaaggg

SEQ ID NO: 22274 - DNA, 478 bp, Zea mays
  Clone ID: cC-zmle18900086g11a1
ttttattttacaattactacaaacaaggaatccttatgataggagatacctccactggtggagcattcgtttgacggtttgatagtgacaacatacagctgcgacctgaacaacggtataagctaaagctctatttaagtgtcaaaacaccggagcaaaaattcaattcaagacaatgttccgaataactcagtttactagcaggtaaatgctgtttaacaagacagaagaacaaatgcagtaagatccccctactgcaggggcttctttactgctcacccggtgtagtcttgatgatatcagaatcaccaggatcaataatgctgaggcagcagacccgaaagtatttaccacaggcagttccaaggtcgacattgtttccatggaagtggtggacagtgaccttggccagcatagcatagtactcaatttcagacttacgaaggggcgggcagttgttagcgatgatcactagctt

SEQ ID NO: 22275 - DNA, 540 bp, Zea mays
  Clone ID: cC-zmle18900086h01a1
ttttagcagtttcgcgtccttcatttttatggaattacaaacgacacatctgctaacaaactatagggaatatatacagcaacgaccaatacaattgccaaataactttccgactatatatgtacaccggaaattgggcatagctatgtaatctggaacgacggtggaacagctataatagtggtataagtctgcttcacctatggttcaagaactaggacccccctgaggactggtaatgtaaaccagttcgttgcggtggagcggctgaaatatttcgcctcaccttatgattcttaggcgctaaaacccttgtggatagaactccaggggttggaaggaatgctggtgcaagcctgagcagcgaccttcgacactgcttcaggaaggatgccagcgttgcagatgtttgcgaaggaccgcatgtgcttcatcccatactgcgccaacgacccacattgcgcctcaaaagtacgaaccgtggacttgagacagctccaatcatcgaccagaggctcaccagctgcacggacggctttc

SEQ ID NO: 22276 - DNA, 362 bp, Zea mays
  Clone ID: cC-zmle18900086h02a1
ggggggcctgtaaagacccgaaaattccggaccggccccccaaattttcccaattttccctatattaaagctgatcaaaacttggggaaatcatggccccagtgggaacctgtgaaaaaaggatatttgctcacaacttcccaccctaaaccatccagaggaaaaccggggaaacccaggggggcctaaaaagaaaattaactgacatgaattgcctggcccctactgaccggttaaaactggggaaacccttccatccattaacattaaaaaatggggcaaaaggcggggagagtcttgttccccatggggccccagcgtggcacctcttataaccaaaaaaacggataacccttgactgc

SEQ ID NO: 22277 - DNA, 585 bp, Zea mays
  Clone ID: cC-zmle18900086h03a1
tccccccttctctttttttctcccccctttttttttttattttgggtcttctttttttctttccccccttttttcccccccaaaaaaaaaatatattacaccccctccccccctcctaacttccccccacaaaaaaaaaaaaataagtataaactttaaaaaaaaaaaaaaacgctttacaaccacaccagaaaccccctaacaaaacatcccaccaaacccacgaagaaaaaaaaaaaaacccggcccatttccccctcctaataaaacaccccccctacaccaataaaaagcaacaaaaacactgccccttttaaaaaataaacattggaaacacaccaccacccccaccccacacccaagagatacccctcctaaaaaaaaaaaaaaacccaaaaaacacaaaacacagaaactgctttcccaaaaaaattaaacccccaaaaagaaaaaaaaaaacccccccccttttaacaccctaaaaaacccccaacccttccaaaaatcccccccctcccccaaaaaaacataaaaaaccacctgcaaaaaaaaaaaaaacctccccctcaaaaaaataatcccccc

SEQ ID NO: 22278 - DNA, 297 bp, Zea mays
  Clone ID: cC-zmle18900086h05a1
ggagctaacggttttagagggccgggctaaaatcacagccttaagccccccctagccacctacacatatcacacggaatataatgagttgcgaggaacactccggaaacacccggcccctggccttgtactgaaccaacgagaaaacaagggggaggtcgacgcaggcgcccgccctcaccgaagctaaccttggtggccacaaaccggagggagcaacgcaagtgagctagactttctgccctgggaaacaatggacaagagcccatggaccggagccaaaggaccagtgggggca

SEQ ID NO: 22279 - DNA, 348 bp, Zea mays
  Clone ID: cC-zmle18900086h06a1
ggggggaggcatccaataaggtaaaaaaaagttgaacaggttacatcccaatccatccatgtgcaaagcagaggaattacatttatacacggggctgatcaccggtggagtgaaatgaaacaaggaccacaccacctacataccatgcagttagagaggaggatcggccggagctatatatatacccatctttgatgatttctacttgaaaaagtaggggaggtcgagcacgtaaaggaaaaagtaggcccaaaacacgccggaaatgccgcctaaaaaaaatcccccggtgaacttggcccacccgtcggaggtctgcagcttgtgggcctccttcttcctgccggt

SEQ ID NO: 22280 - DNA, 466 bp, Zea mays
  Clone ID: cC-zmle18900086h07a1
tttttctcttttttttttttttttttgttttttttttggttttttttttttttttttttttttttttttttttttttttttttttttttttttttttttttttccccctccccggggggtaaaaaaaaaaaaataaaagcgaaagaaaaaaaaagcggccccaaaaaaaaaaaaaatcccccccaaaaatttttgaaaaaaaagtccccccccttttggctttttttttttttaaaaaattttttttcccccggggggtaaatcccgcccgggaaaaaaaatttttttttttttgggggggaaaaggtttttttttttccaaaaacttttttaaaaaaattagggaatttttttccttggggccaaaaattggaccccttggggggtttaaaaaaccggggggaaaaaaattggggcctttttctattttttaaaattttaagggggggggtttaaaattttgtta

SEQ ID NO: 22281 - DNA, 405 bp, Zea mays
  Clone ID: cC-zmle18900086h08a1
tttttctctttttttttttttttttgggttggtgctgggggattttatttatattataggaattgtccaataaaggagagaaggggaaaaaaagaacaggggaaaaaacagctatactttggtggggggggcaccggggcttttatttttgcccacacgcaaacggggctttgaggccggctccggctgctactggaagattcttttttactaccggtactacgcaaccaaaaataaaatttaagggcgcagccagaaacaaatgaaaaacgggcttgccgtcccccgcgacgagagaaaacgcctggcccccggtacaaatcgttcagacaaaacattacattacattgcacgggtggcaatcaaaaaagccgctgcgcggggggtttggattaggtttggcct

SEQ ID NO: 22282 - DNA, 378 bp, Zea mays
  Clone ID: cC-zmle18900086h09a1
gggaaaaaagttcaaaaataaaagccctagggctgaccccaatgctcaggcacaacctcacttatcgagaaaacattttttattttcttattactaaatacctcacagaccaacccccttgggaacccggggggccttttatttccccagacacacacgcaacacacgaacgggtaggttttcatgaatcaagaaccccaaagttcattccgaccggacaagggagacctgacaacatgtaaccctgcctgggcaatagggtcttggcctggcacatgttctacgggtaacctttctttgggatggccgccagccttggatacatgcgggccattgattgatagcccctgatatcaccggaccgcaggagattgcctg

SEQ ID NO: 22283 - DNA, 62 bp, Zea mays
  Clone ID: cC-zmle18900086h10a1
tttttctctttttttttttttttttgggttttttttggtttttttttttttgggacgcgggg

SEQ ID NO: 22284 - DNA, 262 bp, Zea mays
  unsure at all n locations
  Clone ID: cC-zmle18900086h10d1
gggcgaaaaaaaaaaaaaaagaaaaaaaaaaaaaaaaaaaatttttattattaaaaaaaaaaaaaaaggggggggganggaaagaaacaaagaaaacgaacgcacccacccaacgaaaaagcccnacaaaagggacaccaaaacaaaaaccacgggccgccgccaaacaacgacgggacgggaaaaacccgggcggaacccaacaaaaacgccgggcaggaaaaaccccaaccaccagcgggcgaaaaagcgaaaaggcccg

SEQ ID NO: 22285 - DNA, 83 bp, Zea mays
  unsure at all n locations
  Clone ID: cC-zmle18900086h11a1
ccccaagagaggagcctctagagcggccgccccccctttttcccccctttttttcccncccccccccccgggggccccccggg

SEQ ID NO: 22286 - DNA, 365 bp, Zea mays
  Clone ID: cC-zmle18900086h12a1
acatgggacaaaacaattggctgcaggggaataaccacaaaggatgacacaaataaacaccaccataaagtcatacataattctaaacacactacgattaatgagaaaaagacttggcgccagcagagcctccctctatatactaatgaacccccacagcagcacattaccacaaggcctaagcagctacaaaaaacccaaaacatggcgtacaggagaaaaaatcacaaattgcccatgaccacgacttcaacatagaaaccccccaccgaccttatcaccccctctcccacggtatgtatacaaaaccaatcgttaccaggttgcctaaccacccttgattgttgtgcttccgacgcgtggga

SEQ ID NO: 22287 - DNA, 225 bp, Zea mays
  unsure at all n locations
  Clone ID: cC-zmle18900086h12d1
cgggcgaaacaaaacaaaaagggggggcgaggaaacccggatttgattttcctcgccgaaacaccgcggcagggggggggaggaacaaaggagcaggaccngcatcaacaccaagcccgacgggacacagcgggaccngagcggcgacatgaccagccgcggaaagaagaaaggggcctaccccaaggggaaaaaggccacgaacggggagaagacctacgaaca

SEQ ID NO: 22288 - DNA, 385 bp, Zea mays
  Clone ID: cC-zmle18900087a01a1
ggggagcctctagagcgaccgcccttccccaaccccacctttttttttttttacacccccccccaaccccaggaacggggttaattttttttcctttaaaaacccaaccccttcccccaaaatacaattcttccttagcatatcaaaaccccaaacttgttttttgcaaacccacaagaaaaatggccaaatttacaacaaaaaccctatgcccctccaaaaaaaaaaaaaatccccttttgtcaaaaatacaattttcaacccatacataacaccttttatacgccaaaaacatctacctgaccccaggttcaaaccccaaaatcctaacccggcccggggggcggcccacctttccccaaaaataaccctaataacaacttac

SEQ ID NO: 22289 - DNA, 341 bp, Zea mays
  Clone ID: cC-zmle18900087a02a1
aagcggcagaaaatgaaataggggaggggttaacattgggcgatcgttgatcccctctatatatgtagatgcacaaaacagatagttctcgacgcattcacattgctcgggtgcatatcggttggtccgtcctagtataggcctagaatctatatttatgatgacacaggacttggccgccccttataattggcttagccctaatttttcactttttccatgtgaggaactctcctgagacaaagtcttcgtgggcgcccatcaacattatggacccatttgcaagcccttccttgaccaatgggtatgtcttgaggttctccacggacacatatacggcc

SEQ ID NO: 22290 - DNA, 229 bp, Zea mays
  Clone ID: cC-zmle18900087a03a1
gattttctttttctccgcggacgcgaaagcagggggggggcttccaaaccacatcctgcaagcccaccaaacatgcctaaagggagacggatacaagctagacatattgatcaacaaagctgttcccagcccaaaaacgttatgagacaacaatcgcacaccacaaaccagccggaactcaagaggaccaagccagctgggcctaaaagggacctgaaatacacaaatt

SEQ ID NO: 22291 - DNA, 333 bp, Zea mays
  Clone ID: cC-zmle18900087a04a1
gagggggaaccaaccaacaccaagcaaaaacctgatgtggtttttatttcatgaagcaacagttcgtagtacaccagtacaaagcctttttattgatcaaaatcgctaacagcacacacattatatctccgccacaagcttgggcttaaccagcgccaaatcaaaggcggggaaagagtgaggagccaacgtgacctgcatttgctccgcggggttgctcaagtggttttttaccggcgcaacctttttcgggttactgaaggagtttttgtccataacctttccaaacctgaagacgggggcggttgaccccaacgcgttgactcttggccc

SEQ ID NO: 22292 - DNA, 316 bp, Zea mays
  Clone ID: cC-zmle18900087a05a1
gggggtggggaaaaaaaacgggggggtggggtcctgctacaccaggcatggggcatttttaaagctgtttaacattacaaaggttgggggtcaaaaggttccaataaaagccccttgaaagggaatgcttttttgctttaccagctaaaacttaaacaaatgggtttgaactcctacaaaactcagggaaatcgcaacacatttcctaatctgctttggtgggtcaacacatctttttaatgcgggtcctttactctccgggggggtaggacgggtttttcgtgcccccctttggtgccaataggagggacaagtt

SEQ ID NO: 22293 - DNA, 417 bp, Zea mays
  Clone ID: cC-zmle18900087a06a1
gttttatctttaagtctcgctacgtagcagtgcgggaagggaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggagggtgatccactcccgctgggccatgctgggcgcgctcggctgcgtcttcccggagcttcttgccgcac

SEQ ID NO: 22294 - DNA, 423 bp, Zea mays
  Clone ID: cC-zmle18900087b02a1
aaagagaaacttgctattagtgggctggagattattcccatgaaagagagagaaaaaaaaggaaaggcgaacagtggacactgacgcgttcggaataaaaaggtggcgccaaacaactccggcgacgacgagacacccgacgactacgaccacgacacgatacaacaccgggcggggggggttattatgtaaaccaacgccggccggccactgacaacttcctggcgacggactcgccttgtttcacccggggcgggcgggcgggcacgtcatcagacggtgagcccgcgcatgaactcccactcctcatcgtcttcctcctcggcggcgccggcggccgaccgctccgagtcgctgctctcgccgccggacatcacggcggccttggggtcgaacaccaggtacggcattgcgcccaaagcc

SEQ ID NO: 22295 - DNA, 464 bp, Zea mays
  Clone ID: cC-zmle18900087b03a1
cgacgctgatccttagagcggcgcggactctgcccgatttctttgaccgggcagctctgccgagctggcggactcttccggagtaccctattccgacaaggatgggcattttaataatggtttcgtcgtttcaacaatgtgctatcaaaggaaatagtggggactgctccaaaaattcaacttgtgcacatatatttgaagaaatccatggctaggagggtttatgacagtagccagttggtctgctcagtaacgactagttaatgtcctttggacaaggtcaagaatagctctccatggatagaaaagtccatctgatgatgctgcacagtactttgttagctacgagtcagatgatgggtatccatgcttagataagccaagatactccacgtaatagaaaactgaaacccggagtgcattttagtcatgtgaatgatcatgcggcccagtcttttctttat

SEQ ID NO: 22296 - DNA, 435 bp, Zea mays
  unsure at all n locations
  Clone ID: cC-zmle18900087b04a1
tcctttttttttttttcccccccnaaaaaacagggggggcggggggcttactttataatattggtacagcatgaagtccaaaccactgtaacatgagtacacgaaaagtatcttggtagagacatatggcctcccctctcgttatataaagccctactattaaatcagttgcgtgattaagcagctttgtttgaatcattaagcaactctaatttggttttttttttgggtaggaaatggcaaggctcatcaatcagggcacaatatacctaaacgtctctagaagcaccaaaacagtccatccgaagattagggccccgcttgaagctcgaggatgatgtggacgagtaggctcatgtcgttccaaggatccatcgctgggtcaagtattttgctgcatgcgcttgtaagcagaccacgaaacaatgggctttt

SEQ ID NO: 22297 - DNA, 352 bp, Zea mays
  Clone ID: cC-zmle18900087b05a1
gggggggggggatcgggtaaaataaataaaggatttgttttgtagatgacaccgttttgctacgacgaggatatgggggatgtttacattgccgggtccataaatttcctctgtatacggggttgcatggatctttaggacaagctagtgtgtgctggactggtggctaacatcattgcgatccctgggggggtatttgtacctttgtacagggggtttgacatttttacgcaggtactacaaacaaaatgttgacatgtccagcaaggccaaaatgatacccaccaaacgaagttttttttccctcaacaggatgcccttttttttaatcctttgcagacttttcgccagc

SEQ ID NO: 22298 - DNA, 423 bp, Zea mays
  Clone ID: cC-zmle18900087b06a1
gaacaaaaaccttgctcattcgggtcgggtctcgtttcatagcgggagcaaccaaagcgaacaacagggtaccaacacctaatccaaaggtagaacggacactaacacggtgacagaagcgaacggtaacacgatactatagatagataagataactcggccgaagccaggatgggcccacacatcagtccctccagccgccgccgccaccggcgccgtagccgccaccggcaccctcgcgccgaccgccgtagccgccaccgcctccgtagccgccgtcgccacctttgcgccgaccgcccgaaccgccaacgccgccataaccgccgtcacggcgcccgccaccataaccgccgccgccgccgggaccgccgccgtagccaccgccgccaccgccaccgccacgggactgggcctgttaac

SEQ ID NO: 22299 - DNA, 329 bp, Zea mays
  Clone ID: cC-zmle18900087c01a1
tcttctcttttttttctttttctttttttttttcggagaggttttttttttttttttttttttttcccaaccccgggggggaccccagggcgaacccttgggtcaaacagaaaaatggggaccggcaccgggaggcccaccaactttacctaaaaaaagccgaataaaaacctggggaaaacaaggaaaaaactgagtcccggggaaaaaaggtttcgcataaaaatgccaaaaaaaaaacaagccgaaaaaaaaaaatggaaaaacctggggccccaaaaaaaaaacctaaataaaaagagggggggcgcccttacctcccccttttc

SEQ ID NO: 22300 - DNA, 430 bp, Zea mays
  Clone ID: cC-zmle18900087c02a1
accttgcatcctctagaacggccgccctttccccccctcccctctcctttttttttcacccacccacttcacatctgggtttggtttaaaataaattttttatactccccacccccctaataaataataacccaaaccaccaaaaaaccaaataaacaaaaaaaaaaaaaaaaaaaaaaaacgccccatcttaaaaaaaaaaaaaacccaaacaaaaaacaacaaccccccccaaacaaaaaaaaaaaaaagccccaacaacaaaatttttaaaaaaattcaaacaaaacttacaacacacaaccccataactaaaaacaaaaaaaaaattttgagaaaaaaaaaccacccacaaaaaaaacaacaattataaataaagaaaaatgggataaacacacaaaacaccaccaaaaaaaccacctacacccac

SEQ ID NO: 22301 - DNA, 271 bp, Zea mays
  Clone ID: cC-zmle18900087c04a1
ggtgtgggggacaaagaacacaatttttccttgtccattgaacaatagtttacattatgggacaaaccgaaaaccagcgggcgctcacatgcatccggacacctaaagggcaccgggggcgccttccttactttccggggaccaaattgggggcgtaggcccaaacctttttgttgacggggtcggcaatgtggtcagcgaggttcttgagcgggcccttcccggggaccatggcctggacaaaaaatcccaacttggacaacgggggggg

SEQ ID NO: 22302 - DNA, 387 bp, Zea mays
  Clone ID: cC-zmle18900087c05a1
accaaccatagcacatatacggggcggattatcatgcagtggtccttggcatcagaaaaaaacacctaagtgaaacttcctcatcatacagacacagatagtcctttctataagagctaaaaagacttaaactaagtggaaaaccatacactaatgctgcctcaataccttctctgatgtatacttcttaacctttagctttgtgttccttcttctaggggcttcggaaatattctcattagcttcatggacataaataatttcaggctcattaatagcttgaacatcatgctcatcataattggcagactttggctcactcctagcatcctcatcctcttgctcttccccctcatcttcatattcatcatcaaaatattggtgagc

SEQ ID NO: 22303 - DNA, 219 bp, Zea mays
  unsure at all n locations
  Clone ID: cC-zmle18900087c06a1
gggcanaaaaaagcagaagacgggtgggggtttatatcaccacaatgtatatgtacaacaatctggcagatgatacatagtctgtccttattaacaccaaacatgtgatgtgcaacactgtcagcagatagggcacaccagttacaatgcacacattaacgtccaaatcaagcccaggggttttaagtcttacaagcccgtatacaatcatacaacaac

SEQ ID NO: 22304 - DNA, 287 bp, Zea mays
  Clone ID: cC-zmle18900087d01a1
attcccatcaccaaatctcggggggaggggagtttatgacccaacaagcatcccacctacaaggatgcgaacaagttacaagctcaaggcatcgattaatcgtacagaggtggcggcgcgccactgcctcctacttcttgccacctgccttgttcttgttgttgtccgtggaggtaccggtgccgccggccgctgcctgctgcgccttcttggccgccttctcctccagagctttcttgtccctctcgcggcgctgctccggggtgagcccgtcctgggaattcttg

SEQ ID NO: 22305 - DNA, 276 bp, Zea mays
  unsure at all n locations
  Clone ID: cC-zmle18900087d02a1
ggaacaggncacatcccaaggggatgggttgtgcaaagcaaaggaattacatttatccacggggctgatcacggtgggagggaaaggaaccagggaccacaccacctacataccatgcagctagagaggaggatcggccggacttatatatatccccacttttgaggatttttacttaaaaaaataggggaggtcgaccacgataagaaaaaagtgggcccaaaccccccggaaaatccccccaaaaaaaaaatcccccgggaaactgggcccacc

SEQ ID NO: 22306 - DNA, 342 bp, Zea mays
  unsure at all n locations
  Clone ID: cC-zmle18900087d03a1
agagcggccgccccccccccccccccctgttacagtatgaaaacagcaaccccccaggggggaaggacaagacacgnanggncacaagaccccaccaaaacacggacagcagcagacgaacacagaagcccccacaacccacgaaggaacgggcgccaccaancgcggacacggaaaaaaaggaggaaaaaaaaccccangcccggaccacacccacagggagaaacccccacaacgggagacaggcaaacaaaacacggacgcgccggcccgggccccaaagacaaacccccagcacaagggccggaaaccacggcacggggggggggcaggaaagaaccc

SEQ ID NO: 22307 - DNA, 172 bp, Zea mays
  Clone ID: cC-zmle18900087d04a1
cacagggctcaatatcagagggggggggggatttaaacatttggttaataattcaataaggagtactttgcacgcacaacaatcctgcctttctcgacacccaacttagcacctgtgatcagccaatggccaggcgcatcttgtgggcccttgaatgtttctgtcaggtcaa

SEQ ID NO: 22308 - DNA, 252 bp, Zea mays
  unsure at all n locations
  Clone ID: cC-zmle18900087d05a1
cccctcccccccattttttgtttatgaaaanaagaaacaaagccaggggagggcggtaattaataaccagatacataccacgccttaatgtaaaataatgaaatcatggtcgtacacaaaatgatctctaaacttataccgccaaccatcatgctttggcttctttaacaacaacaacgtatatattccgcacggacacaaaattgccacttggccgcggagggggcccccccaaaaaaaatatagctgggg

SEQ ID NO: 22309 - DNA, 175 bp, Zea mays
  Clone ID: cC-zmle18900087d06a1
ggggaagggaaaaaaaaaaagccttttcttccatcaacagggtgttactatacaccaagctaggggccctagctgcggtaaaaaaaatcccctctagggcccactcactttttccctactgaggggaggggtccattttttttttacttaactaactttgaccgtattactaata

SEQ ID NO: 22310 - DNA, 321 bp, Zea mays
  Clone ID: cC-zmle18900087e01a1
cccccccctctttaaaccctccacaaaaaacgaagggaaaataaacccgttggaagaagggttaattacctacagggcacaacttacaacccaccccacaaccgggattaccattaaaaggggccaaaccccccattggggggggaaaaaaaaaaaagaaaaaagcacccctttactactaaccccttcaaaacaatacacccttctttgggccaggccccacaaaattccttgtttagccgggggacctgtacaaaacccacccctgcgggcaaggggcggaaaaaaaaacaaagacccccccccccggccccaaagcaa

SEQ ID NO: 22311 - DNA, 391 bp, Zea mays
  Clone ID: cC-zmle18900087e02a1
gggggaggggccatccatcatattataaataaacaatccgggacaaacagatcagctcccgaaatcgacaagttccaatgcctattataacggcaagggcgacagcaggtaccgtctttggaagccaagccagcaacgaccgtcgaccatacatgacatccaaataaaaccggattgggcgttttctccttattcttttacgtaacacgaagtacgttactactacagctcacacagttacgtcagttcactggctgctcgactcatcatgctccgccggctgatgcttgtttaacacaaaggccccttccaggctcttatggacctctgctttgatcttttcctccttggtgcctctcttcagtttcattaaaatgtcaaattttgcaaa

SEQ ID NO: 22312 - DNA, 257 bp, Zea mays
  Clone ID: cC-zmle18900087e04a1
tttttctcttttttttttttaacaaaattgggggatggggtaattaatattgagcatttaacccccccccagcataaaattgaaatgctaaagaactatacatatacactccatcaaaacattaaagggggcaaattacaagtgaaactaaataaaaaacattctaaacttgaagaaaaaacttgtgctctgaaaaaggaaaactaaatcaaacagagatcatatatgaactcaattcatttttcccggacacgtgg

SEQ ID NO: 22313 - DNA, 451 bp, Zea mays
  Clone ID: cC-zmle18900087e05a1
gaagctggaacctaaagcggcgccttcccctttttttttttttccctctttttttgggggaggggttatattttatttgtccctcccaaacaaaatataataaaaaaaaaaaaagagaaaaaaaaaaaacgaaaaaaaaaaaaaaaataaaaaaaaaaaaggctcaaaaaaaaataaaaaaaaaaaaaggggaaaaatacaagaaaaaaggaaaaaacaaaaaaaaaaaagggcacgaaagtcaaaaacaaacaaaaaaaacaataaaacgcgggggggggggggggaaactacaacctcataccaaataaaaaaaaaaaaccacaaaaaaacaaaaaacataatcacaaaaaaaaataaaacaaaaaatggaaacaaaacaaaaaaaaaaaaaaaaaaaaaaaaaaaaagaaaaacggaaaaaaaggacaaaagaaactaaagaaacaaa

SEQ ID NO: 22314 - DNA, 326 bp, Zea mays
  Clone ID: cC-zmle18900087f01a1
gcatatactgaaattttgaagggccacaaaatgtatatccacacacatttatgtctacatctttatggggataattccatcacctttttttccggcaataaagaaacatgaatattttatttccatggggtaacagccaattttggcaactgcatacgctgaacatttaatttgcactagttttttggaattggatcataaccctggggttcttcaaggcgaactggagctttagcagccaccacaacaggggccccaaataacacgacaaccaaggctgggaagttcactaaaaatgcctctgggccatatttgtcgagacctga

SEQ ID NO: 22315 - DNA, 452 bp, Zea mays
  Clone ID: cC-zmle18900087f02a1
tttttctcttttttaataacgacggtaggttggtaagggctgaaactgaagtatctgtgttacatgcgtatgttcacagcagatgaactttacagcgttacatgtgtatgttcacggcagcaccctgtgtgtatgtgtatgcgtatgcgcctgcgcaacctactacttcgcggcctcctcctccccctcctcttccttccagaccggaaggatgccttgcccagccagcctcttgtagacccagaacaccacgtacttggccgttatcctcttctcatccatcaggaacggctcgatggggctcacttcgttgctgtaggacgatagcgcaaagcccttccgtcctgtgaggtctccttttggaaagaaggcccaaaaataataagggacgtcctttcttatgaaagatccctccagcgtgttgtttttgaaggcgagctgcacctgggaca

SEQ ID NO: 22316 - DNA, 441 bp, Zea mays
  Clone ID: cC-zmle18900087f03a1
tttttgtataattgacagcatatttcattgaggatgggcacaaggaccaaagcatgcatgcaaatacctacactactggtacaatctctgagcccatgctcccttcttcacaaatactggtacatctcctgcagtacatatacgaatacgtatgtctacggtacacgcatacaagtatgtatatgccctcgctcacttgccggggacgaagttggtagcgtaggcccaggcgttgttgttgacagggtcagcgaggtggtcggcgaggttctcaacgggacccttgccggtgacgatggcctgcacgaagaagccgaacatggagaacatggcgaggcgggcgttcttgatctccttgaccttgagctccgcgaacgcctccgggtcgtcggcgagcccgagcgggtcgaagctgccgccgggtacagcgggtcgaccacc

SEQ ID NO: 22317 - DNA, 360 bp, Zea mays
  unsure at all n locations
  Clone ID: cC-zmle18900087f04a1
ggaatctaaaagggggggttcttatttttgggaagccacaaacatcatccaaaaaacttcattattgaactataactcataagcaatctaaaagagggcaccaccaatgatgggttgttggtaaaaccctgttgggtttgtcaaagcaagttggttgaatggcagcaattgttgcacttgtaagagggtgccagcgttaggcgcagcgtgcaggtagaacggcaacaactgttgctgtgtcaagaaggcaatagggctcacatcanctaactggctgaatggtggtagttgttgctgttgtaaataaacagcagagttcaatgctgccacttggttgaatggaaaaaattgctgggggta

SEQ ID NO: 22318 - DNA, 283 bp, Zea mays
  unsure at all n locations
  Clone ID: cC-zmle18900087g01a1
ctcccccccccttttttttttttnnnccgggcccaataacaccggtacgggtttgttgttacaggcagcaggctggccatgcatgaatcatgaccgatgcaacgcttcaggttcctttacaacacgcatgcatctagctttccacagcaaacaactggcggcggcggcagcaggtatgctgatgcaccaacgttctagtggaacttgaggctggtgagcactttgttgttgacggggtcggcgaggtggtcgagcaggttctggaacgggccaacgccggtga

SEQ ID NO: 22319 - DNA, 311 bp, Zea mays
  unsure at all n locations
  Clone ID: cC-zmle18900087g02a1
ccttttctttttttttttttttcccccccccttnaagcctggaataggggggatttccttcttcccttttatgtatgcatatcactcggaatgtcttgggagacaaagtacagcagcagtcagctgagcttcttgagcacagcaaaaaaaaaaaaaagggtctgaacaaaaacgagcaggctactgcaggccgtacacgagcagagctcctaccccagcgatgccgatcaccaaacttaccatcacggggataggcggcaaaacgccccccatggccttcccgggggcagcgtcgtaccttgcaaaccgct

SEQ ID NO: 22320 - DNA, 319 bp, Zea mays
  Clone ID: cC-zmle18900087g03a1
gtctttgttttttaaaccctagtaggttatgtggacaaatgggagatttatccctgaagggtctcgcttgtctatataaagaacatgtacaccttataagaaaaacataaagaggccagaggcccaatctaaaaaaaaaaaaaaaaaaaaaaaaaaaaaaaaaaaaaaaaaaaaaaaaaaaaaaaaaaaagaaaaaaaaaaaaaaaagaaaaaagaaaaaaaaaaaaaagactttaaaaaagttcctgtaaatgaaggagtaataaagatgaccgtgtatcattctaaaatatcctacatgggggggggggggggggcc

SEQ ID NO: 22321 - DNA, 225 bp, Zea mays
  Clone ID: cC-zmle18900087g04a1
aggaaagagatttattggtagcgtaggggcattaattcatggtactgtcgtaaccaggcgagagtcgcagtgctcatcgctcataatccatagagggatcgctctgaatcgaagagaaatgtcgaaccagtgctcaagtacttagtacttagatggagcgcttgttggcctggggggagccctcgcgcttctcgggggggatcttgcccccagcgcctttaaaac

SEQ ID NO: 22322 - DNA, 205 bp, Zea mays
  unsure at all n locations
  Clone ID: cC-zmle18900087g05a1
ccaccaaaaancacatttaagaggtgggtgtaggctcctaaaatctaaggacccccccttaactagatttgtcataaaatcccgggatgcgtacagaatatatataactaacaggagaaagtacaacactggataaatgaaaatacctacaccaccggcgttctctgacgcattagaaaatctatctaacttctaaattgtaact

SEQ ID NO: 22323 - DNA, 177 bp, Zea mays
  unsure at all n locations
  Clone ID: cC-zmle18900087g06a1
cccccccctttttttttttttcccccccccnnaaaaagaaggggggcgtactgctgcaaaaaaattttgggtccaacacagaggacacaacaggtccattaaaccaacgaagcctcaaccacgattcatgacacacaaaccacagatgtttattagacgacgacatccatatagagg

SEQ ID NO: 22324 - DNA, 380 bp, Zea mays
  Clone ID: cC-zmle18900087h02a1
cccccccttttttttttttttctcccccccctttttcttgggggtggaaaagttgcgatttccattgaggcccccccaaaggttgacagggttggaaacattgctgattagtacaccactccctccacacgacccgaccactagtacaaacttccgagaagagactgcgccccggcctatccggccggccggccgcctaggccccctccccccggatgcggcggccaacctggatgtccttgggcatgatggggacccccttggcgtggatggcccaaaggttggtgccctcaaacaggccgacgaggtaagccttggcggcctcccgcaacgcggcgacgggggaggactggaaccggaggccggccttaaagccctgc

SEQ ID NO: 22325 - DNA, 349 bp, Zea mays
  Clone ID: cC-zmle18900087h03a1
aaaacgggggcgtttttaatatgaaaaaaggaaaggaaaatggttttcaacatctagtgacctgcaaaatagatgtccaccgtacaccttaaaatacggcccatatgtgctcagctcaatgctccaaaattgtgctaaatcgaacatgtacgaactaaactgtattattgcagacctagctgcctatagcagcgtactgcccaccgcccacataatccactccctccctagtatgaaggatgcccaaacaggaccacctgcgacgtaagacgagcaagccaagcacaagttcaggccgaaagcccaagggatgctgttgcaaccttgacttgcctgcgacctaggaagc

SEQ ID NO: 22326 - DNA, 239 bp, Zea mays
  Clone ID: cC-zmle18900087h04a1
gaaacgggggatggggacatcttttgttctgctgtaatacatactacaagtagagtcaaatgcaatacaaatgcacgatttttccatgagcagagtagtacaatcacatattaccatggcatgccatgatcaatcgtgcatcacaatcaagccatagcataaacatgttctccgcccgggtttttttcttttgaacggggaggtgaaaaacacgggggggggcttttttgggggggggg

SEQ ID NO: 22327 - DNA, 397 bp, Zea mays
  Clone ID: cC-zmle18900088a05a1
ttttactctctctttacccattaaatttttattggggcctggttttttattaaatttctttattccccccccaaaacattttgtaataattaaaaaaacaacaggttccccaaaaaaaaacctaatcacacacaagaacacacaaaaaaaaatcaggaaacataaaaaaaaaaacctggcctaacaaaaaaataaacaaacccacataaaaaaaaaaatataaaccgcaaaccaaacaaaaaaaaaacccgacacaaaaaaaaaaaaaataactcacccaaacctttttaaacaaaaaaaacggggggggaggggagaaaaaatagttctcctccaaaccaatgaaaaaaaaacaaaaaactcacttgtcaaataaacagtgttgaaattttttaat

SEQ ID NO: 22328 - DNA, 365 bp, Zea mays
  unsure at all n locations
  Clone ID: cC-zmle18900088a06a1
tttttcttctttttttttttttttttttttttttttngggttgggttttttttggaaccaaaaagggtcccatggacacgtacgcacgcacacacgttaaaaaggcaccacctggacctgccggccgggggggccaacgagggtggtgagtctgaacttaacaacggggacggagggaactaacccatgatctgggcgagggcgccggggtttttgagccccagcacaaagcccacccccgggatggggcccacggggcccaaagccaacgtgttggggagggtgaaccccgcggggtcacccggggggggggggggggtgcgccccttcagctttaaccccccccgtgcctttgggggttttgg

SEQ ID NO: 22329 - DNA, 348 bp, Zea mays
  Clone ID: cC-zmle18900088a07a1
ctgaaattatgatcgatttgggattagtcttttactatgctccagagttggaaggggcaatgaatatatgaccctaggcttcaaaagaaatgcctggcaatgatacatcgtacaagggcactaatcccttgttccgtgcagcttgcagagatttacatcgtgcagacatacaatacaatcaccagaattttgtttcatcttctcttcaggaggaaaggccaaaataacagtcttcctgaagaactacaggcaacccaattaggtcactttggagtaggatttagacacgcaacgccactctgacttcttctcgctcacaccgagcccacgcgtccgcccacgcgttcg

SEQ ID NO: 22330 - DNA, 515 bp, Zea mays
  Clone ID: cC-zmle18900088a08a1
ttgtttatattcccatgtattgagaaaaaactatgggatactacaaaatcttgaccatgtggtgattactgattagttttacaaatcgaaaatcacaccaatgttgaactaaagagtgagctggaggtgtgagaggcccgggaaaacactacaatgttgctacaattcagctgtacatttttcatatcagggtgagttgcagctttgggcgatgaggctgaggttcaacaacctccatatgaatcctgacagtctggaggatagcatagctgatgtttgttccgggcttggttactctctggtgcacctcgtcaacaacccaatcaccgcctttgtcgcccttcggagtaaggtagatgggcccttctatgccaaactttgggacaaatactatgaaaccatttgccttgatctttactatcctagcttcagtgtcagttggccttgtcttgaaatatatgtgggtgtgggagttcaactgatgctctgcttgccatttgggcatttttgtgcct

SEQ ID NO: 22331 - DNA, 495 bp, Zea mays
  Clone ID: cC-zmle18900088a09a1
ttttgttctgtgggggactaaatgctgtaatccgaggggatgcggcaagagatccattcaacaattagcaaatgtctggaacgaaatgttcaatccacacaatgttgccaagaactctataaattctgacggaacacgataaaagacaagtacatcaaaatcatcagctactaagaattcagatgccgagtacagctgttgtggcatccttactgctcgcccggtgtagtcttgatgatatcagaatcaccaggatcgataatgctgaggcagcagacacggaagtattttccacaggctgttccaaggtcaacattgtttccatggaagtggtggactgtcaccttagccagcatagcatagtactcaatttcagacttccgaagcggaggacagttgttagcaatgatcactagctttgacttaaaattcctgagggtcctgaggacagtcttgtagccgagcgtgtacttgccgctcttcatcacaagctga

SEQ ID NO: 22332 - DNA, 336 bp, Zea mays
  Clone ID: cC-zmle18900088a10a1
gtgtgttcatatcttttcgcatttgacatacgggaccattggtgaaaaatacatgcagctcctgtcctcaagactcgggcagagcacacatcctttctaatggtgtatacatatactttccctgtctatcgtggccatggactttgcaataccatagataccatacgaaaacacgaaacgggagaagcaaggaaacgttacagatcgtacatgtggatacaacactaaaacaagcgttccacacagctagcacggcactgatcactgtgcctgatcccgtggagtgaagcggtgaacggtccggcccacaggacaactgaactgaactgcacaggc

SEQ ID NO: 22333 - DNA, 378 bp, Zea mays
  Clone ID: cC-zmle18900088a11a1
gggttggggaaaaaattaaaaaaacggtttattttgaagatttaattgggattataacacatgaggggacccccaccccccgttacatggaaaaaacaaaaaagggagggctttatttattaaaagggctgggttcactcattcctgggaacctcctttaacttcaaaccttttgttccgtacttttttggcccccccccccggttggtggtttttaaccttcttttgggttcccgggggtttttgttaaacttttttaacccccccgtttttgggggttaaagattttttccccttttttttaactttggggccggtttttttgccttggcccaaaattccgttggcttttcggcctttaaggaaaccaatggtggt

SEQ ID NO: 22334 - DNA, 412 bp, Zea mays
  Clone ID: cC-zmle18900088a12a1
acgggacaaatatgcgtggggcagggttggaaaaatagaagcgcgcacacacagaaatagtagagatcgagagagagagagacgatggcagggcaactcgacgcttacacgaacagtgctcaaatgaaacaaaagcagtacgtgtacgcgcgttctcaaattacacacaacgacgacccacagagatagagatggatgggcatgaatgattatgcgccggtgagctcctcctccttgtgcgtctcgatgaccacgtcagaggtggggtaggcgtggcaggtgagcacccagccggcggccatctggccgtcgtcgaggtagctctggtcggactggtccacggagccggagacgaccttgccggcgcaggaggagcaagaccccgcgcggcaagagtagggcaggttgatgc

SEQ ID NO: 22335 - DNA, 410 bp, Zea mays
  unsure at all n locations
  Clone ID: cC-zmle18900088b04a1
ccctnnaaaagcaagggggggaggggaaccattccaaaccaacttattgcccatccatactagaaagtagagagacatgaaagcatagaaaatacagggtccaaaatgtaaccacagataatgataagtcaggtaggtacaacacccagcaaccccttgcacgctatagcaaaagccagctcaagccaggtgaatgtctcggtagcaatcctttggggatacacttcttttccgatttaagttgaaatacagtagggttccgtctccaaagccaaggaagttacttggggccaacatccttaaacgcccaaatctgctcctcccccatcgcagactggacagtcacaacaagatccttcccgctttcgaacccttccttaatttgggccacaagagtctcatcagttggg

SEQ ID NO: 22336 - DNA, 494 bp, Zea mays
  Clone ID: cC-zmle18900088b05a1
gtatgttctaagaactcatttatattgcacaagggatgggcccacaaacccagcacttatctaagcttattgtgagttcgacaagatgacaacactttcagcaatgaagaagcgcatgaacaacttccattgaccaagctaatacttctatgatgctaatgcgctattcattgccacaggcaaaagacagcgtagagagaataaaattgagagtcgatgactctcttttgctttcttattgactgctcaagtttgctcagaaatggcaagggtattcctagccactagtaactaattgttctcaagttttcggacacgattcttggcgcaagctccattgcttgcgcaatgcttctcacctcagcgatcattgccacaacgtcgttgagtttgttaatagcagaaccgactccaactccagcagctcctgcagttactggcattggtgcagtcaccgagcttaaccctgacgagcacatcactggaatactaac

SEQ ID NO: 22337 - DNA, 347 bp, Zea mays
  unsure at all n locations
  Clone ID: cC-zmle18900088b06a1
tttttcctcttctattaaaaaaaaaaaaaaaaaatangggtggggggtttaattaatttttctaaaaaccccccccccaagatataatattaaatttttaaaaccatattatttacaaaaaaattaaaaaacaaacgaaaaaaaaaaaaaaaccaaaaaaataaacaaaaaacatttcaaaaaaataaaccaaaagaaaatacaaaacattaaacaccatcgaatgaaaaaacacataacacaaaacaaacacctagaaacacaagaaataaaataaaataaagatataaaaaaaatccaagggggggggggaggggaagaggatattacaaaaacatcaaactaaa

SEQ ID NO: 22338 - DNA, 275 bp, Zea mays
  Clone ID: cC-zmle18900088b07a1
tttttcttcttttttttttttaatatatttttatatgggggtgggctttattaaataatttattaaccacctcccaaacaaaatattgggccccccataaaaaaaaagtgctacaaaaagtccaaaaacaaaaaaaaaactttcaaatcaactcttgtcatctctaaaaagcaaaaaatacaaaaaacccccggaaacaaattttgaccctttaatacaggaacaaaacctaaatgttttccaacccttcctataaacaacaaattaaaacctgg

SEQ ID NO: 22339 - DNA, 438 bp, Zea mays
  Clone ID: cC-zmle18900088b08a1
ggcaaatctatcaacggggccggcaacacaaggctcttaatcgagtaccatccaggttccagaaaataatactgacagatcaagagaccactgcgacaagtcacacaagccacaaaccaccatggtattgcaatactatgcatcacatagcatgttttcatccaagcggcttcatcttaatttttttttataaatattcctgtatccaaacatccgggcatccatttaagaggggaatcataagacatgctctggaacaagaggcggaatctaagcttgtgcggagtcagttcccctttggtgcacccttctttgcagcctcggcagcggccttctctgcttcaatttcggcaacatactcatcaatctcagcctcttcgagttcatgaaggccggcctcgtgtgtcatcactgcaatctctatgttcttgccaccac

SEQ ID NO: 22340 - DNA, 446 bp, Zea mays
  Clone ID: cC-zmle18900088b09a1
tttttcctcttttttaaatagggaaacttgcaaacaggggctggttgatgttcaaaatttttcctgtccggagaaggaaatcgccacgggtcaatttggcaacttcatccttccacaatcactatatctacagctacatgattgttcgacacgcagtaacaagagaaaattcaaacacttgccatgaagagtaacttccaggcgaacagttaggtatggtatattatttggtttctctgctctggtagttgcccttgcccaatgctgacctcaagtttggcgccatcatgctgttgtcttgatgcatccacaggagagcctcagagctgctggaagcaaaatgggttcactatctcacattttgtttggccccataaatttgttttctctcagcaggtttcagaatttggaaggaacacatcaaagtttcgtcaacgctcatcatt

SEQ ID NO: 22341 - DNA, 460 bp, Zea mays
  Clone ID: cC-zmle18900088b10a1
tttttcatccattcatagcatagcctgttggtcaaagggaatgggagacagagtaaaatacatccagacagcaaacttcaatttcagacattcctgttctagctcctggttcattgacacactaaagcacacgttcacctttctccattctcggtcacgcaaagacctcagcgccaccacacgctcgccatccacctactcgtacctgtagatgaagtcggagttgccgaccatggcattgagcacctgcgagacgaggaagccgctgccggcgatgacggccaccatgagcacctccgtgacggggttcttgagcagctccactatgggctgcagcaccgtgtacgccacccctgtgctcaccgtcacaacgtacagcgcgtaccgccgcatgttgttccagaactcctccaccagggggccctctggccccagcgccagggcggggcctggccccgcg

SEQ ID NO: 22342 - DNA, 315 bp, Zea mays
  Clone ID: cC-zmle18900088b11a1
ggacacagggggggggtattcatttcatataatttaaattccctttcccccaaacgacatacataccgacagacgcgacacacatgattaaaaaggggcatagagtatactgcacatttccaagcaatcatgcaaatgttattacaaaaatccttctgctgacccccggggaaaccgaaaacggatccccagccctagtttttaccggcgccgtacctcttagcgttgtggatgatgacctatccggcattcttggggctctcggaatcggacagccgggcggacccctggtcggacccctgggcggacgcctgg

SEQ ID NO: 22343 - DNA, 425 bp, Zea mays
  Clone ID: cC-zmle18900088b12a1
ggtcaacaaggggtagcaatagcattttgttcaccagacaagtacacggttgggagtaattttgtcaaacagggagagaacacatatgtttgattacagaaagtctgacaaaagtagcattccatcaactggtccctgaaccgaaggatttaacgatggggcttactcttgcaccaaagctttttgaagcaatcttcttccctgggacatggaacgggttcgagacggcatttacatatgcagcatggaacttcctgaaaaaatttctggcatttgcatctttgacatcaaaatcagtcgtgaccatgataaatttgacctttgtgtttggcaaatagccatacactttgtagttttcaattgggtataaaagacccaaaaatgtttcattcaatggaggggcactcctcttaggattgctcact

SEQ ID NO: 22344 - DNA, 477 bp, Zea mays
  Clone ID: cC-zmle18900088c04a1
cttgtattctctagagcggcacgccacatcacggttcagatgtaaattaaccgagcagaggcagtgaacatgggggtgattggtcatactctcactgacacccatgcagtggcccgacacggtcatgcttactcctggcggacggacgccaactcatgatggttagccagcagcattactacagctcactgaatcatgggggacggacacccccgatcgccggtggtgagccaggagtcggggtgatggaggccaggacataatcgctgttggctgtgctatccgcatccgccgacaggctcaggcaccggcacaatttgcagatgatgctataggatggactcggggagcaaggctatcatctcacagtaccacagctgatactacacctgagcgtactgctggcaaccttgctggcctaacgactgagcctgctgacagcaattgggcggcgcccactggccgctctgaagcctg

SEQ ID NO: 22345 - DNA, 477 bp, Zea mays
  Clone ID: cC-zmle18900088c05a1
aagttccaagggtaccttcttgagggcacacagtaccctaatttgatctggttcttccgatagcccaaacatcagattcaggtacacctcttgcataaaatggagttttcttccagatgtatctcttctaaaatttattttgtttgccaaaatgacatcatcaaaatcacacagttccgtatagtggcatataggaatgtccacagcttattcgagaattttctctccagttgaaaagacattccaaaccaccgttcctactatgtacaacacaacagacaccttaagcacactatgccaagaacctttctgaagaatgtagccagtggcagcagtaccaaaaactcctgccagaacgccagcagtgtttgacagtccgagaagtacccccgataacgtggtcctatgtcttggtgatttgaatacaggccagactgtgaaaaagcatcgctaccctgactgcatgccatacataac

SEQ ID NO: 22346 - DNA, 357 bp, Zea mays
  Clone ID: cC-zmle18900088c06a1
tttttcttctttttttttttttttttttttttttttgggggagggtcaacacaatgcttataataggcccatttccacacggtacaggggggaaggcgaataaaaataaaagcgacctttattcgttgggcattataacacaaggcattgcccgggaggaaacacagttaccggtttattccatgcccacttgacaaaaacccaaacagagaccacggttccgggtattaattgtccatggcgaccccaggcaactggaaaggggccccctcccggttgagctgctgcttgaacatccacttggggaagggggggaaaaagaactccttggaaccagtgtactggtggggggcgggg

SEQ ID NO: 22347 - DNA, 474 bp, Zea mays
  Clone ID: cC-zmle18900088c07a1
tttttcttcttctcttttttggaaagaaaggcactgggggtgggttcaacatgagcagaaggtaataccatcccttggtcacgattacagttcgttcgtgttaagtctgtactacggtactctggatgagctgttgagaaaatggtgtagcatccacaaccacaatcaagcagctggagatcacttcctcaggctttcgatgacgtatgagccatacaggtccatcgagtacttgattgcgttgatggcatctttcgctggcaggaactcattcactgcgacctctttgttttcattctttttgtaagggtgaaaaaagcggcggatctcttgaaggcgatgcggtgggaggtccctgatgtccgtgtagtgacggaattcagggtcatcagcacagactgctataatcttatcatctttctcgccctgatcgatcataggcatgagcccaatagcacgagctcgcaggaaaca

SEQ ID NO: 22348 - DNA, 472 bp, Zea mays
  Clone ID: cC-zmle18900088c08a1
attaactctcatttagggctggggccacctgattagatccttgatatgcaaagttctttgttgttacgcactgtacatgttggcagaaaaaacaaaactatatttgtgcgtgaatttacatatgtacatcaaaaaataaaaaaagattctagtgtctatagtgccttctggtctaatctctcgttccagttgaggcacctgatcaggctgcggaaccaatcacccgtttggtcagatttattaacagttggtagcgggtgctgactcatggatatacgaacagagtctcctcttgatagttgctgccgccttttgccatcaaatgaaacccatgcattgcttcttgcctcatctggtatctttaattcaagccgtgcggaatccggaaggatgacaggtctaaatgacagtgagtgagggcagattggagtaaaaagcatgcatgggacatttggatgaacctttgatcccc

SEQ ID NO: 22349 - DNA, 449 bp, Zea mays
  Clone ID: cC-zmle18900088c09a1
atcgccgacccgcaggggtttcgtgttcgaagaggaggcggaggtcgaccggcagggccagtacgacgacgacgacgggtatgagggcgggcgcggtcccgcgttcacggcccccacgcgcccgcgcaccggcaaggccgcgctactgcttaagcgcgaccgcacgaggtcgaagaggttcctcgagatacagaagctgagggagagcaagaaggactacgacgtgcccaccgccatctcgttgatgaagcagatgtccagtgccaagtttgttgagtcagcggaggcgcacttccgcatgaatctcgaccccaagtacagtgaccagcagctccgggccacggtgaatttgcccaagggaacaggccagtcggtgaagattgcggttctcacaccaggtgagaagatagatgaagctagagctgccggagctgatatcgtaggtggag

SEQ ID NO: 22350 - DNA, 385 bp, Zea mays
  Clone ID: cC-zmle18900088c10a1
ccctccccccccatttttttttttatacaataaaaaaaaaaaagaggccgaggggtttttttttttttttaactccccccccccccctctcttcaaagaaaacccgccccccaaccaaaagggaccggaataataacaagggcaaaaaaccccccccggaaaaaaaaaaaaaatttttttagaaactccaaaaaaaaaggggacaagggccacaaaacaaaaaaactaatgcaaggcccccggaaaaaaggacactggataaacataccggcaaaacgggaaaaaaataaaaacccggctttaaaaagggaggggggggaaaaaaacttcccctctttaaaaaaaacccaaaccccttaaaaaaaaagaaaaaaaccaatccccc

SEQ ID NO: 22351 - DNA, 428 bp, Zea mays
  Clone ID: cC-zmle18900088c11a1
ggcaaagaaaattctattaatggggacgggcactggatggattatttcactttctgacttggtagagggtgcttcttatttccagagttgaaagaacatcacatgggtaagaatttcctagcagaaacagcatcacctggatcaacacggtgatgcaatctgtcgccttattctatttatttacttgtaaccgtggtcacttccagcagctctcgcaatcctttcctaagctttaccattcagctgcaccttggacagcttctccccgctctcgtcggcaccttccgccttctttccggggaaggacctcccgctgcttgtgaccaggtccttgatggttgcctggatgtccttgtcgttcagtagggactccaatgtcacgtggacacggaatctccaatagtgctttgggttagtggggtcattga

SEQ ID NO: 22352 - DNA, 545 bp, Zea mays
  Clone ID: cC-zmle18900088d04a1
tttggagtccttttatttttatcttctgaaaattaatgtacggacttgctaaacatctatttagagagttattttttaaagaactattagagttgctcttacagatgcatgctccacgaggttggtgggcacgcggcagtgtcggttacactaaacaacacgcactgccatgtcacatggaagcacagcacagcaccttcctctaccgaacccgctggagattgtagtgcaccacccgctcgagggcgctccggaactcgctcctcgggaggcactgcaggctgcgcagagccaggccgcctttctcctccgtgagctcccgcgcgctccggatcccgccgccccggtgcacgagctccaccgcggcagccagggacccgggctcgcagaactcggactcgatgatgccccgcagccggggctcctcccgagcgccaggatcacgggcgccgtcaggttgcccttggcaaggtcggtccccgccgccggcttcccgagctgctccgccgactgcgtcaggtccaggatgtcgtccaccacctgga

SEQ ID NO: 22353 - DNA, 260 bp, Zea mays
  Clone ID: cC-zmle18900088d05a1
tttttcttctttttttgtttgtattctgttttaaacggagggggggggcatataaattggatggacaaccatcccactggtacacgcaggtgtccccttttttcctgtcggtagggacatagatgccggccttggggtcagtgcaccctttcggcacgggcaatcggacatgctgtgccaacttgccataaaattcgaccttaaagtttaaagcgtccagccccggctgactgaggaacttgactaacaactgtacgcgc

SEQ ID NO: 22354 - DNA, 289 bp, Zea mays
  Clone ID: cC-zmle18900088d06a1
attattaccataattggggccgggtaattttatctctcgttccggcaaccctccgctatataaacaacaatacaaagagtttgagttggcgctcaccggcctccactctaaactatatacgggacgacgattcccatcccatcccacgaatattccatttcattcatcccaccaaaaatcccttatcaggtcctttctgctccgcctctgggtatatatatattaatcataatggcgtacgtaccttgtagtatcatctggacaaatggccggaaccgggaccaccacc

SEQ ID NO: 22355 - DNA, 384 bp, Zea mays
  Clone ID: cC-zmle18900088d07a1
atggaacaaccgccaccctctttgggaaagattgtatcctccagtattacatgttacagctttatatatatatataaatcacacacccagacattgtacaagagtcccaatgaggcacaagagttccaagctcgttatgggttgaatgctggaaccgatcggccgaccgatctggcaaatcaatttacctgtcaatcccctcaatcttgtcttcaacctccgaatagagctccctgagcctgtccaggttctcctccgttgtctcccagtagcctctgccactggcttccaggaaggtctgcaccaacttcctgaacgaattggggttggtgtccatgagcctcttcctcatcgcctcgtcctcgatgaacgtggagttggcct

SEQ ID NO: 22356 - DNA, 462 bp, Zea mays
  Clone ID: cC-zmle18900088d08a1
acaacacaagatttccttttctggggtaaagtgatacaaaaatgagtgctttgagtaagaaaaaggaaggaaaagaattccaaaagggaaaatgtgagaggtgcggaggggataaaggatatgaagaatctataaagaaacatgaaacacgttgctacttggttttcagggcaacagatttgcatataggacaccggttcttctgccgaagccagtgctctatgcaggaaaggtggtagtagtgtttacacgccatcttgcccacatcctcacccgataaatactcctcctggcatatgctgcattttgtttcacaatcttcatgagaccctggagctgtgggcatgtagaggctcctatttaggcacgtggacaatgcatcgtctgaaagacctgtttttacagtaccaatccgctctcccaaagcaagcaactcttcgtaggacatgccgtcgatatcca

SEQ ID NO: 22357 - DNA, 363 bp, Zea mays
  Clone ID: cC-zmle18900088d09a1
ggggtggggttttttaaaaaaaaactggccccaatccctcattaacataaaccggccaaaatcattcattaaaaaaaactggccaggatcattcattccactaacttcactttttttacacacaaacagtaagggcagcaaacccttccagcgtcacttttaacaacaacgtattctgttgtttttgaaacaccactctttcctactctgaaatcttgagctttgatgcaaataaaaaaaccccattctttgcagtttcaaggcgccagggcggaaactttggggatacaaattgattggctggatcatacctcaaggccaaattttttaacccttatcccctctagggggccataaacaatt

SEQ ID NO: 22358 - DNA, 353 bp, Zea mays
  Clone ID: cC-zmle18900088d11a1
cttcctttttcacttctcttttttttattaacaaaaaaataaaaaggggggggggtttttttaaaaaaggaaaaatttccaaacccatcgaaaggacttaataaaccttgtttggaaaagcaaaaaaaaaaagttccacaaaaaatggttggaccctaaaaacccaacatggccaaaaagggtaagcaccggttttcctcttcaaaccccccaggaaactttcctagggaccatcgttcggtctcggcacgaaccaaccggaacgaacaaggcaaaaaaattccccgggctgaacatgccccccagagagggccctacttgaggtactggaaaacccacttgaaaccataacc

SEQ ID NO: 22359 - DNA, 345 bp, Zea mays
  unsure at all n locations
  Clone ID: cC-zmle18900088d12a1
tttattttttatccatcgctttgaaaccatgggagtnggagctccttccatatttcacaagctgcggctccctcagcactccatttgcaagctgctttgataatttcattaccttcacgagcaagatcgcgcccttcgttacgagcttgtacacaggcttctaaagccacacgattagctgctgcaccaggtgcatttccccaaggatgtcctaaagttcctccaccaaattgtaatacggaatcatcttcaaagattttgggcagagctggcatatgccaaacatgaatacccccagaagccagcggggttacacctggcatggatacccaatcctgagtgaaa

SEQ ID NO: 22360 - DNA, 372 bp, Zea mays
  Clone ID: cC-zmle18900088e04a1
tttcttttcttttttttttttttttgaacatgggggcagggagttattgggtggcaacaacagaccatgggtaacaacagggcactctcagtaataatagtttactaaaacccgcaaaggctgcatggaagcgaagccatgataaggaagcaaattcgttactgcggcggctggacgtagtagtagcccatgggatcggcggcgggcaggccggcggcggggttcggaatcccggctgctcccatggcggcggagtcggcgtccttggcctcgtcccgcggcacgatgtcaacgaggaagtcgaagacctcggtgcgcgccacggcggcggcgatgtcggacttctgcagcgtgcggcgccccacgcgttcg

SEQ ID NO: 22361 - DNA, 325 bp, Zea mays
  unsure at all n locations
  Clone ID: cC-zmle18900088e05a1
tacataagcacttataacattccaagcagttaatcttatcagcagcaatcatccactggagtaggaaatctaatatacttctttctcaatgagccatagatggcacatcctccaccacattcccatgatctccaaggcttttatcttgtggtatcctgttctatatgagcgcaagnctcagatatctcaaanctctaatacatagatatccttgtccagctcctctgccttcttgcttgcctcctccttctcctcatctgtaaggtctccatataagaggctgacatgcggcatgtatggagtttttctattgtaaccgaagttg

SEQ ID NO: 22362 - DNA, 397 bp, Zea mays
  Clone ID: cC-zmle18900088e07a1
atgcatgaaacgggaatttcagtggggaggggattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccacatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaag

SEQ ID NO: 22363 - DNA, 372 bp, Zea mays
  Clone ID: cC-zmle18900088e08a1
gtgacggaggaagcagtagttaaagggtagggtaataaccgaatgaaatgaaagttgctggtacatcaactctcgactggtattacatgaatgcaggtgtacgatgtgcgtatgccattcagacattcacagtcggcgatgttcctgtccgagcatacatggatcaatcatagtatagctatataggctatagctagtacgtagtagtgtagtgcgcaattcagagctcgtcgtggctggagccgtcctcgtcgacgacggcgtggaccttggggttgggcgaggtcttgacggggtaggatgcctccatggcgatgccgcagtgtccctccttggcggccacgtcgcgcgccatgcggatgtaccccttct

SEQ ID NO: 22364 - DNA, 294 bp, Zea mays
  unsure at all n locations
  Clone ID: cC-zmle18900088e09a1
cttttattgatttagacttaaatatgaagtacggggaagggcacttatctcatgtgatctgatgctttacatttgggggngtgggggtgatggttcatttttcttttttttctcttttcttctcttttctttctttctttccctttccccttctttcttcttctctttcttttcttctctttctttttttcctctttttctcttcttttttctcttcttttttttctctcttttttcttctttcctctctttttctttttttttttttttttttcttcttcctttcttcttttc

SEQ ID NO: 22365 - DNA, 489 bp, Zea mays
  Clone ID: cC-zmle18900088e10a1
ttttatgtcatacttagcgaatgccaatatataggggggggagaaacagttggcgtccatagagcgatcccaaatgtaaatacatagaaacttgttaaaaagataatatggaacttgtacaaaaaaaacagctggattcagcacaactttgtcattcagactcagttccaaattctggttagaacaccacccagcgagttaacgtgacatcacaccagaaatttccagtgcctgatgaaattatactacataaactgaatttagataacaataaacagcaatctggaaaagactaaccacagctaaccaaagcaactcgacattttctccacaacccaagataaaaggtcaaagcaccccaaaattacttagatatgcaagtctatgcaaaacctattattaacgtgcgtgtctgtaggatgctacatcccaaacattataatgaagttggtcttaatcctgaacaatcagtgacccagacagaatgag

SEQ ID NO: 22366 - DNA, 423 bp, Zea mays
  unsure at all n locations
  Clone ID: cC-zmle18900088e11a1
aataaggggcggggcagatttttcttatatgagagaaacggaacatatttgacgtacaacacacaagcaaagtccagtgatacaagcaagaggccgtcgtgcacgtacatatttattctagcggattcgattattattccaacaacgcaacacaacatatttgcatggcataatggcattcgttcatgcacttgactcgcacggtctcgttgacgacgtcttcatcagctagggcagcgtgtaatctccgcacttgtatccnaccgggcggtcggccatgttgcaacccttggggatggtaatggcgaccttcggcttgatcccggcagccctggcggtgccggacagcatgacggcgcacaggcagctggggctctgccccatggtgtgcacagcggaacaacatctgctggtcggcgtgga

SEQ ID NO: 22367 - DNA, 446 bp, Zea mays
  Clone ID: cC-zmle18900088e12a1
aagtcgggaaaggatttagcaggttatggcagacatgtaaacatgacaactggtacaggcattcaatttttaacgatccataactgttaatgagtcagcataaccttcaaaacaagaattttagatccgcatctactctcctgcttgtttacagccaactatgccactatcctaaacaagacataacatctatacttgtatgatggtcaaaagaatgcataaagcaccatgtccgctcactatgttaccaccttcaaagccaggatttccagaacaagacatgtgtttggcacacatcatgtgctctaggtgagatgccaaccatactcacagaaagggtgatgcacttctgctaaatcaatgacatctgtaacggtgaaatgagctaaagctcatttggttgcggagctcacaacgtggaaaggaatcagccattgcatcttaca

SEQ ID NO: 22368 - DNA, 436 bp, Zea mays
  Clone ID: cC-zmle18900088f04a1
acctttgtggctgtttttttttttctcgaatgattcataatgggctggggattcttaccaaatgtttatccgcatcctccattatatgtggaattcacataagactaggaacagttctgcagagcatgagaacccttctaaggctaaagctgggttcaacagcatgttcagccttacatttcacaaaccagaatcacttgcatcactgtggaaatgaggtattcaactacaatgatacacagctcacagcaaatattctcccagcaatgcaaagtgtgtataatgcccttgttaatctaggactgggacaacaagttactgttacgactgctcattctttcaacattctagcctattctttttctccttcatctggggcattcaggcaagatctgatacaatacattcaacccctacttagctttcatgctcaaat

SEQ ID NO: 22369 - DNA, 325 bp, Zea mays
  Clone ID: cC-zmle18900088f05a1
atcttataatggcaacgactatagggcagaggtgtttatttagatacatcttacctgcacctaactatttgaattacatattattggaacggtttcatctttatgtctttgggtgtatacgtaaatgttggagccatattctgtcatgagctacaaacattcacggaggaactattgggtgaccaagaaagctactctttttactcaaacaactcttgccccttttgcctctaagcttatggatcaagccttatttttctttacggagagcgttaacatgaaaaaaatatggctctacctcattcttgatgggatgctggaattt

SEQ ID NO: 22370 - DNA, 430 bp, Zea mays
  Clone ID: cC-zmle18900088f06a1
cagaaatctctccaggtacgggcagagagcatacaacttgagacatgtacggtaaggttcgcttattatccttgtaacaacatcctacagccaagcaaggccaacatcaaagctttatttctctcaagttttgctcattatgcattggactgtatatatcctctaaccggaagacatgactacagctccaaccctatcgcgagggatgagacgcagctccgaaccatgtttcagaaacacgttgcctgcactttgctgggggttgatgccaattccatcgttggtgatgatggcgctggtctggggcgggaccttgaactcctccgcggcgtacttgagcaccgcggtaaagggcgccgcctcgggcacgctgaacactttgaaagggagcttggggtcggaggtgaggatgatcttgaaggataccttt

SEQ ID NO: 22371 - DNA, 373 bp, Zea mays
  Clone ID: cC-zmle18900088f07a1
cctttttttctctttttttttttttttttttttttggggtggggtttttttttaaataaaattcttcccccccctttaaaagaaaaaaaaaacacccccaacaaaccacctacaaatggctagttttcgaaaaaaaaccccccataaaaaaaacacaaaagtgaccccaaaaccccacaaattcaaataatgaaatgctcccttggaaaaaaacccccaagggcaaaagaaggctggccccccccctaaataaactggcttcaatgggcaaaccccaattaaaaaaccaccccccaaaaccggacgggggggcggacccctaatttccaaccgggaactcccgacccacacccgaaagcgaacccaccccccc

SEQ ID NO: 22372 - DNA, 523 bp, Zea mays
  Clone ID: cC-zmle18900088f08a1
ttttactttcacaagaaaacactgccatcatggggtggggcccaccaaatctttagtcgctcacgttcaagagccacaccacactacattatagacatatctcaatatatttcaacttcagctgctttgttctcggcacataatctttcttttcactcaagcttcacagaccatacaagagaacgaacctggtaatttcaaatggctgaaccaaaactcaggttcgtttttgtaaattccaatagcaaaaaatactcgtgtaccagctcataagcacaaccaccattatccacctcaggtatactatgtgttgtgcaaccagttacttccacagaacgcccccaagtcagaacatgtcagctcaaactcacacattatcccaggagataatcacattccaaaggctctgttatagatgtcatttgaacccagcatgtgcaacttgttcacttcacttggatataatatcctcgacatgtctgacataggagtgctattcccttgtctcgaatcactccaccca

SEQ ID NO: 22373 - DNA, 364 bp, Zea mays
  Clone ID: cC-zmle18900088f09a1
aaagggtgggatttaaaatatactcagtttggaacagggaaaagtacatgcatgcatgcatatatatatatatagctagaattattgagacgacacgttttattttctgcgcgggcggtactgcatgtgggggcacaagacgacgggccctggcggggtatagctagctagaattataggagggcatcctccttgggcgtctcgatgaccacgtcggagggggggtacgcagcgcaggtgagcacccaaccgttggcgacctggttgtcgttgaggaagctctggtcggactggttgacggagccagagacaaccttgccggcgcaggaggagcaagaccccgcacggcaggagaagggcaggt

SEQ ID NO: 22374 - DNA, 442 bp, Zea mays
  Clone ID: cC-zmle18900088f10a1
ttttcttttttacaccaggaaaaatcatatgggttggacacgttttattcatggttttacttaatgatgacttacaagcacccccaccaaggccacaactctcacactggtttatgatactacaatataatactggtacatgatttgaaaatgaatgcacaacccacagctccatgtatgaagctacatatatatgcgtgtataactttgaccgcgtataaacccttaatcacccatgcattgatgcatgcatgcggatatagattagtggtggtgatacatcatattagcacatatatgcagctgatgtgattaccggcactggaagctggagggcacatgcttgccgcactcgttaacgagcaccgagatggcgacggggagcacgaggctgacgctgagcgccttggccttgatggtggtgcaaaggcagagcgcggcg

SEQ ID NO: 22375 - DNA, 506 bp, Zea mays
  Clone ID: cC-zmle18900088f11a1
gttaacaaaggcacagcaagcgcgatggcatggattaacgacggagcatttttacagcggggcagcatacatacattattacgatttatgaattagccttagttgcgctacactgcaaagtacaataaccacttcagctgttcaacgcaatgagctgtaactgtaagcaactgcacagtagcagcagcatcacgaacccgatgatgcagtcggtcttgtactgcatgttgccggcgcaacgcaagtacttcgctcaggctttcccacacgatccaaacaggcgcagcttctctgctacaacagctttcattgcctctttagcagacgccatcacctgaatcaagtccttttctggctttctgagggacgccaggtagctgttccgaacctcggtgttcacattgaattttctcacgcccaagtctatgcactcctttacgagctcatgagatagaccagatgctccatggaggaccaagctaactcctttctttaatggtaatgca

SEQ ID NO: 22376 - DNA, 454 bp, Zea mays
  Clone ID: cC-zmle18900088f12a1
ctcgatcatgtcatgtattcagggtggggagaaaaagtgtatgtaaatgtaatcgcaccccatcgctaagaaagcgttcttcacaatccatgtctgggaagtgtcgtacttccccctttaaaactttgctggtcgctcacattccatcatgcccttgcactcgtcgttatgcgcttacaatccaccgggtcctgcggctgaatgtgcgctggcaccggcgccggggcccatagtcgcgtgtgttgcatcacggtgggcagcttcacgcgcctctccctccttggtctcttgggcaatctggtcttcggtcttcttgtttcctcgggcaatgagcttctcgaggaggccgcccttctttggcgcgtcgtgcttgtctgagtcttcgacatcttcaggtaggcgacgcgctcttgagggggcatcgcggcgagttcagagtccatcgagtcacggt

SEQ ID NO: 22377 - DNA, 507 bp, Zea mays
  Clone ID: cC-zmle18900088g05a1
tttttttcctttttttttaattcttttttttgggtggggtttttaaaattaattttttattcccccccccccccaaacattattcaaaaaactttatttatttaaattacatctaaaaaccaaccaaaaaaacgcccccaccaataatttcctttttcaaaaaggctaaagaaaaatacaaaacaaactggacaaagggcaacaaaaagtaaaaatataaaaagttagaaggcttacacaaaaaaagataaaaaaaacccccccccctctttttttcaaaaaaaaaaacccgtggggggggggggaagggaaaaaaaaaaaaaaactttctcctgcaaaaaaaaaaaaatattcctgccccccacacttttaataaaaaaaaccccaatcttttatcaaaaaaaaaataaaaaaactccccaaaaagtaaaaaccatattccaaacaaaaaaaaaaaatgtttaaaaaaaaaaaaaaggcttgtaatataacaaatcacttctttat

SEQ ID NO: 22378 - DNA, 339 bp, Zea mays
  Clone ID: cC-zmle18900088g06a1
tttttcttctttttttttttattttttttttggggttggggtttaaaaattattttttaatttcccccccccccataaccttatttcttaaattttttttttctgaaaaccaaaaaaaaaaaaattcctttataaggacccctcccacaattccccctggaaaagtggcacgacaaaaaactctaaaaaatgccaaaaaacaaaaacaaaatctggactatcaatagggaaagaaagaaagcccaaaccgaaaaaaaaaccccccaaaaaaaaaaccgttttaaaaaaaaaaaacggggggggggggaaaggggcaaaaaaagaaacaaaaatttctta

SEQ ID NO: 22379 - DNA, 388 bp, Zea mays
  Clone ID: cC-zmle18900088g07a1
gcttaaattgggaggcgggactaatgttcggtacagattaaagcaaagcacagcatgagccatacgcacaaatatgaaacaatccacgaacaattcttagaccagtgaattgcatgccagttcggacagtgataagcacttgcaaacaatctaggtaacagttgagacaacaaacaatcagccaaaacttgtctaagccaatcacagaagatagagccccttcttaagccttcctggttgcgatctgagactcagcctctttcttgagtggctcttccttctccgacaagatgagctctatgtggcatggggaggacatgtaagggttgatgcgtccatgagcacggtatgtcctgcgtcgctgcttctgagcctgattaacttgaat

SEQ ID NO: 22380 - DNA, 380 bp, Zea mays
  unsure at all n locations
  Clone ID: cC-zmle18900088g08a1
ctcatcttcttttttttttttttttatttatggggttgggtttttttttttatttttttttaccccaacccaaaaaaaaaaaaacaaaaaaaaaaaaaaaaaaaaaaaacaaaaaataataagaacaaaatattacaaaacaaaaaaaaaaaaaaaaaaaaaaaaaaaaaaaaaaaatgaaaaaaaaaaaacattaaaaaaaacaaaaaaaaaaaaaaaaaaaaaaaaaaaaaaataaaaaacatatttatcccttcttacaacaaaaaaaaaaaaataatcaaaaatacnttaaagagagagggaaggaaaataaaaaaaaaaaacttacacaacaaataaaaaccaaacataaaaatttaaaaaaaaccctttatatt

SEQ ID NO: 22381 - DNA, 174 bp, Zea mays
  Clone ID: cC-zmle18900088g10a1
ggggttggggttttttttttttttttttttttccttttcctttcccaaaacccacaggccaaaactcatgggggggctctaactcaaaaaaacccccccttttcaagggaaaaaaaaccggttttacttttattttaaccaaaaaaaggtaaaaaaaaaaaaccggccccgggg

SEQ ID NO: 22382 - DNA, 324 bp, Zea mays
  Clone ID: cC-zmle18900088g11a1
cacacaaaaaaaaatcattggggagggggacattttatttatgggctgactccatgcccacccacaaaaacgcggacacaaggccacaacaatcaaaatgggccgtgatcctacacaaaaaacctggcacatcagtagaaacagaatgcacagcccaccatgccacgtttgaaactacatatatatcccaccataacattgaccgcacttaaacccctaattacccatgcaatgacccatgcctgcgactatagaaaaggggtggtgacacatcaaacccgcgcagagagggaggcggggacaccaccgtcactgaaaactccc

SEQ ID NO: 22383 - DNA, 345 bp, Zea mays
  Clone ID: cC-zmle18900088g12a1
ttttattttttatccatcgctttgaaaccatgggagtggagctccttccatatttcacaagctgcggctccctcagcactccatttgcaagctgctttgataatttcattaccttcacgagcaagatcgcgcccttcgttacgagcttgtacacaggcttctaaagccacacgattagctgctgcaccaggtgcctttccccaaggatgtcctaaagttcctccaccaaattgtaatacggaatcatctccaaagattttggtcagagctggcatatgccaaacatgaatacccccagaaggcagcggggttacacctggcatggatacccaatcctgagtgaaa

SEQ ID NO: 22384 - DNA, 486 bp, Zea mays
  Clone ID: cC-zmle18900088h04a1
cttgggtggggttgtttcgaaaaagatatcgtcccattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctggcttttgttgaatctttttcacggctcgatagagaatttgattagccaatgatttttttcccgc

SEQ ID NO: 22385 - DNA, 481 bp, Zea mays
  Clone ID: cC-zmle18900088h05a1
ttttggttcaattctgtctatttcaagcttttaaacggggcaaggaacaaaatctgattttcacagacgacgtgaccactcggtaagtcggtatgtgttccaacgcctatacagagatatttttatcatatcccctcttgggattggggttcactcatatgttacactcttcgagatcttctgccttgcacagcaattttttttcttcaccatgaaacccagataaaacctgactccagtgaatgaaattgcaggttccttagcagtgcgtggctgcgtgctgtgtcgccttaaatttgatcagtagatcaggccttgttgtaactaatcgaacaaagaaaaaggcaataactagacttcctagtatcctgcaatgccaattagaacaaacgatacaaagtacagggcagcagaaatggctgttcctgccacaaaattgtatgagaggcgcttgttgtcacgattttggtacaaataccat

SEQ ID NO: 22386 - DNA, 356 bp, Zea mays
  Clone ID: cC-zmle18900088h06a1
agcatagctactaagtaaaatggggaggggtgccattggcgtgcacttgtacaagttgacccaaaaacagggctgtcttacaacaggggatgatacaggaggaagccaaaaaaacagatgacacccgccaagtcacgctacatcttttattctttaacacattgccattcagaacagagctaaagtgcgtttgagatactgagcctctaaaacaggcgcccagcgccctacgtgaatgtgtcctccctatcaccttcagcgacctattaatatccatgttgctgaacataaggaggggtgtccgcctgtggccctagagatgtaattccggggcatgcccagctcatgttgtactt

SEQ ID NO: 22387 - DNA, 540 bp, Zea mays
  unsure at all n locations
  Clone ID: cC-zmle18900088h07a1
caatattgacatagggcatgggaacatatcctcaagcaacaaacactgatacaatatagctgtaacatacatgggaagaaaaacatcaacctctggtgcaccgatcaacacaaaaggatggaggaaagcaatcgctgtaacaatccaagttttagcatatgaaagcgacatgaacatgctcatcgctgcagtatagtccaggctgttgagtgtacccttgcttggacagcagctcacgtgctttcatcacgagatccttattcgtcaccttcccgtgcttgtctgcaagaatggtttggatagcattgctcagagcaccaaaggagacaccctgcggtgtagttgcatccgctgatgtttggttagtctggcacccactgatcagaatgccattgtttggtgcccaggccttactcncggcgtacacctcgtcaacactgtgaacctcttgctctaatgcaggtttgaaagcctcttcctccttcccttcaagcttagccctcaagaactcctgagcaagggcaccaaccatgccaaaga

SEQ ID NO: 22388 - DNA, 361 bp, Zea mays
  Clone ID: cC-zmle18900088h08a1
ggggtggggtttttttttttttaaaccggggccacaaaacacctatttgattcttgggaaaaggcaaaatttggaaggaaaaacgcccggttggaaccaagggccaactaaacaccccctagggccaccccttggggacccatgcccccacaaaaaaggacagttaccaaaagcttgaaaacaaagtgtccgcccaaaacgaaggggggaaaaagtccccaacaaaaaacaaaaattccctcaaaaagaaaggaaaaaacttgaccagaagcggggggggctggacccaaaaaaaaccggtcttgatgggaaaaatttttttccaataaaacacccccggagacctacttctttcccaaaa

SEQ ID NO: 22389 - DNA, 424 bp, Zea mays
  Clone ID: cC-zmle18900088h09a1
ttttttttcttttttttttttttttttttttgggttggggttttttttttttttttttttttttttttcccttttttttttttttttttttttggggaacccctttggaataaaccgggggggggaaatccccccccctaaggtgtcaaacccaaaaaaaaaaaccgggggcccccaaaccccccggtgaccaaaaaaaaattaaatttttaattttaccgccccaaggggggccccttttttaaaagaacaacttaaaaccggggggccccctgccactttcccaaattgaatttggttaaaaaaaaaccggggggggtcccaaccccaaaccaatttatcccattttaaaattggggaaccccttcaaaccggataaagaaaaccaaacggttttaccaaaaggccgccttttcccccgggg

SEQ ID NO: 22390 - DNA, 422 bp, Zea mays
  unsure at all n locations
  Clone ID: cC-zmle18900088h11a1
ttttactgttattnactgtctttgctcacggggcgaatgagcgaaaagaatgggtagctgagcaatcagaattcagaaagcaacacaagatgccattgcagtttatatacagcatttatttacagaaaccatggcgtgcagacgtgcagttattccgcctgtacagtacagcacgcgccgatcgatcgcggcggcggcggcggcagcggcgggtgagcaaggggcccgctcagctgggcgcgaaccggtcgaggaggaggtagagcgtggtgtcggacatggcgccgccgcaccttgcgacgtgcccctcccgcctgtccgtcccggccgccgcggctcctcgcaacgcttgttgttgctgctgctcctgtcgtcgcctcgccacggcctctgctgctgctggcacggcagccgcgggtccg

SEQ ID NO: 22391 - DNA, 345 bp, Zea mays; identical to SEQ ID NO: 22359
  unsure at all n locations
  Clone ID: cC-zmle18900088h12a1

SEQ ID NO: 22392 - DNA, 479 bp, Zea mays
  Clone ID: cC-zmle1890010a01a2
ttttgactaagagctattgatggcctacgcatccatacacagttttattcagctacaaaccccaactgacaggctgccctgcttgaagaacaggctcctcggactccaatattcgacgcccaatatagtataggaaaaagagaagaaaaaacctcctgttgcagatgttaatcaaagtgataaaacttcaacaaacgatgtgacatcgcaacattgtattgtataagcctacacaatatcccgtttccatacaatacaggtttcaagacacaggaacagtcagctagcttgtctcatggccatggcagaaccgttgtgtccatttttttctgttctgctaacaggcaacatcactcactcactcctgctgcttctgcgatggcggtggtggcgatgtttggatttcttcttgcccttttccttccttttctctatcttatcctttttatccagcttacttttcttttcttttttgctct

SEQ ID NO: 22393 - DNA, 513 bp, Zea mays
  Clone ID: cC-zmle1890010a02a2
ttttttttttttttttttttttttttttttttttttttttttttttttttttttttttttttttttttttttttttttttttttttttttttttttttttttttttttttttttttttttttaaaaaagggggcccccccttttttaaaaaaaaatgggggggaaaaaaaaaaaaaaccccccggaaaaaggggggggggtccccccccccccccccccttttgggcccaaaaaaacccccggggggctgggggggcccccccccccccttttggggggggggaaaaaaaaacccccgggacccccggggggggcctttttgggggccccccaggggggggcccctttttttttcccccaaaaaagggggggggttgggtcccccccacccccacgggggggggggcaaaaaaaaatgtggggggaaaaaaaaaagggggggggaataaaaaagattttttttttttttgggggggagaaagggggggatttttttggggaactctccccggg

SEQ ID NO: 22394 - DNA, 480 bp, Zea mays
  Clone ID: cC-zmle1890010a03a2
aaattatgcttgcgaatcctgaattcttagtagttggggtgctagcactctagcagctgtcactacatgctcagcgcataaccacgggtaggtctacacagaacgaagacgtacagtttatggcaaaccattcagcaaaacacaagtagcaggggttacaatctctgctcaaatgagaccttaaacaggtactaacctccgttctcgaatatttgtcgctcgctagttcatttttgaactaaaacgcgacaaataaaaaagaacgggggagtatttgttagtaatgaacgcccaagacacagcaacggcctctgaaacgagtcacgctgcttctgctgcactcaagcggagctgtctgaaggtcttgactcttccttcatcttagatggcgtcgacatgccttcaccgcctatctcagccttgaggtcattgaggctctgttccaattcatcaattctcgcacccatttcatctatcttt

SEQ ID NO: 22395 - DNA, 397 bp, Zea mays
  Clone ID: cC-zmle1890010a04a2
ttttcattaaaaatattattttatataatgggattatgagtccatggaacactaaacatatatgatgggtccctcaatgtgacttaaacataaatcaaaccgatgactatagcacagttttgtcgaaagagctaaaccgatgactattgcacaagttcatcgaaagtgcttagaaattcacccaataagccaggaccagtacaggtccaacataggatttgacgcttgcgtatgcacaaccaggataaagatccacctgtaaatgggccttataatagtccacagaatttaccccatttctcttacataaggggcatacgattgccccattataattccaaaactggctaaaaatgctcttgacctacagatgcttgttagcagactgatcattttg

SEQ ID NO: 22396 - DNA, 470 bp, Zea mays
  Clone ID: cC-zmle1890010a05a2
ttttgtacataatggtctttggatattttttttatttgcaaaataaagtctttgcatacaagtctcgtcacaaacctccataaaggcacactgttcatttctagtggacaaatattattcatcatcaccatacaaaaatttattatttccctaccattcaacaatcaatcacacagttgcttcaacggtggggatgttgacgtaatcatgggccatcacctccttgctctccatggctaagtagtagtacaccataattccggcgaagtagaagagctgtaccaagccggagagcagtgcgtatacggagaacagagccagccccatgggcatgttcttcttcaagcatgcaagcgcaaccgcgtagagcagggacggaaccatcgccaccaggtggaccgcgacgaccagcacgaagccttccttcctgcacacccgtgtcatcagccgccacgccagcctgagcgcgc

SEQ ID NO: 22397 - DNA, 85 bp, Zea mays
  Clone ID: cC-zmle1890010a06a2
ttttagaccactgagacgagccatagatttaggaccactgaacggcgatgaaaaggttaaaatgcaagcgacaacagtttaaggg

SEQ ID NO: 22398 - DNA, 416 bp, Zea mays
  Clone ID: cC-zmle1890010a08a2
ggaggggcaaaaggctcatcttgattctacttgattgatgaaatgagtaacaacaaaataagaacaaatagcccacagttgccaatttccatgactcacgagttcagcaatctttatgactcacaagcgaaccagtccaaatgcaaagacactagtagttcattacaagactaggacacattattatcccgccgtattctttagcagaatgcaaaaaaaaaggcagcacatgcgttgcacggaaacatgatggatctcacactactcaataacctaatcgagcaagtcagatatcgatttcttcttgacaaacggatcagtagcggcaatcaaagttgacacagcactgttggggaaaatgttgtcagccttcatcctctctctgaatccataagcaggggccttagcatgtacat

SEQ ID NO: 22399 - DNA, 437 bp, Zea mays
  Clone ID: cC-zmle1890010a09a2
ttttttttttttttttttttttttttttttttttttttttttgtttttttttttttttttttttttttttttttttttttttaaaaaaaaatggggccccaaaatgggtggttttcccaacgttcccacattttttttttttttttggggggggggggacaagggcttttcaagaaacccaaaaaaagggggggtttgcagcggggattttaaaaaaaaaaggcccccccggggggatagattttttatttcgggaaaattggccccccccccctttcccgtttttgggggaaacgggagggaccatgccgttttttgaatttttacccaggttcttggggggggggaaaagggtccccaaacccagcttgttgggttttggacccccgggttgggcgatgggcccaaaaatttttttggtttttgggaaggggggg

SEQ ID NO: 22400 - DNA, 473 bp, Zea mays
  Clone ID: cC-zmle1890010a10a2
tttttttttttttttttttttttttttttttttttttttttgggttttttttttttttttttttttttttttttttttttttttttttttttaaattttaactaacaattaattaaaataaattaaaattttattataacaaaataaaaaaataggaaaaaaaaaaaaaaacccccacaaacccccccaaaaaaaaaaaaaaaaaaaaaaaaagggggggggcccccccccccccccaaaaaaaaaaggggggggggggggggaaaaaaaaaaaaaaaaaccccgggggggggaacccccgggggggggggggccccaaaaaggaaaaaaaaaaaaaaaaggagaaaaaaaaaaaaaaaaaacaccgggggggggggcccaaaaaaaaaaaaatttaaaaaacaccccgggggggggggaaaacccccggggggggccccccccctaaaaaaaacccggggggaggggccaat

SEQ ID NO: 22401 - DNA, 532 bp, Zea mays
  Clone ID: cC-zmle1890010a11a2
ttttgttccaaccccaaacacttctgtagtaaataggcctgtgaggcatacacgattcgtcatcatctttagcaactatagtcgttgcttgtcatgcacatggtacaagaaataggtttgttcactcaaactaacactgattgatttacaacacaacactgactacaaagaacttaaaaacaccagctccgtgaacagcagctgcacagagatgcctctgcttctaaacctgaccaagaatggtgccacgattgcactaggcaaagcaagaaccagcatcgtcatcatgccacctcagctcaacccggcaaccatcccatgggcaacggggcttaaggctgcatgagattcatctccattactaagtgccaagaggaccaagttttaagcaaaaagaaaagtgagagttgcactaacccacatccctgtcgcctgttcacatactggaccatcccaatctttccccttgccaatcacccgctcactgcacaatcccatttttttaccaacactatcagtcctttcacaacag

SEQ ID NO: 22402 - DNA, 513 bp, Zea mays
  unsure at all n locations
  Clone ID: cC-zmle1890010a12a2
ttttaaggagaatggttggagaatggctattgggggtgagggagggcataatttcaatgccatttaagtttgtggctacaaaactgttacagcgctttgttgcaacaacaaagtggccgagcaaaactaacagctaagccctttggttatttctacactatatggattggatgagattggaaaaaaattagtagtgagtttgacttgctatggatttaaacccacacaattctatccaacccatatggattgagctgaacacgaacaagccctaactggtgtcacctaggtggtttttggaatttgccatggacccatacccgccgcatcgtcttcccattctttcggttcacggacttgacacagcaatattccagctccaactctactagcccagcagcatgaaagagttctctcacagtatccaatgagaagaagtatganaaggtaccatctgatcgcatatattcccgaaatcctattctttgatgaggtaaaaaaccgaagcatcgt

SEQ ID NO: 22403 - DNA, 462 bp, Zea mays
  Clone ID: cC-zmle1890010b01a2
ttttatagcaaacttggatattgaattagcttagtttgtaggatgctattacacacgactctagctataggtagctcatatacaaaccatcacatgatatatagatacacatacgcatgcatcatgcatgcacatatatatagtatggagtaatctataatacttaattacacgcacgcgcgctatctctggatcgtgaagaagagagattgctagctttattccggtccgatgatgatggaggcacatatatatacatagatgcttggttctacaatacgttgacagtaatctgtatatatgcttcgtgtagtggttttggttggttcttattgtcttcaccgccgtcgtcgtggtggtggatgacgacgagtcgccgccgtggccgacgccatgatcagaacaggaacgccggctgcgcgaacgctggcagggacgacacgccctcaaggtgccggtact

SEQ ID NO: 22404 - DNA, 362 bp, Zea mays
  Clone ID: cC-zmle1890010b03a2
gttggggggcgcttgatggtttttttttaaaaaaaacggggacaaaaaaggcctaggtacccgccaaggcggccgtgagggggagaactgaaagccccccaatgctccacaatgctgggaaagccaccctgagtaacaaagcggccgtatcggggcaagggctatatcctggataagccacccaaagagttcgaaaccaacccccggggggggggatgttgagcacaaaaaggacgaagtacgcccccccccccccggagaggccccccaagaagaaccctggggtgaaaaagccccagccgcaggaaatctggaaaatcccgggcttcataatccggcccaagagggagagcctgggcgcc

SEQ ID NO: 22405 - DNA, 386 bp, Zea mays
  Clone ID: cC-zmle1890010b04a2
acctaaaatggcatttcactagctggtttgaagggggggtcatgatgcatccaaatcaaagtaaaaaaaaattaacagttccaagttacatcccaatccatccatgtgcagaggaattgcatgtatccacgatgctcgtcactgctgaaatggcatacctttgcacgcaaagaggaggatcggaggcggagctatattatatatatgcatctttatgaatttgtattctacttgaagtagtaggggaggtcgagcacgtagaggaggaagtatgcccagagcacgccggagataccaccgaagaagaaccctccggtgaacttggcccaaccgtcggcggtctgcagcttgtcggcctccttcttccggccggtgagcgtgagcgt

SEQ ID NO: 22406 - DNA, 461 bp, Zea mays
  Clone ID: cC-zmle1890010b05a2
tttttaacaaaaacaagcatagcgcaaccaacaaccatgctagcattacggttccagagttcaaggcaaccacagacgttaagttaacatagcatcatttcgtcttggttcattcgctacagtatccactcatagtggcaacgaagacttgtaactacaggaaagacccactgcaccacataccctttccatgccaagtagatccgcgtcttcagtctccaccaacctggcgtttccaggagtcctccacaatgagctcgtctactccccagtcttcatagcttccatcaggtaagtaccgtctgatcgtgaagggtatcttgcgcgctctcagctccttcattgcaatctcaagagggtcagtttcaccctcaagctcaaccatgactggagcattcatgcttatctgcaaggctcgtgtacccaggatgcgcgcacgttcgtacttcgtcatgtatttt

SEQ ID NO: 22407 - DNA, 252 bp, Zea mays
  Clone ID: cC-zmle1890010b06a2
attgtctccacaagtaaaaattggaggaccccaaaaagttctccggaaaacaagaaacgggctcgcacgagagacgcggcaagctctagaaacaacgagaacagacggccgaaaaaggagggggggaaacgcctggtaaaaaacgaaaacagcccacaacgggccacaagatttacgctgaaaacaaaaaaaaaaagggcgcggggggggggggatagcctcaacaggcaagggagaagaaccgggccccgg

SEQ ID NO: 22408 - DNA, 109 bp, Zea mays
  Clone ID: cC-zmle1890010b07a2
cacccgttgagcgcgcgagagaggcatgacggaggaacgtattggagatctaacatgtcacacagacccaccgtgacaataacacaagggtatgggccaaacagaccgt

SEQ ID NO: 22409 - DNA, 457 bp, Zea mays
  Clone ID: cC-zmle1890010b08a2
ggagggggagaaaccagcttttgggccatccatccatgcataaaataaaaaacgggctaagagacaaattctatgcacctcctcctccgcggcctttacaccatgggaggataaccagccccaactacacaaaagaagtaccactcccccatcaaccattccggaatctgaatactctgttttaagttaacgagacatctgcttcttgctcggaacgaactggtgcacggcacccctccttccttcctcatcaccagcaaccaagcgggccatttgagcttccatgcgggttcttttgagctgccgctgctactgttgttgcgattctgccatttgggcttccgctgaacaggcaaaaaccagttcaggtttaccactccgatgcatggtcgtctggactgtttattttccggcagcaggcttctggtcgcttgacggttttaaaggcgtcggcatt

SEQ ID NO: 22410 - DNA, 488 bp, Zea mays
  unsure at all n locations
  Clone ID: cC-zmle1890010b09a2
tttttttttttttttttttttttttttttttttttttttttgtttttttatttttatttttttattttttttaatttaaattatatttaataaaaattaaaattttttatttttattttatttttatttaaaacaaaaaaaaaaangccacaccccgtttacaaaaaaaaaaaaaaaaaggggcccccccaaaaaaaccccccccaacccctttttttttaaaaaaaaaccccccaaaaaattacccctggaaaccccaaaaaaaaagggaaaaaaaaaaatgggggccccccccaattcccccctccccgaaaaaaaggcccaaaacttaaaatatcccaaacaccccccccccaaaaatttgaaaaaatgggggaaacccccccccaccctcttttttttttaaaaaacacaaaaaaaagggggcccccgaccaaaaaacccctttaaatggggaaaaaggccccacacccccccgggggccccct

SEQ ID NO: 22411 - DNA, 246 bp, Zea mays
  unsure at all n locations
  Clone ID: cC-zmle1890010b10a2
ataanngggggggggaaaaaaaaaaaaataaaaaaatttttggtaaaaaaaaggagaaaaaaaaaaaaaaattgggaaaaaaaaaaaaaaggggaagaagggtgtaaaaaaaaaaaaaaaaaaaatgtttttttaaaaaaaaagggggagaaaaaaaaaaaatttttaggaaaaaagaatattataaaaaaaaaaggggggggaaaaaaaaaaaagggaagatgagaaaaaaagaaatttataaaa

SEQ ID NO: 22412 - DNA, 505 bp, Zea mays
  unsure at all n locations
  Clone ID: cC-zmle1890010b11a2
caacgcactttattctttaaactgcaaaagatcttctgcaggaagaactgaggtgtaaatagcgtccaaatctcacgtggctatgaaacatttaactctctacattgctcatggagctatagaacacttaacaagaatatctcagcccatggtgtaggatggtgacggcaggtttatgacagtgctcttcaccttggtcatcatgttaatgctgtttgttatcccctgggacccaatgccactgtctttcagtccctggaaggggaaatgatcaggcccacgagccggtgcagagttgatctgcacagttccagtctccattgcatcactgatcaggattgccttgttgatgtctcttgtaaaaatgcatccctgtaggccgaaattactggcattgcaatggtggatgccttcctcaactgagttaatcctaatcacaggcaagacaggcccaaaaggctcctcccatgcgatcctcatgtcanggcggacatgatccagcagc

SEQ ID NO: 22413 - DNA, 403 bp, Zea mays
  Clone ID: cC-zmle1890010b12a2
ttttaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagcccggacgcgtggg

SEQ ID NO: 22414 - DNA, 501 bp, Zea mays
  Clone ID: cC-zmle1890010c01a2
atctgccagatttattatatcatagctcacagaaaaatgtcatcagcactttaaggatccaattgacaagataatttctcggggtaaaagatccaatctagtactacaagatatatataaaaaagacatgcgacaccagtacaacatccgtgcaggttgtcacagtctcaggaattgcatatgtttttgaactgactcctccgagagcaagagcgcaaacgccacaggtgcagtcatgggagcagcagtatcttgccgatgtgggtgctagcttccatcaacctatgagcctcagcagcttcacataacggaaacgtcttgtaaatcaccggcttcactttgccagcagcgacagcaggccacacgttcttttccacctcactaacaatctctgccttattagcaaggcttctgttgcgcagtccagcagcttgtatggtcaaacggcgtgcaagcacagcttgcaggttcacttcacccacgcgtccgcggacgcgtggg

SEQ ID NO: 22415 - DNA, 431 bp, Zea mays
  Clone ID: cC-zmle1890010c02a2
cttatccaatccatatgccataacttggtatcgacatgataatttcagcacgcgttcttacatcacagagggggtggtaagtaatacaacctgctgctccgaaccacacctagtacacgtccgctaactttggcatgcagggagtacccaaaaaaggagctttacagtggagtggacacacccaaactgacgaccggccgtggcccgacgcgacacgagcagtcgatcgttcgagcaaaaaagcggagtggctggtgcaagcaagaaggcaagggagcagcagcgcactagtatttagtatggtacagcagcacgtcgtagtacaggtgcacgtcgtagtatgtaggtgtatatataggtacagtacagtccgtgcggggcggattgcaggcagagcaaaacgagcaacgccagcgggagagcccggcggt

SEQ ID NO: 22416 - DNA, 207 bp, Zea mays
  Clone ID: cC-zmle1890010c03a2
ggggaaaaggggttttttttttttggggggggcccccacctttaaaaaaaaaatttttttttggggcttttcccccaaaaaaaaaaaaaggggcccccgggtcccccccccggttttggtaaatttgtgttagttaattgtggggggcgttgggggccccccgggtttttcggggtggttctcggggggcccccccttttctctttt

SEQ ID NO: 22417 - DNA, 440 bp, Zea mays
  Clone ID: cC-zmle1890010c04a2
ttttatatatagcatcaaaattatgtaatgaagagtagcactgattattgttacatgacgaaggttgagcatccatggaggctagattatagacagacaccctgattttacacgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggagc

SEQ ID NO: 22418 - DNA, 410 bp, Zea mays
  Clone ID: cC-zmle1890010c05a2
aaagagaaccacaccggctttctttattcaaacatggccgattattcagggccccggcaagagaagtcaggcccaaccgcacaagaagtacacacacgcccaacccaacaggattccccaactctatcaatacatctcagatgggcaagatacaggccaaaatttcctgaagcgaagaggtacacaaaagataccacacggtctcacttctgcatatcggtttacatgcttcggcactgacaaacgaatggggggcagtacatatgggaactagtagaagagacccgaagttggccacgcgcccaagttacaaccccagctccgagaggagattgcgccaccttggcgtctcctcgtcgaatatgtaggtcagctttgttaccaagactccactgccaccaattgatctc

SEQ ID NO: 22419 - DNA, 358 bp, Zea mays
  Clone ID: cC-zmle1890010c06a2
ttttgtgttgatttggaacacgatcttcgaatgaatggatgaactactactacatgattccagctattaatatagcaatggcgacgctgctagtttgctcctcctcaaggcacttggccaagaatctctcagaaaggaaactgaagattgcaaaccgccaaggcgccaaggcacgaacatagtatataaatattacattgttgactccatagcgctagggtgatcatctgcagtcaaccacagaaattgacaactagagtcttatttattgtgtactctaacgttgggaatcagtgggctactatcagcaatgggaaggaccacttaattctcagatctgtcgacgaagatgcgcaat

SEQ ID NO: 22420 - DNA, 493 bp, Zea mays
  Clone ID: cC-zmle1890010c09a2
aaacttcagatcttattcattgtattgcatataggttaataaaggtttttagccatctaaaatagctttcgaagatatataaataccgccaatacatgcagggctaatcactgtttatagccagggtactagtaaaaatgaacttaaacatgaacttggggccctgtgtatggccaaaaaaactgcataataataataataagatccactttgtaattgacgcaattatttaagcaaaaatacatatatcagaatttcctcatttagtcgacttcttcgatcttgggtccagcaccgctgccaccagccggcgaagcattctgatccatgccaccggccatgtcaggaccagcggcgccctgatacatcttcgcgatgatggggttgcagatgccctccagctccttcatcttgtcctcaaactcatcaacctcggcgagctggttgttgtcgagccaattgatggccccctcgacggcgtcatcgatctttt

SEQ ID NO: 22421 - DNA, 426 bp, Zea mays
  Clone ID: cC-zmle1890010c10a2
ttttaactacccacaccacatattattcataaacagaatgggcccacagggatttatccataccaacatgctaattggggcagacgctactgaccacctagagctgcctactcactgactcagactgatccatcatgcggcagcgtccgaagttggcatgcttactgacgacaaactttggtccctatgccttggatgggttgtttaacacatgccccaagcgacaaccactaaatcgggacgatctgacatgaacctctcagaagctactagaccctacaagccgcgtattagtcttacgcagtcgcgccttatcctccatggtatgcagtttctgctaccaccatggatgattggccagcttgtcaatctttgtcataggaggaggagcgctctgcacattactcacgtctaagtggtggataa

SEQ ID NO: 22422 - DNA, 437 bp, Zea mays
  Clone ID: cC-zmle1890010c11a2
ttttggtatcgacatgataattttagaacgcgttcttacattacagaggggtggtaagtaatacaacctgctgctccgaaccacacctagtacacgtccgctaactttggcatggagggagtacccaaaaaaaagagaggagctttacagtggagtggacacacccaaactgacgaccggccgtggcccgacgcgacacgagcagtcgatcgttcgagcaaaaaaagcgggagtggctggtgcaagcaagaaggcaagggagcagcagcgcactagtattagtatggtacagcagcacgtcgtagtacaggtgcacgtcgtagtatataggtgtataggtacagtacagtccgtgcggggcggattgcaggcagagcaaaacgagcaacgccggcgggagagcccggcggtacggtggcctctcgccgccgcttcac

SEQ ID NO: 22423 - DNA, 354 bp, Zea mays
  Clone ID: cC-zmle1890010c12a2
gggaaaaagggcccaaaataatttcattgttccatttgcccattttagggggcacataatcgagttttaaatcgcttaacaagtcctttgatggccccatagggaaaaactgtttttttttaaaaaaagcttttggatttttcattttgccaacaaattccggccttgtaaaaaaaaaaattgggaaagtttgccctaatcgtccaacttaatgatttttacaaccgatgaattttccaccttttgggaaaaaaaaacacgggcatgggacttgaacacaccacatgccttgccatgggttaaaacaacctttaaaactgacttatttgtattactgggtgattccgctggatg

SEQ ID NO: 22424 - DNA, 355 bp, Zea mays
  Clone ID: cC-zmle1890010d06a2
cacgcctccgttagcttggatcctctacaacggacatcctattttttaatttctatttttttctctacactacttacaacggggtccgagggcaacactatatccttccacacccactctctctcttccatccctatcctatatttttttttttttttttttataaaaaaagccgcccctccccttttaaaaaaaaatcggggggttaaaaaaaaaacccccccctaaaaatgggggggggcccccccccccctccccccctttttcgccccaaaaacccccccggggggtgctgaggttctccccccctcttttaggggggggacaaaaagacacaccttaaacctctcggggg

SEQ ID NO: 22425 - DNA, 227 bp, Zea mays
  Clone ID: cC-zmle1890010d07a2
aaagcccaaacgcataagccctggggtgggctacacagaacgaagaacgacaggttaagggaaaccattcagcaaaacacaaggtgcagggggtacaatctctgctcaaatgagaccttaaacagggactaaccttcggtctagaaaattctgcgctcgctcggtcaatttagaaccaaaacgcgacaaataaaaaaaaacgggggagattttgtttaaaatgaacc

SEQ ID NO: 22426 - DNA, 280 bp, Zea mays
  Clone ID: cC-zmle1890010d08a2
cctcattatttttattttttttttttttccgctcttttttttatctcggggtggtttttatcttttttttcccgcaaaaaaaaaaattttgtctcatatagtcagggtccaagaatcctaatactaattcttttccaaaacaattttcactcacaaagggggaccatcttcccctttcttccaagggttaaaggaaatcttttctcttcttccccccacaaaaccaaaggagtaggctgttcttttaaaaacccgggcccctggggaaccccccggggaa

SEQ ID NO: 22427 - DNA, 135 bp, Zea mays
  Clone ID: cC-zmle1890010d10a2
attttaataaagaaaacacggataaaaagaacaagcatgggtagggtacattagtgtgattcatgatattacttattcgaggaagtctaacataagttgccaacaatcaatacacgcgtgtaaagggcaagacag

SEQ ID NO: 22428 - DNA, 284 bp, Zea mays
  Clone ID: cC-zmle1890010d12a2
atattttttatttttcctctcttattaggaagaccaacgggcggattcagattctttttgattgaaggaatggcgtccaccaaaataagaacacatttcccaacgctgtcacattttactgattacaaatgtccaatctttctagggtcaaaggggaaccacatcaaatgcaaaaacagtagataataagtatgcgactcggacacatatattttcccccgcgacttattatgcaaaatgcaaaaaaaaaggcgtggcatgccatgccctcaaacatgaggggc

SEQ ID NO: 22429 - DNA, 470 bp, Zea mays
  Clone ID: cC-zmle1890010e02a2
ttttataaaaaaggggttcgctgatatatagagagtttatataattcggattaaaccggtcctagtcatcatatactctaatgacaagaactgtatttacaagacaacccagaaacattctctctgtcccaaaataaatcaatttctcagagttatcttaaatcaaactatttttaagtttgaccaaattcataaaaagagcatggcactgaattagtgtcactaatgcaccataaaatatttttcataatgtactcatttggtgtcatagagacatagacgatggtgcctttcctataaaattggtcaaacttaagataatttgactttaagtgattctagaaattgacttattttgagacggagcatattactataagaaagaaaagcataagcagtataactacttcacggttcagcttcaacgatcatggactcgggatttggatctcagtatagaagagtacttc

SEQ ID NO: 22430 - DNA, 360 bp, Zea mays
  Clone ID: cC-zmle1890010e03a2
gcaatgaaatcccattcttatgttaattacagtcttacatcacagaggagaaagcagagtgacccatccacagcagaagcagatggaagcactggagcagcaccaggcaagagatcgcattcacctcgcatggcgccaaccacagcgaaacaagagaggagagagggccacaacaactcacgagacgaccgcacaggaaagaaccaaagctgctgcattcaagtgccagctgccagccgggacacggtggacgcatgctggtcgacgactccctatccctagcagcagccacggcccacggccaaccgggatacggctcccttcattcaggcggcggctatcgccggtggcgccgcccag

SEQ ID NO: 22431 - DNA, 343 bp, Zea mays
  Clone ID: cC-zmle1890010e04a2
accaggtccgccacggtccactcggcgggcgccatgacgtgcagcggccacatgctctgctgcaccgccacgctgaccaggaccttgctcggcgtcctccgccccgcgtcgccgtccgggggcggggacccggagcggaagctcgccccccggacgccggcgagcaggtcgggcagcgtcttgggcctctgcttctgcggctggtggtgccgctgctccgtcccgcgcccgtggaacgacgccgaccgctgggccggggccggggccgccgccgccccctgccgctgcctgccgcccttctcaccgtgcggcggcgccagaggaggcatcgcgagcgccggct

SEQ ID NO: 22432 - DNA, 409 bp, Zea mays
  Clone ID: cC-zmle1890010e06a2
aaaaaaaaaaaaaatgggggggttaaaaaaaaaaagggtttggtttttttcaaaaaaaaaaaaaatggggggcccccagggtttttttaacggaaaaaaaaaaggggaaaaggggggtttcccaaaaaaaatggggggacgggccaaaaaaaaaaaaaaggatcgggcaacccgggggctaccccaaaaaaataggcgcgggtcctggggggggcccacttttttttaatggggggggtaaaaaaaggggggccaaaagaaggaaaaaactttccttgggggaaaagggctcactgcaaaaaaccaacaaaaaaaaaaaccggaaaaaaaaaaaaaaaaaccgggggggcctctggggggggcccacccaaataaagggggggggcccctcgcccttttaaaggaaaaa

SEQ ID NO: 22433 - DNA, 283 bp, Zea mays
  Clone ID: cC-zmle1890010e07a2
aaaggggcaaaaaacaaacctacatgggggtccaaaaagaatttccatttaagcaaataaccaggcagggggggttttattaaaccctcccaacacgtaaaaaacggggttctaattctaaccaaaaacaatttttgttaaatttgggggggggggccaattgtttaaaccaaaccaatttttaatgggggccccctcgttccctagccccctaaaaaaaaaaagaaaaaccttcaggccttgagggtggacaggaaaaaactccacaagagggtttttaaat

SEQ ID NO: 22434 - DNA, 437 bp, Zea mays
  unsure at all n locations
  Clone ID: cC-zmle1890010e08a2
ggggtccaagtaccagttttttttgacactgagaattacagcttccaagtgacacaatacagcagcattcagcaccacacgcggcactgtactgcaaacccaattcggttcatcattatacaggaaggatagaacgaatacatggaggcacgtccaggtcccggcaacacaacgcagcagcgaccccaaaggccaggtagagaaaatactacatggcatacctctgggtccaggtcctcgcggggttctcgtacttgtgccggtccgtcttgtacatgtgagctatctcggggaccaaagggtcntcngggttcggatcagtcagcagggaacagatggacagcagcaccttggagatggttagtgccggactccactggtccttcaagatgtcgaggcaaatgctcccgttgctgttgatgtttggatggaacacc

SEQ ID NO: 22435 - DNA, 467 bp, Zea mays
  Clone ID: cC-zmle1890010e10a2
ttttgaagaaaaggacctatgtatattcattccacagttaggtgccaatctaccaaaaagtagaacatccacatcctagacaatcttgtggaaacaaattatctccctcgcggcaaaaccgcctccatctaatacctagcatgccccctcatttgctgtcagtaaaatctgcgtcaatcacatcgcctccgtcacctggcttctcagaagtgcccgctgaaccagcagaagaagcatcagctgcaccaggtcctgcgcctggggcaccctgctggctgtagagggcctgcccgatctgcatgacttcctggttcaacgcactcatggcgtccttcatcgtctgcgtggagccaccagcaacagcatccttgagctcttgcagcttcgactcgactttccccttgacgtcacctgggaccttgtcccctagttccttcagttgcttctcggtctggtagatgaccgac

SEQ ID NO: 22436 - DNA, 369 bp, Zea mays
  Clone ID: cC-zmle1890010e11a2
ttttagcacttgcaacctacgaataatgaggcctatttaacacattacagactagttacgctaccaatcacatagaccagggggtgtctaaacagaagacggacagcctactaacattgacaatctctgcagactccttcggatatcacatgctacaccttcatggactccaatggacctcccagttacttggacaccatgcgtgttcttcatggactcaattggacctgcaactaatttgcacccatgcttacccttggagtgagcctggcgagccatctcactattgaatgtgttgctggatgatttgcaggggactgacccaacacatgttggagacttctccggtgatttgacattgtctgcagg

SEQ ID NO: 22437 - DNA, 410 bp, Zea mays
  Clone ID: cC-zmle1890010e12a2
ccatgtaactttattgatcacgtaaactgcatgcacaattgcacacgtttcacaaattccgcgttttctccctgtctctctctaataaaaagaggacattgaacatgcttagttatttcattgagaggttcactgctaatacagatgaacgaagtactctaggtattagttccttctttcttgatatatcatatcatatcatggccgatagataattgattattctgatactacgacggcaattcattacaagcggccggcggggcaaacactggtggggcgtggtgtctacaggacgaactgcttgcggtaaatgtcaaacgtctccgaagaggacaggttaggctcctgcacgccgcttaagttggcgacggtgcggatgggtgcgcccatggccccctgcagatcgc

SEQ ID NO: 22438 - DNA, 299 bp, Zea mays
  Clone ID: cC-zmle1890010f01a2
tttttgcaccgatacttttttattccaaactaggggcttggaatctggggggcccattacacttcggcccgacttacgaacccaccctagctaaatgctgtcctttgaaaaatcgacaaaaacatcaaacacttaacagaaaattcctaagctgggagggctaatggactcgctcactaaccctcgttggaaggggctacctgcccaattcttagtcggtgaaccctgctcacctgctgcataaattaattaccccccccgctccctcagagacggtatgtttggcgcgctctcctggg

SEQ ID NO: 22439 - DNA, 467 bp, Zea mays
  Clone ID: cC-zmle1890010f02a2
ttttgatactaggaggtcgacttttacctaaaatggcatttcactagctggtttgaagggggggtcatgatgcatccaaatcaaagtaaaaaaaaattaacagttccaagttacatcccaatccatccatgtgcagaggaattgcatgtatccacgatgctcgtcactgctgaaatggcatacctttgcacgcagagaggaggatcggaggcggagctatattatatatatgcatctttatgaatttgtattctacttgaagtagtaggggaggtcgagcacgtagaggaggaagtatgcccagagcacgccggagataccaccgaagaagaaccctccggtgaacttggcccagccgtcggcggtctgcagcttgtcggcctccttcttccggccggtgagcgtgagcgtgggcgccgtggacgggtcgccctcgttgaaggaggcgacgccgtacatggtgaggc

SEQ ID NO: 22440 - DNA, 427 bp, Zea mays
  Clone ID: cC-zmle1890010f03a2
ctgaatattcagttaagaccgtgccaagggtccttttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgttcaaaacatatcatattcgtaaagcagaaacataaatgtactcccattaatgtggaataggcggaactgaattagtcaattcaag

SEQ ID NO: 22441 - DNA, 314 bp, Zea mays
  Clone ID: cC-zmle1890010f04a2
aacagaattccaactggaacggtgtttcgaattaaagcaaattaactctggtactggtacattcgactcgaataggatccaaaaatactcacggcaatatcactggccacacaaagcagacatatagctatggataaattaggctggtgcattgcccagccaccaccatcgccagcaccccaggggaaggactgatcgaaagtcacgcctagatcttgttgaaggcaactatgtcgcaactctgtacgtactcgttaactggctcagcgcacagatagtccttaatgagagtgtcgacagagacaaggtcgtct

SEQ ID NO: 22442 - DNA, 354 bp, Zea mays
  Clone ID: cC-zmle1890010f07a2
ttttaggatatgccatacgacgcactttattggggttaaagatgttacatcgtttaccagtttgaagaataacaccagagggttcatcgatcccaaatacaggttcctttcaagagagagctactttgctatttcatgtgccacctgtgcgtctgtaaattggacacagtcttttgggagcagtgcacggcattcttgcgaaaaatgagaagaaaaaaaaggatattttttcactggcttcgcctactttcatttccggtgttcgttatgctgggcaagacacacatttattcatatcgctttactggggaacttgcacagagtaaatgactgcacgctcagctctttatgcgg

SEQ ID NO: 22443 - DNA, 355 bp, Zea mays
  unsure at all n locations
  Clone ID: cC-zmle1890010f08a2
gggcaatgaacacaattattccttggcgattgaacaatagtttacattatgggacaaaccgaaaaccagggggcgctcacatgcatccggacacctaaaggtcaccgggggggcctcccttacttgccggggacaaagttgggggcgtaggcccaaacgttgttgttgacggggtcggcaatggggtcagggaggtttttgagcgggcccttcccggggacgatggcctggacaaaaaatccgaacatggagaacatggggagggggccgttcttgagctccttgaccttgagctcggcgaaggccttggnggtcctcggcgaggcccagcgggtcaaaactgccgccggggtaa

SEQ ID NO: 22444 - DNA, 402 bp, Zea mays
  Clone ID: cC-zmle1890010f10a2
aaacccacatgaagaactcaaatgggtatatgttcccttgattaagggttttttttcctttcaaaattatataatctagcttatggattatttaataagcacataattatctgtttatgtattatcataatctaggtatctagattatacaatacatttaataacctgttttgtttgtttgtctattaacttatttaaacgggattatttaatataaaggataaacaaacagggctaaactgacatgaagaacccaaacgtttacgaagatactgctccctgcttctgggccacccgcgccaaaaatagtttgccgaccaaattggtcgcgaggctgccgaggaagatgtccccgttgaactccgtcaccgacgtgacgaagttgatcaccttcccctggga

SEQ ID NO: 22445 - DNA, 298 bp, Zea mays
  Clone ID: cC-zmle1890010f11a2
atagaatatatatagaataaaatcatatcaaagaggaccaagaaaaaaaaggtaacagaaaatgcaaacggaacaaacaacaagcaggaagacacacgtacgaacaagaacacaaagactgacgccaaacaagcaaaaagagatagcaaaatgaagaaaacagaaattttctatttaacacacacaacacaaaacctatgtatggcaatcaactaggactcgaataaaaaagattaaccaacaccacaagctagatagagaaaaaacaaattcatggacgatgaacgaagagatcaga

SEQ ID NO: 22446 - DNA, 533 bp, Zea mays
  Clone ID: cC-zmle1890010g01a2
ttttaggataaaatcagggttgttggggcttagctataagagcacccagattctcaacgatgatcctatagagccgactcaagtataattctcgagcctacaaaaagtcttccaaccaacaacaaatttccgcacactacatactcagaaagtaaaaaaaaaaaagataacaaaaggtatagaaaggacgaggggaatcgcaagttcagaccaccaacacaaccctctacggacccaggtatctacgcttatgaggagtactcaaagggttgcggcggttgtggctcgtcgtcaacggccatggcagatgatccggacccctgttggcttgcagctgtggcagtgttgccggtgcttcctccaactgctgtgggagcatcggtcagtgcaaggtcctcggcctcagtgggctgaaggtctcggaggaggatgaatccagaaggcgctggtttcacagggacgtatcggctgttttcaagaaacttgatgaacttctcctgtgcagggatcacccgagctgggttcgtcaggag

SEQ ID NO: 22447 - DNA, 453 bp, Zea mays
  Clone ID: cC-zmle1890010g02a2
atcattatcaacttctgttgaataagcaaattcagagttcaacaagaaacgcacgggcacttgtctcgggagggggtaaaaaaaagagtcgccaagtccaggagagggttaagaaacataaatatgtgaatcttgaccaccccctaaatctaatcaccacaaaggctaggacttggccctaacgcgactgcaacacagcacgcacattcaacaacgaattattgctatctacggagccatggtaaaaggccggggcgggcaccatgaaattacgggatgccccaggggaagaactgctggcgaagaacaggtgacatgccccgtcatttacagagtcgccaacaggcattcttttcccttccgctatcagaacggcttccttcccgctatttcctcttgccgctgccaagggaaaggagctccaagctgcggtggagtggctcgtcgcgggag

SEQ ID NO: 22448 - DNA, 421 bp, Zea mays
  Clone ID: cC-zmle1890010g03a2
ttttgaaaagaaaactatacgtatcctgctattgcactgcagtagcgcagttgatcaatcgttttgggttttggccatatacagacttgagcatggcagtaaagagaagtctgaacttatttgctaacgaagctcagatagagagctgatgagtagcccattcgcccgcgtgatcactttgtgagctgctcctccttgctcgcttcctccagctccctgaggcccccaaccctctgctcaatctcctcgagcagctcctcccgcagcagctcctccctcgcagacgcctccaggtcctcttgcctgtcgtagtaccagtgcacggtcccgtcgccaccctggctcctgtacgtctcgctgtcgtagaagggatccttcatggacgcgaagaagcagactccccagacggtgaacatggcgt

SEQ ID NO: 22449 - DNA, 500 bp, Zea mays
  Clone ID: cC-zmle1890010g04a2
ttttacgaactaaacacaatgtattacatacggagtatatgcttacaggcgtgatgccgtagtcaggattgaggattgcgcgcttggtgcaaatctagatgtacatacaggctgccgaggaatcaggccctcacggatagatgtcaatatggccaaacggcgctagctagcctcaacaagtttcgaagaccactatggcacacttaagaacaagcttcagcttcaggaaactggtggtgacagatttaatacactatctaggttacaatgactgatactgcggtacaggcagttccgaggatgttgcaattttgaggcaccaggtacggttacttggcagctggagaactcatgcctcttccacttgctcttcctcttcctggagaaggttctccctgttgtcgtgggcccagaagccgcgcacatctataagcatgctggcgacagtcccaccttgcttgcaagaaagaaggtctgatagcgagatcctgagaggatct

SEQ ID NO: 22450 - DNA, 435 bp, Zea mays
  Clone ID: cC-zmle1890010g05a2
gtgcaatacagtttccggtctcaataagatcaatactagtttgttgttacaggcagcaggctggccatgcatgaatcatgaccgatgcaacgcttcaggttcctttacaacacgcatgcatctagctttccacagcaaacaactggcggcggcggcagcaggtatgctgatgcaccaacgttctagtggaacttgaggctggtgagcacgttgttgttgacggggtcggcgaggtggtcgagcaggttctggaacgggccaacgccggtgacgagcccctggatgaagtaaccgaggatggcgagcatggcgagcctgccgttcttgatctccttgagcttgagctcattcatctccttctcggtcttgccgaagccgagcgggttgaagaagggcccgccggggtaggacgggtcgccggagccggcgaggaac

SEQ ID NO: 22451 - DNA, 373 bp, Zea mays
  Clone ID: cC-zmle1890010g06a2
cattcaaacatggcagagttggcatttcccgctacctatcatacgagtccgccgtagtattccaccaaaaacaactcccatgtccgagtcttcctctgtcgaacaatgcgcgccagccgagagcgagtagtttacttcagcttcttcttggggcggagctggttggtgtgaccgcacttcttcttgcggcagttggtggcacggggagggagacgagcgtagcacttgcggcagatggccttgtcgcagttgtacttggaggcaagggccttgagcgagggctcaatgataccaccacggaggcggaggaccagggggaggggagactccttctggatgttgtagtccgacagggtacggccatcctcgagct

SEQ ID NO: 22452 - DNA, 417 bp, Zea mays
  Clone ID: cC-zmle1890010g08a2
accaaaaattttgctggcaccaaagcaatataaacaatttaagcatttcatgaaaaatgggagacagaaaatttatggcatacattgttatatagatccccttggtataccaaattctgtttactacaaaattgagggaacaaacataagcccaattgcagtctagcaactgataataagatgatcatatagaagtctgaacatattccaacaagctctcaaacaatggggtttgctgcgctagcaatcctaggccaaagatcagcacactccttgccgataggtccagtgatagcggaacctttcatctcacccttgggattcacaatcactccagcattatcttcgaagtacatgtagaccccgtccttgcggcgccacggcttgcgctggcggaccatgacggcgggcattacc

SEQ ID NO: 22453 - DNA, 496 bp, Zea mays
  Clone ID: cC-zmle1890010g09a2
ggagaaaggagatgagatctcatacatagttgattcagagtacagacataagacatgatcagaaattcataatgcagcagcctatgaccaggcccttctcttgagtcagtcacccccacttcctcgcgcaagcaggctgacaaatgttggaacactagccacacagtggctggctgtctaacgcaaacaccactcgagagtcgagaagaccgcgatgcatcgcaccctgcctcttttatttggggatcgccgcagccagcagaattattattagggtaccagctagtagtttctttcgttcgttcaccaagggaggatcttccagcgctggttgtcgccctcgcaccacttccagagcacgatctcggtaccgtcatggacgccgccgtgagccttgtcgccgtggaaggcgtcgaagttgaggtagatgttgttgaccatgcggacgcagcggaagccgttgccgacgtcgcggctctcggtccagagcacggac

SEQ ID NO: 22454 - DNA, 523 bp, Zea mays
  Clone ID: cC-zmle1890010g10a2
aggagtactacaatttttattgaagacgacaaatagttcgaacgtacaggtacgacatacaagccttcaaatttattcagtgaaccaaaacagtaagccatctgtctgttttttaggactatacacttcaccggttgggaagatatctacttaatcacagctacgtgtgtgcaatatatacagtggcatatcatcttctcgctatgagatacagtatatacagttgtattctagagcccacgggggaaatgtcagaactcgaaacccccgttcaattgaacggataaagaaggccttgccatgttgtcaaggggtgtctccaaggtgattactagtcccgaactgccgacctggccattccatttggatcgcccaagagagagagctgtgaatgctgagggatgtcttgagcaagagaaaccacacattacgctgacttcctccttcaaagagtggacaaactcggtgcatattccaggatcagttccttcgaaagtggggcaaacactgatttgaatgctgg

SEQ ID NO: 22455 - DNA, 414 bp, Zea mays
  Clone ID: cC-zmle1890010g12a2
agcagcaaccaacaaaacatcggatttttttatattggaagcatgcgggggcaagtcacaaacagggtacaatcacatatgtccattaaaaggggggacatatgccagcatcatttcaactaatctaatcaggcttatttcattttgaccatccagctgcaaaaaataagcggggggatatggagccctggcaaataaaaaaacgggagaggaaatacctgaagatttccaacgataatgggggacattatcacacgagcctctcaggactaattcattcttaactatccagaccatgcctggggagccaccgcatgggggacagagctcaacctatcgggcaggggggtacattctggagggtggcctgcatccaccatacggagcgcaagggcatcaactacttgatccttt

SEQ ID NO: 22456 - DNA, 350 bp, Zea mays
  Clone ID: cC-zmle1890010h01a2
atataagcccgactgcccggttatttatttctgcaaaggtacgattatacacgcacactcgtatggtgcagatcattatttcagcaaacaaatcacttgtttgcactaggattgtatagtcgtagcttgagactaatacgacatgatttgttattgcttaatatttactaactcatccccgaataatatatattagcttgaatgaatcttttgcatgtatgtacgtatagttcgtgcttcttcccacaacatgcatgtatcttacgcctggctgtagtcgatgacaatcttgccggctccgaggatgccgatggtggtcaaagcctgctgggagaggaagagcgtggcct

SEQ ID NO: 22457 - DNA, 445 bp, Zea mays
  Clone ID: cC-zmle1890010h02a2
caactgaacattcacataaaaatgggcatatgcagtaggggacacatgccttccaccactgaactttactcggccacagaattactcactgagcctgcaatggtaggattctatacaggttcgcaggacatgaacaaccaagaaccatttattatatactatctgcggcggaatgacggaggaaaaccctgttttaataaatctctgggaacaccagcggccaagcaagctcagacagcctgtgttaacaggaactggattcactcgatgcaaaaagtaactccaaaaaccagagtgcgaagcagcttttaaatcctttcaaccaaaagccaccaacattcacagaattcctggaatctccagattagccgtccgcttcgagaactccatcagccaaatcttcattttcttgaccttggcataaagaacctggcaccattcttct

SEQ ID NO: 22458 - DNA, 263 bp, Zea mays
  Clone ID: cC-zmle1890010h03a2
aaaaaaaaaaaaaaaaaaaaaataaaaaaaaaaaaaagcgcgggggggaaaaaaaaaaaaaaaaaacgggggccgggggggtaaccccgaaattcaaaaacgggccccctgggggcccccctttttcataaaggggggggtttaaaagggggggggaaaaaggggaaaaatatataccagggaaaaaagggaaacggataaaaaaaacaaaaaaaaagcggggggaaaaaaaaaagtcaaaaaagggggggcccaaaaggggg

SEQ ID NO: 22459 - DNA, 338 bp, Zea mays
  Clone ID: cC-zmle1890010h04a2
ttttcggagtcgaattaccgcattcaactcaagatgaccgagggccacgctgaaacaaggagaaccggagtgatcctttagaacaggtaacataactcgcgcaaagcagatggagctccaatcaaacggagggcaacaacggcgtacaggactggcaccctatttatttcaattactggaggtagaagacaccgggggaggacaaggtccatatatttgatcacatttctttcacgggtccaagactttaccgaattatacactgctcttctcactgaaggcctggcgtttaagagctccgggctggtgaatgtgcgctccacgaccactataggacc

SEQ ID NO: 22460 - DNA, 486 bp, Zea mays
  Clone ID: cC-zmle1890010h05a2
attattattataattattattaggggagacgattccattctacaccggaaagaaacatcagcagatctcacagccatttcatgcacactcgacaagaaactaatcagagcagcaatactgccagtactccatgagatctgcgcaaatttctttctagtaggagagaagatggtgaacgaagcagacgacacacacgacgctagctgagccttgagatctctgcagctctcaagaacccaccgccaccggccgcgtcacggggaccaccaccacccgaggcggcggcggcccgagcccgactccgacgacgacggcttctcgtgattcgcctcgtagttccacttagtggacggcccggacggagggatggggagccgcttgctctccgccatcgccgcggccgacggctgcgaatgctggtgccggctgatgattacagcctcccgcgcgggaggagcaacggcggcggctgctgctccacggccg

SEQ ID NO: 22461 - DNA, 430 bp, Zea mays
  Clone ID: cC-zmle1890010h06a2
cccaaaaaagaaactggacgggtgaaatcaaatactagtgatgagataaattactatttgtattcttctctcagctccacatcagctagctatttgagatagcaattgcggacggcctaagcagaagaactagaatagcttgttttctgcatgcatgttgccggtcccacaaatgcgcggccggggcgcattcattcgcagtcttcactagctagttcatcgatcatccattcatccttgcttgcactgcacgtcgatcttgctattcctttgtcagcctgacttcttgttggctatctcgatggcttccgctagctcgtcgatcttggcgccggtgacctccttcacgaccttcccgcccttgaggatcttgaacgtcggcacaacctttatgcccagctccttcgcgagaggcttgttgtcctggttg

SEQ ID NO: 22462 - DNA, 387 bp, Zea mays
  Clone ID: cC-zmle1890010h07a2
ctcgaactaatacatgtgtttccacattgaaccatacgctggcaagccagaagtaagcgcacaaaacgaaaccccatgcatgggatatacagatgatactgatcaaacgatctctacccttaatatccccttcagctaatgtacataccagtcactcctcagccctcgttcccttcagaccatgcatgcattgcaacacggcccgaatctgtaccctccagatagattaacaacacacacaaactgatccagaaaggaacttaaggtttcaatgtttgccttccagtccatattagctcaccagcgatggatcgtatccctccttgacctcgactaaaccggggaaggtttggaagatggtgttgagccatgggtcatacaagtgct

SEQ ID NO: 22463 - DNA, 209 bp, Zea mays
  Clone ID: cC-zmle1890010h08a2
tttttggagctatatgtacattggaaccaatatggatgcaatgaacgcgtacacactcacacactttacaaagttaccatctgcacctgtcgggcggagggacaatcaaggttgatgtttttgaaaactacaaccgagacataaggaatctagcccatgaatttgtatcgggcgtatgttgtttttaagcccaagcacgatctcaacgc

SEQ ID NO: 22464 - DNA, 422 bp, Zea mays
  Clone ID: cC-zmle1890010h09a2
gactcgatgaactgcttcttgagggaataagcaaatttacaatcaataatctgtacaattgatatccaattctgggagaacgaaaagatatgttggcctcccctgcttcaaatccaatctgcaagcttctcttcctcgttcttgccagcgaagaggaggcatcattgcatttggtccttggagcatcgaatcctattagtagtatcagtagcagcagctgccgacgggcggctaccggcggccggccaggcggttgagccaggcgttgcggagctggagctcgacagggtcgccgaagcactgcgcccgcgcgaggcataagtgcgtgcagaacccggccgaggagcgcacgcggcaggtggaaagcacgtaacacgacgcgcgcttcatgccgcgcgcctgcaccaccaggccccacacct

SEQ ID NO: 22465 - DNA, 269 bp, Zea mays
  Clone ID: cC-zmle1890010h10a2
acctagaatagaaaaaagaagaataagcgaaagagaaacatagaataaagcaatggggggggaaaaaacaatcaaggaacacgagaacaagctagaagaagcaggggaagggagaaaaagaggaagaaaacaagaaaaacaacaggaacagaagagacctagcaagaaaaaacacaaaggggaaacaacaaacacgacacgaacgaagataaaccctagggaataggaaaaaaacaaaggaagggaacaagaaaacaaggccgagcggg

SEQ ID NO: 22466 - DNA, 434 bp, Zea mays
  Clone ID: cC-zmle1890010h12a2
ttttgaacttggggccctgagtatggccaaaaaaactgcgtgataataataataagatccactttgtaattgacgcaattatttaagcaaaaatacatatatcagaatttcctcatttagtcgacttcttcgatcttgggtccagcaccgctgccaccagccggcgaagcattctgatccatgccaccggccatgtcaggaccagcggcgccctgatacatattctcgatgatggggttgcagatgccctccagctccttcatcttgtactcaaactcatcaacctcggcgagctggttgttgtcagagccaattgatggccccctcgacggcgtcatcgatctttttcttgtcgtcctacggcagcttggaggcgaacttgtcgtctttgatggggttgcgcatattgtaggcgaaattcttgagcgtgttct

SEQ ID NO: 22467 - DNA, 437 bp, Zea mays
  Clone ID: cC-zmle1890011a01d1
gcaagtctctcgatggtcattggcgcttgggcacattggatggaaggccatcaagctctgaaccacagagcaaaaaagaaaagaatagtaagctggataaaaaggataagatagagaaaaggaaggaaaagggcaagaagaaatgcaaacatcggcaccaccgccatcgcagaagcagcaggagtgagtgagtgatgttgcctgttagcagaacagaaaaaaatggacacaacgggtctgccatggccatgagacaagctagctgactgaagctgtgtcttgaaacctgtattggatggaaacgggatattgtgtacgcttatacagatacactgttgcgatgacacattgttggctgaagttttatcactttgattaacatctgcaacaggaggccatttcttctctgtttcctatgctatatagcgcgttgtata

SEQ ID NO: 22468 - DNA, 432 bp, Zea mays
  Clone ID: cC-zmle1890011a02a1
gagcggtcgtccttttttttttttttttttttttttatactctaaaggtgacattattttggggttattttttttattttaacctttgtgctttaattatgcatgcatatgctacacctatagtatacgcatacaaaaagatgccccccgttttaaaaaaacaatatgggggataaaaaaaaaaaaaacccccacgaaagcaaaggggggccgaccaacacgcacacccaacaatccccagaacaagcgcgcggggcaacatgtactgatgaaccctgaaccgaccaaaggagacgaacgtacttcacaggtcgaagctgtggctgttgaaaaggaaaaacgcgccggtcctgcttttggccgcccccaaacacggggggcggaggggccgcgccctgcactccctcggtacgctaaaaagcaaaccctggg

SEQ ID NO: 22469 - DNA, 413 bp, Zea mays
  unsure at all n locations
  Clone ID: cC-zmle1890011a02d1
ggaaaagcaaaaaacgactaaaataataaaaaatatcgatttatttattttaactgtttatgtttggatctttagttgttaagtaattaaacattaatcacttttgttttatattctgagatcaaacactatcaggctatccgcagcggttccctctaatttttccccctatatcacttttttgtgtcacatcatcaacatttcacctcctatttttcatctcccgcagcgattccccataaatactccccctatatcccactacaactataaaatatcattttctatatctactatcaatcttatatctactaacaattacttgttgacccacagcacagtgtcgtaggggatgaacaatgaacccttggattgagggggagagagaaagngaccgcgccgtggggagcccc

SEQ ID NO: 22470 - DNA, 540 bp, Zea mays
  Clone ID: cC-zmle1890011a03a1
aaattatgcttgcgaatcctgaattcttagtagttggggtgctagcactctagcagctgtcactacatgctcagcgcataaccacgggtaggtctacacagaacgaagacgtacagtttatggcaaaccattcagcaaaacacaagtagcaggggttacaatctctgctcaaatgagaccttaaacaggtactaacctccgttctcgaatatttgtcgctcgctagttcatttttgaactaaaacgcgacaaataaaaaagaacgggggagtatttgttagtaatgaacgcccaagacacagcaacggcctctgaaacgagtcacgctgcttctgctgcactcaagcggagctgtctgaaggtcttgactcttccttcatcttagatggcgtcgacatgccttcaccgcctatctcagccttgaggtcattgaggctctgttccaattcatcaattctcgcacccatttcatctatctttgaaatgatgttctccgacataggctggaacctgggttgcatctgcataagaaggttttgc

SEQ ID NO: 22471 - DNA, 444 bp, Zea mays
  unsure at all n locations
  Clone ID: cC-zmle1890011a03d1
gatctacagccaccttggtcaccggcggcgatggcgagttctttgttcggcatccctatcaaggcagaacaagagtcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcagacagctccgcttgagtgcagcagaagcagcgtgactcgtttcagaggccgttgctgtgtcttgngcggtcattactaacaaatactcccccgttctttttaattgtcgcgttttagttcaaaatagaactagcgagcgac

SEQ ID NO: 22472 - DNA, 399 bp, Zea mays
  Clone ID: cC-zmle1890011a04a1
ttttcattaaaaatattattttatataatgggactatgggtccatggaacacgatacatatatgatgggtccctcaatgtgacttaaacataaatcaaaccgatgactattgcgcagtttcgtcgaaagagctaaaccgatgactattgcacaagttcatcgcaagtgcttagaaattcacccaataagccaggaccagtacaggtcccacataggatttgacgcttgcgtatgcacaaccaggataaatatccagctgtaaatggggcattatattttttcacagaatttaccccatttctttcacattaggggcatacgattgccccattataattccagaactggcaaaaaatgctcttgaggtacagatgcttgttagcagactgatcattttgt

SEQ ID NO: 22473 - DNA, 428 bp, Zea mays
  Clone ID: cC-zmle1890011a04d1
accactcgtggctcaccggggcgacagttcttgatggccctctcgtggaggatgagtaccgtggtacctgagcgagggtgacctgaaaacggcagctcttttggtcatgctgtacttccacatgctgtgccactgcaggagcctgtgcatcaagaccaaggccgcacaaactgatcatggctgctcacaagcatcaaatggtgaagagcatgctgtggcatgactgcgaaggaaaaggggcactcctatgcaccatgtgtaaacgaccgggggaaaatgctggagactatctggaaggcctgctaacagctggatctgtacgctcggagagccaaggcaagcgcgtgctcccatgagggaacggtaaaggggctggcgttgtgtgtggatctaataacactatttgtgaaactgggcactaggcatcg

SEQ ID NO: 22474 - DNA, 470 bp, Zea mays
  Clone ID: cC-zmle1890011a05a1
ttttgtacataatggactttggatattttttttatttgcaaaataaagtctttgcatacaagtctcgtcacaaacctccataaaggcacactgttcatttctagtggacaaatattattcatcatcaccatacaaaaatttattatttccctaccattcaacaatcaatcacacagttgcttcaacggtggggatgttgacgtagtcatgggccatcacctccttgctctccatggctaagtagtagtacaccataattccggcgaagtagaagagctgtaccaagccggagagcagtgcgtatacggagaacagagccagccccatgggcatgttcttcttcaagcatgcaagcgcaaccgcgtagagcagggacggaaccatcgccaccaggtggaccgcgacgaccagcacgaagccttccttgctgcacacccgtgtcatcagccgccacgccagtctgagcgcgc

SEQ ID NO: 22475 - DNA, 585 bp, Zea mays
  Clone ID: cC-zmle1890011a05d1
ctccagatcaccaatgtcttctacatccagccgcgcacagccgtcatgctgcaccacatcaacgaggtcaagagcatggacccctcaagcgccgattacgccaagctcatggtggagatcatgaaggaagccaaggagcttgccatgatctccatcgcgctcctagtcatcacctttgcaggaagctttgctaaacagatcatagccttcttcgccacctccactacctacgccggtgaccgctactcgttccctgagctcttcaccaaggtgatcatgaaggggcgtcacctcaggggccctctcataaccgtcgccatggtgggcgtgctcaacgtcgcatgcgcgctcctcctcgccgcgctgctccagctcgcgatgcgccagttgggggtgctgtacacggcgatcctcttcgtgctcccgttcctcgcgttcctctacctcgacgtcgttttctttgtcgccgtagccgcgtcggtggccgacgaggacagtcgctgtgtgagcgcgctcatgctggcgtggcggctgatgacacgggtgtgcaagaaggaggctttctgctggtcgtcccggtccacc

SEQ ID NO: 22476 - DNA, 85 bp, Zea mays; identical to SEQ ID NO: 22397
  Clone ID: cC-zmle1890011a06a1

SEQ ID NO: 22477 - DNA, 85 bp, Zea mays
  Clone ID: cC-zmle1890011a06d1
cccttaaactgttgtcgcttgcattttaaccttttcatcgccgttcagtggtcctaaatctatggctcgtctcagtggtctaaaa

SEQ ID NO: 22478 - DNA, 357 bp, Zea mays
  Clone ID: cC-zmle1890011a08a1
gaggggcaaaaggctcatcttgattctacttgatggatgaaatgagtaacaacaaaataagaacaaatggcccacagttgccaatttccatgacttacgaattcagcaatttttatgactcacaagcgaaccagtccaaatgcaaagacacttgtggttcattacaagactaggacacattattatcccgccggattttttatcagaatgcaaaaaaaaagggcgcacatgcgttgcacggaaacatgagggatcttacactactcaataacctaatcgagcaagtcagatttccatttcttcttgacaaacggatcaggtgcggcgatcaaagttgacccaacactgttggggaaa

SEQ ID NO: 22479 - DNA, 587 bp, Zea mays
  Clone ID: cC-zmle1890011a08d1
gctgatcacaacctcttagacaagggtaaggaactagcaaatcggatggatgagaaccgtgtcaggtttggggccccaactctggatgcacttgtgaagctatacgttgaggctggagaggtggagaaagctgagtccctagtgcacaagctatctatacagaaccacatcaagcctatatacaacacatacatgacgctgcttgacagctactcaaagaaaggagacgtccgcaactcagagaaagtgttcaacaagttgcggcagtccggctacactgggaggatcaggatgtaccagtcgctgctccatgcttatgtacatgctaaggcccctgcttatggattcagagagaggatgaaggctgacaacattttccccaacagtgctgtgtcaactttgattgccgctactgatccgtttgtcaagaagaaatcgatatctgacttgctcgattaggttattgagtagtgtgagatccatcatgtttccgtgcaacgcatgtgctgccttttttttgcattctgctaaagatacggcgggataataatgtgtcctagtcttgtaagaactactagcgtctttgc

SEQ ID NO: 22480 - DNA, 357 bp, Zea mays
  unsure at all n locations
  Clone ID: cC-zmle1890011a09a1
gcggccgccctntttgtgcatttcattttttttttttaattttaggaatactagtttggggttacaggcagttatgttggccatgcatgaatcatgaccgatgcaacgctttaggttccctaacaacacgcatgcatctagctttccacagtaaacaactggcggcggcggcagcaggtatgctgattcaccaacgttctaaaggaactggggggtggtgagcacgtttttaaaaacggagacgcccaggcggtcgagcaagttttggaacgggccaacgccggcgacgagcccctgcatgaagtaaccgaggatggggagcatggcgagcctgccgttcttgatctccttgagctt

SEQ ID NO: 22481 - DNA, 511 bp, Zea mays
  Clone ID: cC-zmle1890011a09d1
ggtcgacccacccgtccgcagggccgttcaatctttgccagtggcagtccatttgctttctttggagtacgaaggaaagacttttgtgcgtgggcagtctaacaatgcctacattttccctggactcggcctcggtcttgtgatctctggagccgtccgtgttcacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtagtgctgcggggatcacatttgcagtaataaaaaatctatcaacgcggatggtactctgttgtttatagtccctgctgctaaccacccctgttgctggtgctgctgg

SEQ ID NO: 22482 - DNA, 318 bp, Zea mays
  Clone ID: cC-zmle1890011a10a1
atatcttaattttaactgtgttcggtgtttttaattaaagcaaattaacttttggttctggtacattctacttgaataggatccaaaaatactcacggcaatatcactggccacacaaagcagacatatagctatggataaattaggctggtgcattgcccaaccaccaccatcgccagcaccccaggggaaggactgatcgaaagtcacgcctagatcttgttgaaggcaactatgtcgcaactctgtacgtactcgttaactggctcagcgcacagatagtcctcaatgagagtgtcgacagagacaaggtcgtcc

SEQ ID NO: 22483 - DNA, 578 bp, Zea mays
  Clone ID: cC-zmle1890011a10d1
gaaggaattggatacatattagatccagaattttcgtttgtcaaagttgcagcaccatatgctcaagaactgtgagacttgaaacagagacgacaaactggacctcaattggtccaggaaataaggaagcaagcaaatgatgctcgtgattctacaatatcaatgccgtacagaatacagagaattgaagattttgtaggacaacttgagacaggagatctgaaacttagggtcagagtactggagtcagaacgtgctgcacgtaaagctactgttcttcagatggccaccatgtatacagccttgggtggtactctcttgaatgttggggtcacactgaatagtcaagggaaccagataattgcaaacggctctttcattggtgcaggaatatttttggcattgctggtcagatctatgcaaagagtgaagaagctcgacaaacttgagaccatgatataattatcctattttgtaaagacgtgcaatcgccggaattacatgcgagctgcgcgttccttcgaggttgatagcctatgcatagtgtatatagtaaatgatattctttctggaacaac

SEQ ID NO: 22484 - DNA, 554 bp, Zea mays
  Clone ID: cC-zmle1890011a11a1
ttttgttccaaccccaaacacttctgtagtaaataggcctgtgaggcatacacgattcgtcatcatctttagcaactatagtcgttgcttgtcatgcacatggtacaagaaataggtttgttcactcaaactaacactgattgatttacaacacaacactgactacaaagaacttaaaaacaccagctccgtgaacagcagctgcacagagatgcctctgcttctaaacctgaccaagaatggtgccacgattgcactaggcaaagcaagaaccagcatcgtcatcatgccacctcagctcaacccggcaaccatcccatgggcaacggggcttaaggctgcatgagattcatctccattactaagtgccaagaggaccaagttttaagcaaaaagaaaagtgagagttgcactaacccacatccctgtcgcctgttcacatactggaccatcccaatctttccccttgccaatcacccgctcactgcacaatcccatttttttaccaacactatcagtccttcaacaacagagcccattcaacgaggggcaag

SEQ ID NO: 22485 - DNA, 474 bp, Zea mays
  Clone ID: cC-zmle1890011a12a1
ttttaatgagaatggttggagaatggctattgggggtgagggagggcataatttcaatgccatttaagtttgtggctacaaaactgttacagcgctttgttgcaacaacaaagtggccgagcaaaactaacagctatgccctttggtttatttctacactatatggataggatgagattggaaaaaaattattactgagtttgacttgctatggatttaaacccacacaattctattcaacccatatggattgagctgaacactaacaagctctaactggtgttacctaagtggtttttggaatttgccatggacccatacccgccgaatcgacttcccatttttttggttcacggacttgtcacagcaatattccatctccaactctactagcccagcagtatgaaagagttctctaacaggttccaatgagaagaagtattgaaaagggtccattctgatcgcatatttttc

SEQ ID NO: 22486 - DNA, 443 bp, Zea mays
  Clone ID: cC-zmle1890011a12d1
cccacgcgttcgcgccgcgcttcgcactctcgctccattcgcttcacattgccgttggtggcctcttcgactgccgcgagaatgccgttcaagaggttcgtggagatcgggcgcgtggcccttgtgaactacgggaaagactacggccgcctcgtcgtcatttgcctatgtggtcgaccagaacagggcacttgtggacgcccctgatgtggtcaggtgccagattaacttcagacggctcttacttaccgacatcaagagtgacatctaacgtggcctcaagaagtcaaccttgatcaaggctatggaggaagctgatgtgaacactaagtgggagaacagcttatggggcaagaagctgattgtccacaagaggagggctgcactcagtgactttgatcggtttcaaggtatgctggcaaggatcaatacgggtggtgcta

SEQ ID NO: 22487 - DNA, 355 bp, Zea mays
  Clone ID: cC-zmle1890011b01d1
accacgcgtacgaacagctccgctcgtcaatcagctctcggctgatcactcatcgccagtgggtgcctgccgaccaggtctcgccgccgccaccgccgcggtagagaggggagggagagggggaaaaaactggcccaaatcgacaggtgcagaccgaaatagagaggcaagatagatccgggaccggagggcgtaggtccggggcctaagaccgaggggctcgtgcgcaagaagatgatgaggttcctgtcgctcgttctcttacgctgcctagctggacccatcgactacgcgccggcggacgtggaccacgccgccggccttaggaggcgccggaggaggagggccaacaggg

SEQ ID NO: 22488 - DNA, 430 bp, Zea mays
  Clone ID: cC-zmle1890011b03a1
agtgtgtctgtctcttttttttttattttttttaaatttttttttttttgttttttttttgggggggtctttgtggttttttatctaaaaatactgacccaaaaaagggaaaggcacctctcaaggcggccaaaaggggaaaacctgtaagccttcaaaacgctccagaaagttggaaaaacacacctgtatacacgaaaaacacgaacggcggaacaacaagaacagacaaaaacccccctaaggggggggctgcccaacctggagtggcgagcggtttaaaatagggacccccctgtaccccaaccccccaacggaaatggcaccgaagaaaaagcctagcgggcaaaaccagcatcacgccgaaaacgggaaatccccggggaccgaaccccgccccgagagggaaagcccgggccccaacaagggg

SEQ ID NO: 22489 - DNA, 511 bp, Zea mays
  Clone ID: cC-zmle1890011b03d1
atataagatgccatttcaacatgctgctgaagacggtgagaatagttttggtctgtgactgcataagaaagacatgttcctgctgatttgatgtatctgtatcattcaacgaaagtgagatttcacgattgtttctggggatggcctgctggagctcaggcagtacctcattgaactggatttgaaaccccaggatttcaccgattcctgctgcaaatgaagttgaaagctaaacttgctcagatgcgcacaagacattggcggggtggtgtatagtagtaagattaatgtaaatcaattgccacaccaggtgctaatctatgaacatttgggtgggttatatcagtagctaaactttagcagctaaggtagtacgattaatcatgcaggctttcccaaaaaattgtagcagttggaagggtttttatgttcacccttctcaacgcctgaccaggaaccaatgcctttaatgtggccgtatttttaaaaaagatgcctttaatgtgaccca

SEQ ID NO: 22490 - DNA, 428 bp, Zea mays
  Clone ID: cC-zmle1890011b04a1
acctaaaatggcatttcactagctggtttgaagggggggtcatgatgcatccaaatcaaagtaaaaaaaaattaacagttccaagttacatcccaatccatccatgtgcagaggaattgcatgtatccaccatgctcgtcactgctgaaatggcatacctttgcacgcacagaggaggatcggaggcggagctatattatatatatgcatctttatgaatttgtattctacttgaagtagtaggggaggtccagcacgtataggaggaagtatgcccagagcacgccggagataccaccgaagaagaaccctccggtgaacttggcccaaccgtcggcggtctgcagcttgtcggcctccttcttccggccggtgagcgtgagcgtgggcgccgtggacgggtcgccctcgttgaaggaggcgacccc

SEQ ID NO: 22491 - DNA, 451 bp, Zea mays
  unsure at all n locations
  Clone ID: cC-zmle1890011b04d1
ggcgtcgcctccttcaacgagggcgacccgtccacggcgcccacgctcacgctcaccggccggaagaaggaggccgacaagctgcagaccgccgacggctgggccaagttcaccggagggttcttcttcggtggtatctccggcgtgctctgggcatacttcctcctctacgtgctcgacctcccctactacttcaagtagaatacaaattcataaagatgcatatatataatatagctccgcctccgatcctcctctctgcgtgcaaaggtatgccatttcagcagtgacgagcatcgtggatacatgcaattcctctgcacatggatggattgggatgtaacttggaactgttaatttttttttactttgatttggatgcatcatgacccccccttcaaaccagctagtgaaatgccattntaggttaaataaatatattccttccatt

SEQ ID NO: 22492 - DNA, 535 bp, Zea mays
  Clone ID: cC-zmle1890011b05a1
tttttaacaaaaacaagcatagcgcaaccaacaaccatgctagcattacggttccagaattcaagggcaccacaaaccgttaagtaacataacattattttcgtttgggttaatccctacaagattccactcataggggcaacgaaaacttgtaactacaggaaagacccactgcaccacataccctttccatgccaagtagatccgcgtcttcagtctccaccaacctggcgtttccaggagtcctccacaatgagctcgtctactccccagtcttcatagcttccatcaggtaagtaccgtctgatcgtgaagggtatcttgcgcgctctcagctccttcattgcaatctcaagagggtcagtttcaccctcaagctcaaccatgactggagcattcatgcttatctgcaaggctcgtgtacccaggatgcgcgcacgttcgtacttggtcatgtattttgttgttttgcgttcacgcttgggcttttcctgttccttatcttcaccctcaccacctatgacgtcatcagggg

SEQ ID NO: 22493 - DNA, 530 bp, Zea mays
  Clone ID: cC-zmle1890011b05d1
cccacgcgtccgagcccggcgaaaaccctagtaagcaaaccattggagcagcggcgcttgcgcgggcggagccgtgggggacgacgattacaacgaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggtgaaactgaccctcttgagattgcaatgaaggagctgagagcgcgcaagatacccttcacgatcagacggtacttacctgatggaagctatgaagactggggagtagacgagctcattgtggaggacttctggaaacgccaggttggtggagactgaagacgcggatctacttggcatggaaagg

SEQ ID NO: 22494 - DNA, 373 bp, Zea mays
  Clone ID: cC-zmle1890011b06a1
gattaatatttttggtttttggggtcttatctatgggagcacccatatggttaacgatgagcctacaacgccggctcaagtataattctcgagcctacaaaaagttttccaaccaacaacaaatttcccagcactacatactctgaacgtccaaaaaaaaaagataacatacgggctgcaaaggacgaggggaatcgcaagtttgtaccaacaacacaaccctgtacggacccaggaatctacgcttatgaggcagactcaaagggatgcggcgtcagtggatgcacaaagacactcctggaacaagatccggacccctgttggcttgcatctgaggcagagttgccagcagctacagaaactgttgaaggga

SEQ ID NO: 22495 - DNA, 444 bp, Zea mays
  Clone ID: cC-zmle1890011b06d1
ttctcgggtcgtcccacgcgtccgcccacgcgttcgcccacgcgtccgtgaaaaagcagtgattcctgcctttatttatggctaacaaaaaatagagaaggagttatttttttttaaacaaaaaaataatataaattaaattaaaattatcttatttttttttgtttttttgcttttgtgtgtttttctattttttgcttttatctatttgtaattctccctttgttgttcttttctttttttgttttctacctttcctttttccttttgttttttctctcttggggcgttctctttcttggttcttcctcttttccttcctgtgtttgcgctgtttttctttttttttgtgccttttttttttgctcttttgtttctttttttttagtgttttctctttttgtcttcctctcttttttctcccttcttttttgtgggcttttt

SEQ ID NO: 22496 - DNA, 318 bp, Zea mays
  Clone ID: cC-zmle1890011b07d1
gcgcaccgactgacgaaacgtgcgctgctcatgccacgattgttgaacccggcccactggatctggacgtggtcagcgtatgcattgatattgacagggcgcactgctaacagacctggaggatgcagtacaccagcacggtcactgagattagcaggctaggggcataggagtgacacagtgtgaattcaagggatacactgactggcttcgtagacgaccctgagaacggtgacctggtgacggtgaggtacgacaatgctcggttcgggggaccgagcatggtctagagcaccgaccggacgatggcagaactga

SEQ ID NO: 22497 - DNA, 436 bp, Zea mays
  Clone ID: cC-zmle1890011b08a1
gagggggagaaaccagcttttgggccatccatccatgcataaaataaaaaacgggctaagagacaaattctatgcacctcctcctccgcggcctttacaccatgggaggataaccagccccaactacacaaaagaagtaccactcccccatcaaccattccggaatctgaatactctgttttaagttaacgagacatctgcttcttgctcggaacgaactggtgcacggcacccctccttccttcctcatcaccagcaaccaagcgggccatttgagcttgcatgcgggttcttttgagctgccgctgctactgttgctgcgattctgccatttgggcttccgctgaacaggcaaaaaccagttcaggtttaccactccgatgcatggtcgtctggactggttattttccggcagcaggcttctggtcgcttgacg

SEQ ID NO: 22498 - DNA, 515 bp, Zea mays
  Clone ID: cC-zmle1890011b08d1
cccacgcgtccggaccgtataaacatggctaattttcagaatatgatgtacccatcaagtgctgcccaagggagagttcaatccccccagttgaaggcatcctcagggagagggacaccttcatctactgctacgactacccctgccgccacaccccctaatttgattatgatgaagaacagtagcctccaccagcaacaagcaaaagtccctatgcaggctctctacactcctggtcaccaatcacagacttccttaagttcatcaaaggtaggaccttctctaacaaacctttctaccggaggaggggatctatctcgatcttcaaacgcccctgttgcttctggttcaccatccaattcggtgtccaaaagtaccggtggcagcccacccgccacaggaaatgcaaagggtgttcagcagcctgtccaactgccatcaccacagcagcagtcagccaagaactccgcgtcgacgtctggctccaggactactcccacgaatcatttcagtat

SEQ ID NO: 22499 - DNA, 234 bp, Zea mays
  Clone ID: cC-zmle1890011b09a1
gtattccactatttttttatcggttctccattggggtttacaagcgggatttcttctttttctgatttgaggattaattccccttcttacaaatttatatgtacaataaatgcttgccgaggaattatgtcccccacggatagaagaaaaaatggccaaacggcgcttgctagcctaaacaagtttcggggaccacccaaggaaacctaaaaacaaccttttttttttggaaaa

SEQ ID NO: 22500 - DNA, 370 bp, Zea mays
  unsure at all n locations
  Clone ID: cC-zmle1890011b09d1
ctgcaagggaagtgagttcntatatcaaacagataagaggagcttctgggcctggctccgctcactgtttggttgttacaaaaagaatcaaggattgggaccagttccagcctagctgaaccatatcgtccgcatgtattgtcatgaattattcagttttgctccatctctcaagtcagcgacgaaatgaggcatgactactattattatttcaactttatgtttgtgtatacaatggataaatattgtagcgctttcttgtacataagattaggttatgtgtaagttcatctgtacgaaacactatcatgttaatccatgaaacacgagctgccgaatattacttgcttaaataaataataaatttata

SEQ ID NO: 22501 - DNA, 233 bp, Zea mays
  Clone ID: cC-zmle1890011b10d1
ccggcagcaaaaatgaataataagggggggggttttaaatttaaaacccccccacacaaaaagttaccggttgaagaacacaactgaataggactgctcacagaaataactaaatagaaccctcccttgaaaataaatagctgacaacaaaattaactcctacgcgtcttcgcagtacgcaacatttaaagtggccggaaatcataacatgtgagaacatgccacactacaga

SEQ ID NO: 22502 - DNA, 497 bp, Zea mays
  Clone ID: cC-zmle1890011b11a1
caacgcactttattctttaaactgcaaaagatcttctgcaggaagaactgaggtgtaaatagcgtccaaatctcacgtggctatgaaacatttaactctctacattgctcatggagctatagaacacttaacaagaatatctcagcccatggtgtaggatggtgacggcaggtttatgacagtgctcttcaccttggtcatcatgttaatgctgtttgttatcccctgggacccaatgccactgtctttcagtccctggaaggggaaatgatcaggcccacgagccggtgcagagttgatctgcacagttccagtctccattgcatcactgatcaggattgccttgttgatgtctcttgtaaaaatgcatccctgtaggccgaaattactggcattgcaatggtggatgccttcctcaactgagttaatcctaatcacaggcaagacaggcccaaaaggctcctcccatgcgatcctcatgtcagggcggacatgat

SEQ ID NO: 22503 - DNA, 73 bp, Zea mays
  Clone ID: cC-zmle1890011b11d1
catggaagatgggaatcggacttacacgaagagccatgtctgttttcgcacgcccattcatgaacagggcatg

SEQ ID NO: 22504 - DNA, 403 bp, Zea mays; identical to SEQ ID NO: 22413
  Clone ID: cC-zmle1890011b12a1

SEQ ID NO: 22505 - DNA, 521 bp, Zea mays
  Clone ID: cC-zmle1890011b12d1
tcaagctgtggttgcgttttattctgcaagtgcggcatgaatttccctgacctggaggagacgagcaccggctcgcaggccaccgtctttctcggcgtggccccggagaagaaggccgcgcccgagttcgtcgaggccgtggcggagttcggctaggccgtccacggttgcagctgcggtggcaactgcaggtgcgacccctgcaactgctgatcacattgatcgacgaccatggatatgattattatctatctagcttgtggtggtggttgaacaataataagcgaggccgagctggctgccatacataggtattgtgtggtgtgtgtgagagagagagaaacagagttcttcagtttgctatctttctctgcatgtttggcgtcagtttttgggcttatgtacgtacgtgtgtttacctgtatgttggttgatccgattgcatttgctgtaaccattttttaattgggtcccggtggtctgatctgatactatttatatctaaaccggacttttttttt

SEQ ID NO: 22506 - DNA, 494 bp, Zea mays
  Clone ID: cC-zmle1890011c01d1
cccacgcgtacgcggacgcgtgggtgaagtgaacctgcaagctgtgcttgcacgccgtttgaccatacaagctgctggactgcgcaacagaagccttgctaataaggcagagattgttagtgaggtggaaaagaacgtgtggcctgctgtctctgctggcaaagtgaagccggtgatttacaagacgtttgcgttatgtgaagctgctgaggctcataggttgatggaagctagcacccacatcggcaagatactgctgctcccatgactgcacctgtggcgtttgcgctcttgctctcggaggagtcaggtcaaaaacatatgcaattgctgagactgtgacaacctgcacggatgttgtactggtgtcacatgtcttttttatatatatcttcgagcactagattggatcttttaccccgagaaattatcttgtgaattggatccttaaagtgctgatgacatttttctgtgagctatgatataataaatgt

SEQ ID NO: 22507 - DNA, 406 bp, Zea mays
  Clone ID: cC-zmle1890011c02a1
agcggtcttccttttttttttcttatccaatccatatgccataacttggtatcgacatgataatttcagcacgcgttcttacataacaaagggggtggtaagtaatacaacctgctgctccgaaccacacctaagacacgtccgctaactttggcatgcccggagtacccaaaaaaggagctttacagtggagtggacacacccaaactgacgaccgggcgtggcccgacgcgacacaagcatgttatcgttctagcaaaaaagccgtgtggctggggcatgcaagaaggcaggggagccacaccgctctacaatttagtttggtgcagcaccacgtcagagtacaggagcacaccgtcagatgtatgtgtatatataggtacaaggcatttcgcgcggggcggat

SEQ ID NO: 22508 - DNA, 394 bp, Zea mays
  Clone ID: cC-zmle1890011c02d1
acccacccgtccggcggctaccagaagtggggagccccgagagcggatatagtttttggttacgggcggtcgggcgcggcggtggggggggtcatgatctgtgggagcgagagcactaccgccagctggtggcccgagctggccacgctgtgcgcgctggcgcgcgacgccgtggagcagcttcggctgccgcgggccggcacgttggcgccagtgttgtcctcgaggcgcgggcgcgaggaccacctccatggccacggctagacggcctaggcgatgcacctgctgctctggggacccaagtgaagcggcgagaggtcaccgtcccgccgggcgttcccgctggagttggtcgtcttgccttgtctgttatccgtccagaacggactgcact

SEQ ID NO: 22509 - DNA, 418 bp, Zea mays
  Clone ID: cC-zmle1890011c03a1
agttggttcgtcttttttttttttattatttaagacatactactcattttattgttttgggacattgtttacattttttaccattttgaataataacaccagagggttcatcgaccccaaatacagtttcctttcaagagagagctactctgctaaaacaagggccacctgtgcgtgggggaatcggacacagcatacagggagcagtgctcgggatcctcgtgaaaaaagagaaagaaaaaaaggatattgcttcactgccctccgtctcctttcatctccggtatacgtatagctggacaagacacacatctatacagatcgcatcactggtaaacttgcacagagtaaatgattacacgtccagctctttatgcggctacagctagaggtctttggctggtctcggacgcgtggg

SEQ ID NO: 22510 - DNA, 489 bp, Zea mays
  Clone ID: cC-zmle1890011c04a1
ttttatatatagcatcaaaattatgtaatgaagagtagcactgattattggtacatgacgaaggttgagcatccatggaggctagattatagacagacaccctgattttacacgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaagccacccccaatcccgtagggcttgtcggtcttgatcttcttcttggagcagacgacggcgaaggaagaggcgcggcggtcgaagggcggcaggccctg

SEQ ID NO: 22511 - DNA, 570 bp, Zea mays
  Clone ID: cC-zmle1890011c04d1
cccacgcgtccggcgactcagcgagcgagagcagcacacactcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcaagggtgtctgtctataatctagccttcatggatgctcaaccttcgtcatggtacaataatca

SEQ ID NO: 22512 - DNA, 484 bp, Zea mays
  Clone ID: cC-zmle1890011c05a1
aaagagaaccacaccggctttctttattcaaacatggccgattattcagtgccccggcaagagaagtcaggcacaaccgcacaagaagtacacacacgcccaacccaacagcattccccaactttatcaatacatctcagatggtcaagatacaggccaaaatttcctgaagcgaagaggtacacaaaagataccacacggtctcacttctgcatatcggtttacatgcttcggcactgacaaacgaatgtggggcagtacatatgggaactagtagaagagacccgaagttggccacgcgcccaagttacaaccccagctccgagaggagattgcgccaccttggcgtctcctcgtcgaatatgtaggtcagctttgttaccaagactccactgccaccaattgatctcagttgttggatagatttgtaaagcaacttctgtggaacaaccacattaatggcatagtattccacatcaacttt

SEQ ID NO: 22513 - DNA, 505 bp, Zea mays
  Clone ID: cC-zmle1890011c05d1
agatgtctgaatggacagaagaaaggccactacgtgttgttactggatttggatatctaggtgataagttcttaagagagaaaggttttaagcatgttcgttttttatctgccgatggagctcttgagtcatatcctcctatgggtatggctgatgctattgtggatctcgtgagtagcggaacgaccttgcgtgagaataacctaaaggaaattgatggtggagtagttctggaaagccaggccactcttgtagcaagtaggaaatctctgcacaagcgtaaaggtgtgctggaggttactcatgagttgcttgaaagattagaagctcacctaagagcaactgcagaattaatggtcaccgcaaacatgaggggcaacagcgcagaagatgtggcagagagagttcttagccaaacatctatatggggattgcagggcccgactgtaagtcctgtctatcgcagacgtgatggaaaagttgatgtggaatactatgccataat

SEQ ID NO: 22514 - DNA, 408 bp, Zea mays
  Clone ID: cC-zmle1890011c06a1
ttttgtgtcgattcggaacacgatcttctaatgaatggatgaactactactacatgattccagctattaatatagcaatggcgacgctgctagtttgctcctcctcacggcacttggccaagaatctctcagaaaggaaactgaagattgcaaaccggcaaggcgccaaggcacgaacatagtatataaatattacattgttgactccatagcgctagggtgatcatctgcagtcaaccacagaaattgacaactagagtcttatttattgggtactctaacgttgggaatcagtgggctactatcagcaatgggaaggaccacttaattctcagatctgtcgacgaagatgcgcaataggaagaaccgcctaattctcagatctgcccaagaagatgataccttgta

SEQ ID NO: 22515 - DNA, 589 bp, Zea mays
  Clone ID: cC-zmle1890011c06d1
ctgcaaggtaccatacatctgtggcttccaatcaaggtggagtaagatatggggaaagctcttcaccacaggaggacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggtttcgccaaatgtgtttgatcctcctgttgaaggacatgctgcaaactacagtgtgaatgggggcgttttacttggtcattaatgggtgcattgggcagaatgga

SEQ ID NO: 22516 - DNA, 656 bp, Zea mays
  Clone ID: cC-zmle1890011c07d1
ggtcgacccacccgtccggcaacaacggataacgctctcttccttcggctcctcccttcttgctcctatcctctcccctccaatggcgagcgggatttcctctctagtaactcctccgaccctccaccgccgctgcctgggccctgcctgcgtctccgtctccgtgtgcacccctatccgcatctccttccggcccgccgccgcgcctcaggtgtcgcgccggggctcggcgctgcgggtgtccgcctcctcggcggtgctcgaggcgccagaggcggtggcggcgcggaagctctacgtggggaatatccccaggaccgctccatacgacgagctccgcgacatgttcgctgcgcacggcaccgtcgagcgggccgaggttatgtacgacatgtataccaatcgcagccggcggtttgggttcgtcacgatgagccacatggggagcaggcaatgctggagttgaggccctcaatggggactgaaggtgggcgaaagaaaaaattaaagtgaaccgtaacagagagcttcttacccgaacagtggtccgaccagcacccagaaccagagggctctggttgtagaatggcaatccaagggttatggtgggaactttggtaagaccggaaccacccaagtttttaaatacctttttc

SEQ ID NO: 22517 - DNA, 528 bp, Zea mays
  Clone ID: cC-zmle1890011c08d1
gaattctcctcgtcctaaaaaaccctaaccccaactccttacactcgtctcgccgggggcggcgcgatgaggggtatcaccggcggcgtcgtctcctcccagccctgtcccctccacaaggccgacctcttcctcaaacgcttcaccgagtctgccgcctcccacctaccctcctacgactgctgtaactacctccgcaacgccgccgacgccacaacacagctcagccgcttccgcaaggaactcggcggcagccacaagcagggtgccgccaactccgatgcccactactatgatgatccggtgaagggcaatagaaatcacgaagatcaggagagcaaaggggacatggcgattgccgctgatgattccaaccgcgattctgccgctgaggcgaagctagatgttgcctccggtcagaagggcaataagaagaagaatggggatccactgtaggatagagcggttgcccgtgctaactcgcacatccccccttcaccagaaattgccactgagaagaggaagaag

SEQ ID NO: 22518 - DNA, 427 bp, Zea mays
  Clone ID: cC-zmle1890011c09a1
aaacttcagatcttattcattgtattgcatataggttaataaaggtttttagccatctaaaatagctttcgaagatatataaataccgccaatacatgcagggctaatcactgtttatagccagggtactagtcaaaatgaacttaaacatgaacttggggccctgtgtatggccaaaaaaactgcataataataataataagatccactttgtaattgacgcaattatttaagcaaaaatacatatatcagaatttcctcatttagtcgacttcttcgatcttgggtccagcaccgctgccaccagccggcgaagcattctgatccatgccaccggccatgtcaggaccagcggcgccctgatacattttcgcgatgatggggttgcaaatgccctccaactccttcatcttgtcctcaaactcat

SEQ ID NO: 22519 - DNA, 509 bp, Zea mays
  Clone ID: cC-zmle1890011c09d1
agttcgagctctctggcatccctccggcgcccaggggcgtcctccagatcactgtgtgtttcgacatggacgcgaacggcatcctcaacgtgtcagcggaggacaagaccaccggccagaagaataagatcacgatcaccaacgataagggccggctaagtaaggaggagatcgagaagatggtgcaggaggcagagaagtacaaggccgaggacgaggaacaccagaagaaggtgaacgccaagaacacgctcgagaactacgcctacaatatgcgcaacaccatcagagacgacaagatcgcctccaagctaccggaggacgacaagaaaaagatcgatgacgccgtcgagggggccatcaattggctcgacaacaaccagctcgccgaggttgatgagtttgaggacaagatgaaggagctggagggcatctgcaaccccatcatcgcgaagatgtatcagggcgccgctggtcctgacatggccggtggcatggatcagaatgct

SEQ ID NO: 22520 - DNA, 309 bp, Zea mays
  Clone ID: cC-zmle1890011c10a1
ttttaactacccacaccacagatctatcaatttgtgatagggccaacagggattgacgcataacaaaacgcgacctggggcagatactagcgcacgtgtagaccggcccatgcatgggcagagactgttctcttaagcggagggcaccgaagttggcttacaacctaaccacaaacaatggtccttatgcgtccaacgggttgttaaaagcatgccgcaagcgagtaacgatgaaaccggaggatctgccaggaaccttgcagatgatacaaacacctactagttgcagactgggcatgcgttgttgat

SEQ ID NO: 22521 - DNA, 437 bp, Zea mays
  Clone ID: cC-zmle1890011c11a1
ttttggtatcgacatgataattttagaacgcgttcttacattacagaggggtggtaagtaatacaacctgctgctccgaaccacacctagtacacgtccgctaactttggcatggagggagtacccaaaaaaaagagaggagctttacagtggagtggacacacccaaactgacgaccggccgtggcccgacgcgacacgagcagtcgatcgttcgagcaaaaaaagcgggagtggctggtgcaagcaagaaggcaagggagcagcagcgcactagtattagtatggtacagcagcacgtcgtagtacaggtgcacgtcgtagtatataggtgtataggtacagtacagtccgtgcggggcggattgcaggcagagcaaaacgagcaacgccggcgggagagcccggcggtacggtggcctctcgccgtcgcttcac

SEQ ID NO: 22522 - DNA, 144 bp, Zea mays
  Clone ID: cC-zmle1890011c11d1
acccactctaggcggttgcacatacttactataccatactacacacaccgtttcgacttttacacactcgctgagcaactagcggggttcgggcgtgaactcgtgtcgcaggaagctataatctagcacggacggggaataata

SEQ ID NO: 22523 - DNA, 386 bp, Zea mays
  Clone ID: cC-zmle1890011c12a1
gggaaaaagggcccaaaatgatttcattggtccatctgcccattttagggggcacataatcgagttttaaatcgctaagcaaggcctatgatggccccatagggaaaaactgctcatttgtaaaaaaagcttttggattatacatatagccaacaaattccggcctcgtaaaaaaaaaaaacgggaaagtttgccctaatcgcccagctcaatgatctttacaaccgaggaatctcccaccttttggcaaacaacaacacgggcatgggacttgatcacaccacatgccttgccatgggttaaaacaacctttaaaactgactcatttgtattaccgggtgattcggctggatgcccaggatctgcaagcctcggaaagagggctt

SEQ ID NO: 22524 - DNA, 469 bp, Zea mays
  Clone ID: cC-zmle1890011c12d1
cccacgcgtccgcccgtcacaactcacaacccgagtcttccaatcccgaagcagcaggagctcccctgaccttgcttcgcctccgatcaaggaaaaggaagatgagctactacggccagcagccccccgtcggcgtcccgccgcagcaaggctacccggggaaggacggctacccgccagcggggtacccgccggccggctaccccccgccggcgcatggctacccgccgcagggctacccgtagcagggttacccgcagcagggcttcccgccgtagtacgcgcagccgcctccacagtagcagaagagcggtggcccttccttcagggagggatgcttggctgccctttgttgttgctgcctcctggacgcctgcttttgacggaaccatccgtgccgggttcaacacggttgcatgggaagcaaccagcttacggaagagctggacctgggcccggctattttagc

SEQ ID NO: 22525 - DNA, 491 bp, Zea mays
  Clone ID: cC-zmle1890011d01d1
gcttaggcttcgactgtcctcccgtagcaccgccacaccgcacgcgtgcgtggcggcgtccgccttggggccggtctggcacaccgatccctggctggggaagttcatcgcctccgagcccttcaacgtggggggattcgactgggcgatctacttctaccccgatgggaagagcggcgaggatggtatgttgaagtgacatgctctgaactgctcttggcttcaggcagtcaggcggcataacaagcagaggtttagtctgttggaggaagatggcgagctgttgatccgggcgaaccagggacacacagtaatactaaaaaatatagtctggaggtgacctcaactttattggacagaatactctcttatgagacaaagttgcataagcccatcagatcttgcagaatcagtttcttgagttcatgtgcaggttacatctacaatggcaatctacaggaggctatggattgggtatggctaatgataca

SEQ ID NO: 22526 - DNA, 383 bp, Zea mays
  Clone ID: cC-zmle1890011d02a1
tttttgggcacacaggacagttctgtagcaactaacaagctctactgaaacacatgaggatgaaaaactatcatctcatcaagcatctgaccggggcaaacacaagcgctaccatctacacagaaggtggttagttttgcagcatgcatgtacaaggaaggaggcaaggactactccgctttccctttccactaaaaaaggactaccagctccgacaaacacaaaccgggtttcagaacagcgtgagcgaccgaggcttccagaagatgttcagtttcctctggaaaaacctggacgacttcgacgcaagctgcttgtgaaccgagttcttgggagcatcctctactaccatgcctgtggcagccacttcttgtgagcacgag

SEQ ID NO: 22527 - DNA, 398 bp, Zea mays
  Clone ID: cC-zmle1890011d02d1
cgacccacccgtccgctcgtgctcacaagaagtggctgccacaggcatggtagtagatgattctcccaagaactcggttcacaagcagggtgggtcgaagtcgtccaggtttttccagaggaaactgaacatcttctcgaagcctcggtcgctcacgctgttctgaaacccggtttgtgtttgtcggagctggtattccttttttagtggaaagggaaagcggagtactccttgactccttccttgtacatgcatgctgcaaaactaaccaccttctgtgtagatggtagcgcttgtgtttgccccggtgagatgcttgatgagatgatagtttttcatcctcatgtgtttcagtagagcttgttagttgctacagaactgtcctgtgtgcccaaaaa

SEQ ID NO: 22528 - DNA, 444 bp, Zea mays
  Clone ID: cC-zmle1890011d03a1
tttttgcaggagaaaaatatttgcccgtcgatttcttgatttgcattgcgaagtcgcaaattggctagtggctagtgcacaggcaaactggctagctagtactacactactactacacaaaccgattgcccttcctatttactacacaatccctttttgctagaattactatctccaacgctacatgaccatctcggcgggcggaggcaggttgaggtcgaagtcgaacccgaggcccgccagcaccgacggcggcgaccgggagcagcagctccgctcccggtccccttcctccctcttcaccggcgccgggtccaggaacaggcacggctgggtggccaccgtcgccgggaagagcccgaggcccaggccgagcgacgacggcgccgaggcagcggcggaggcgggtggccgtcgttccttgacgacgacgacgacgactac

SEQ ID NO: 22529 - DNA, 505 bp, Zea mays
  Clone ID: cC-zmle1890011d03d1
actcccaactcgcactcgcccaacctcgaatgccaagctagcaagagaggcctcgatcgcagaacccagcggcgaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgtcgctgcctacggcgccgtcgtcgctcggcctgggcctcgggctctttccg

SEQ ID NO: 22530 - DNA, 413 bp, Zea mays
  Clone ID: cC-zmle1890011d04a1
ttttcggtgaatatgggaaaatcattatcttttctctaaacataactgtccgacactccacctccaactcaacattttccccccttggttaccagaggccgaagcaacatcaacctcgagtcctcgacctgcaggtctcgttgtcatctcccgtctgtcacgctgcaaggttgaagtagacggtgtagaactcgtccctcaaggtgaacagtggctccaggaggaagctcctcctcacgcccctggcagcgaagctgtcgcgtgcacggcggcgtcggtgccgtcgccgtctttgggccgctgcagcatcgtcaaggacccgttcacggcggagaggacgaaggcctcgccgccggactcctgcgccagcgtcaccagctgggagttggactccacagggaccggggtgatcc

SEQ ID NO: 22531 - DNA, 522 bp, Zea mays
  Clone ID: cC-zmle1890011d04d1
ctcagtacgaatcgttctggtgctgctatggcactgggatataatcgttctccaagctgggagattccatttacttcgaggagagaggtgagaggccggcactgtatgttgttcagttcataccgagcacgttcagctggagaactgcaggccttactgtcgcacagcagctgatgcccctcagctcgtcggatcagtaccttcaggtctcattctccgtatctgccaagacgacaaacggtcagtttgcgacgttgaacgtgagaataccatcgtggacatctttggatggcgcaaaggcaacactgaatggcaagcatctggaattagcatctccagggacatttctcactatcagcaagcagtggggcagcggtgatcagttgtcactccagttacctatccacctaaggactgaagcaataaaagatgaccggccggagtacgcgtctatacaagcagtcctgttcgggccgttcctactagccggccttaccaccggagactggggacgccaagacc

SEQ ID NO: 22532 - DNA, 492 bp, Zea mays
  Clone ID: cC-zmle1890011d05a1
ttttattttttgtttttggttttcaaactttataatctgggggagatttaatttggggataaaccggcacccttatagattttaaaaaaacacattgtgtgttgtagctctagaccaggttctacatctgttaagcatactgctcagccgcgaacttgccctcgggatacaacacggccaccacctggttaccggctaattttcgaccatgcattcccgtctttgctttggtcgagccctagacatctgcatattccaaaaacacctttccaacaccagtagctggggcatagatggggtcagggcgtgaaattacaactttcaccacgctacctgtccaagcgctagcgcgtggagatagataggcaagaagctgatgatctaatgattaatgaaactcaaaagaatggtgtgtggtgtgggttaaaacccgattggcaatattgcatatggtcggactataaaacactcctgaaaggccttatgtgggac

SEQ ID NO: 22533 - DNA, 459 bp, Zea mays
  Clone ID: cC-zmle1890011d05d1
acaatctttgtaagtgggaaaccattttattacactgaggtttattttgcagcagttgataaagtacttcgggggggggcgtggattaaatcttgagaaggatatagaaactggtatctcatcggggtatgccttttgtgtttaccaagatctttatgtcaccgtcattgcctgtgctgctcttaatggcatcaaaaaaggggacacgactcttactgttaggagggcaaaccacggagactcactgcctatgccagagcaagaaagcatcctgctgcaggctcattagcaggtgcaaatgcacaaactttggtaccacctcggaggtgccttgcccacaaaagttgtctgcctgacacaagccgtgacgccctattaactgatagacgatgacgaattctatgacctttttgacgacatgaggcaagaaagacgcaaatttgttcccacataattgcc

SEQ ID NO: 22534 - DNA, 419 bp, Zea mays
  Clone ID: cC-zmle1890011d06a1
agacgcgaaacatgacatgatttcacgtgattcgtcagcatttaaccttcgggcttctatcatgcatgcatatgctacacctatagtatacgcatacagatttatacatctcttatataacttaactatattaactatcagctatacatatatatacacgatatcaaattatgacggatcaacatgtacatccaactatcgtctgtgcgtgtgtgctgtgcaacatgtactgatgatcgttgaaccgaccaaacgagacgtacgtagtttacaggtcgaagctgtggctgttgaaatggaagaccgcgccgctcctgctcttggccgcccccaagccgccgcggcggaggttccgcgccctgcactccctcgctacgctcgtctgcagcccctgcggtccgcacaccagcacgcccacg

SEQ ID NO: 22535 - DNA, 573 bp, Zea mays
  Clone ID: cC-zmle1890011d06d1
gccattcttggcgatcttgagcgacataatccacaggatcgttgagggcaagcaatgcatgcccaagaacgtgctggtcctttggtcagttaagaagtccaaggagctttctctgctgtccgccgttgatgcccagaccatcagctcatctgtctcggacaggttgcaactggatatccaggccttcgtgactcaagaaccccatcctcctttggaggatggcatcgtcggggacgaccagaaagtccctggcatgttcgtcaagaacggtacagccatgtctgggctggtcggcaccggggacaacttctgggcggccatgtacttcctggcgtccacgctcggcttcctcctggcgtacgccctggtgcaggtgtactacgtgaagccgcacaacgtggtggcgtggtggtacctgcgcctcctgatcatgctgtgcatggttgccggcgtcgctctacccggcgggctcgtggtcctcctgtggcatctgtcggagaagcagaggttggaggacaacaagtgggacgcctttcagtaaccgcgcgccgagcagacaggccccttggttgc

SEQ ID NO: 22536 - DNA, 315 bp, Zea mays
  Clone ID: cC-zmle1890011d07a1
gcaaagatggataccaagtatccagaccatcttgctcattaatgcgtttttactggggtattctggctaaatacaggtatgcttcatgtatcacatgatgacaaacttgacagacatctgtatatgatgtatgtgtggatcacgtttgctgctgctgcctccctccctcggattgagatgaagctccaccatcattccttggaatcagactcgagggggcaggagccgtcctcgacggtggctagcgggtcgaacatgtcggagctggggtccgtgcatccgctcacaatgtccagcttgcaccgatcccccccc

SEQ ID NO: 22537 - DNA, 535 bp, Zea mays
  Clone ID: cC-zmle1890011d07d1
cgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgccgggcgaggggctgaccctgttctacaacccggcggcgacgaagatggccccgaacgaggtgttcggcgtggcgttcaacggcggcttcaaccagcccatcatgtgcggcggggagccgaagcagaagacgctgcaagagcggggcaaagcccgacccgcccatctacacc

SEQ ID NO: 22538 - DNA, 626 bp, Zea mays
  Clone ID: cC-zmle1890011d08d1
gaccatcaaacaagtgccagcgccctctcgcagtcgccttattggagagcaccttcatcatgatcaagcctgagggcgtccagaggggcctcattggtgagatcatcatccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcatgatcattggcgccaccaaccccctggcttctgagcccggcaccatccgtggcgactttgctgtcgacattggcaggaatgtcattcatggaagtgacagcattgagagtgctaataaggagattgccctgtggttcccccgagggccctgctgattggcagagcagccagcacccctggatctatgagaagttaacatggaaagtttcacatcataccttgagagccagaggaagcatgtcaccatttgtgctttagcaatggttttcaaaagatcatgatcctgttcttggaaccttatttcaatggggccaatatttttttttggc

SEQ ID NO: 22539 - DNA, 428 bp, Zea mays
  Clone ID: cC-zmle1890011d09a1
attggtggtttacaagttatcggcacaagccttcatacatgcacactgatcattcctagagcacaaacactatttatcagcaccatacaaaaatttataatttccctaccattcaacaatcgatcacacagatgcttcaacggtggggatgtcgacgtagtcatgggccatcacctccgtgcgctccatggctaaaaggaagcacaccatactcccggcgaggcagaagagctgtaccaagcctgaaagcagtgccgttacagataacagaatcagccccatgggcatgttcttcttcaagcatgcatgcgcgaccggctataacagggacggaaccatcgccaccaggtggaccacgacgaccagcacgaagccttacttgctgcacacccgaggtattagccgccacgccagcctgagcgagctca

SEQ ID NO: 22540 - DNA, 552 bp, Zea mays
  Clone ID: cC-zmle1890011d09d1
cggacgcgtgggataataccgtccatgagggtcgcatttaccatctgaagttgctctgcgacaaggactgccctgagaagccaccatcagctcgatttcattcaagaataaacttaacatgcgttaatcatgaaactggagtggttgacccgaagaagttcagcgttctgggtaactggcagcgtgattactcaatggaatacatcctaacccatctcaagaaagagatgacatcgccacagaaccgcaagctagttcagcctccggaagggacattcttctaaagatggcagcaactcatgttcatccatggtgactcggaaacagcttccgcacctggttcctatattttatatatttagtctgatctcccagttatctgttaaccaccgagatcgagtgcaagcagacttggttgattaacaatttgcccggtggttgcttatgatatgggatgaaacggctgccggtttggctgctattaacgttgtgtaatctgatgggaaatttcagccttctaatgccctaatgaatgatttttggccatttgct

SEQ ID NO: 22541 - DNA, 126 bp, Zea mays
  Clone ID: cC-zmle1890011d10a1
aagtaaacacggataaaaagatcaagcatgggtactgtacatttgtgtgattcatgttcttccttattcgaggaagtctcacataagttgcctacaatcaatacacgcgtctcaagggcaagcagt

SEQ ID NO: 22542 - DNA, 286 bp, Zea mays
  Clone ID: cC-zmle1890011d11a1
ccatgtaactttattgatcacgtaaacgggaggcacaattgcacaccggtaacaaaatccccgtggtggccctggctctctctaataaaaagaggacattgaacatgctcagatattacattgagagggtcactgctaatacacatgaaccaagtcctctagggatcacttccttgtttcttgatatatcatatcatatcctgggcgaaagataggggattatcccgacccttcgagggcaattcattacaaggggccggtgggtcaaacactggggggggggggg

SEQ ID NO: 22543 - DNA, 452 bp, Zea mays
  Clone ID: cC-zmle1890011d12a1
atagattagctaaaccaaccagtggttacataagtattaagttcgaatgtaggtcgccgacaagaacaagcatacaaattcaaacgcattcacaagttacaataaacaaatgaccaatcaaacaaaggccgaggcataaccacatgaacccagctaagggcagataaaaggtctgctgcactgaagtccatattacacctgggacgaaaatgcaaaaaagaagagtttgttggtggtgtacaatgctttcaagggaagggtgcccatgacccaatcctgctcaaagatctgccacggtacacagcatactgaaccctaaagtgttcagtaaactgatctacttgtcagcatgtcgccgcttgtatcttttgtggccatggttaccattactactacgaggccttttattctttttggagcagaaggtccctactagaagcctgtttataatg

SEQ ID NO: 22544 - DNA, 236 bp, Zea mays
  Clone ID: cC-zmle1890011d12d1
tagctggaatgcctaagtaacggcgtctgtactttttcgacgcccgtcgcgcgagaagagccgctcctacggtgggaagacgacgcatttccggcgaatgccgccgggggcgatgggcagccgctcgactcgggcgcccgtgacgccggtagcttcccgtggctgccatccgcggtcgttgtgtacctcacgctcatctccgtgatggccctgcacgcgctgggtggtcccgaccc

SEQ ID NO: 22545 - DNA, 224 bp, Zea mays
  Clone ID: cC-zmle1890011e01a1
agaagcgggcaaaatgccccccagcatacgaaccgggaaagttaacgtgtcaaagcaggggggcccaacggggggagccacccaaatttaagggggtggagtaaaatggcgatttccgggggggaaaacggggcggcccccccccataaaggagggggcccaaccccggcaaaggaagtacggtattgggggcaggggggttttttttttaaccgaagccggga

SEQ ID NO: 22546 - DNA, 474 bp, Zea mays
  Clone ID: cC-zmle1890011e02a1
ctttccataaaaaaggggttcgttgatatatagagagttgatataattcggattaaaccggacctagtcatcatatactctaatgacaagaactgtatttacaagacaacccagaaacattctctctgtcccaaaataaatcaatttctcagagttatcttaaatcaaactatttttaagtttgaccaaattcataaaaagagcatggcactgaattagggccactaatgcaccataaaatatttttcataatgtactcatttggtgtcatagagacatagacgatggtgcctttcctataaaattggtcaaacttaagataatttgactttaagtgatgctagaaattgacttattttgagacggagcatattactataagaaagaaaagcataagcagtataactacttcacgggtcagcttcaacgatcatggactcgggatatggatctcagtatacaagagtacttcca

SEQ ID NO: 22547 - DNA, 496 bp, Zea mays
  Clone ID: cC-zmle1890011e02d1
aattctcgggtggacccacccgtccggaagtactcttctatactgagatccatatcccgagtccatgattgttgaagctgaaccgtgaagtagttatacgggtgatgcttttctttcttatagtaatatgctccgtctcaaaataagtcaatttctagaatcacttaaagtcaaattatcttaagctggaccaattttataggaaaggcaccatcgtctatgtctctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacagttcttgtcattagagtatatgatgactaggaccggtttaatccgaattatataaactcttctatatatcagcgaaccccttttttataaa

SEQ ID NO: 22548 - DNA, 383 bp, Zea mays
  Clone ID: cC-zmle1890011e03a1
agtggtctttcttttttttttttgcaatgaaatcccattcttatgggaattacagccttacatcacagaggagaaagccgagtgacccatccacagcagaagccgatggaagcactggaccaacaccaggcaagagatcgcatttaccttgaatggcgcctaccacagcgaaacaagagaggagagagggccacatcaactcatgagacgaccgcacaggaaagaaccaaagctgctgcattcaagtgccaactgacagccgggacacggtggacgcatgctggtggaccactccgtatccctagcagcagtcacggcccacggacaaccgggatacgggtacctttattctggcggaggttatcgacggtggcgccgcccag

SEQ ID NO: 22549 - DNA, 404 bp, Zea mays
  Clone ID: cC-zmle1890011e03d1
aattctcgggtcgacccacccgtccgctgggcggcgccaccggcgatagccgccgcctgaatgaaggttgccgtatcccggttggccgtgggccgtgggtgctgctagggatagggagtcgtcgaccagcatgcgtccaccgtgtcccggctggcagctggcacttgaatgcagcagctttggttctttcctgtgcggtcgtctcgtgagttgttgtggccctctctcctctcttgtttcgctgtggttggcgccatgcgaggtgaatgcgatctcttgcctggtgctgctccagtgcttccatctgcttctgctgtggatgggtcactctgctttctcctctgtgatgtaagactgtaattaacataagaatgggatttcattgcaaaaaataaaatttaatt

SEQ ID NO: 22550 - DNA, 530 bp, Zea mays
  Clone ID: cC-zmle1890011e04a1
accaggtccgccacggtctactcggcgggcgccatgacgtgcagcggccgcatgctctgctgcaccgccacgctgaccaggaccttgctcggcgtcctccgccccgcgtcgccgtccgggggcggggacccggagcggaagctcgccccccggacgccggcgagcaggtcgggcagcgtcttgggcctctgcttctgcggctggtggtgccgctgctccgtcccgcgcccgtggaacgacgccgaccgctgggccggggccggggccgccgccgccccctgccgctgcctgccgcccttctcaccgtgcggcggcgccagaggaggcatcgcgagcgccggctggctgcagaggcgggggggctctagacgtcgcggcgatccggccgctggcggtgacggtggacgagagccacgtactcacgttcggtggcggccggacgacgaggcggtcaatgcgaagcggagcatgctgctgggagaggaggctgctgctgctgctgcaatcaccatgctcccaggaaggtggag

SEQ ID NO: 22551 - DNA, 535 bp, Zea mays
  Clone ID: cC-zmle1890011e04d1
gaattttgggtcaccacgcgtccgcatacaaggctccacctccaccctcctgcgcgcatggtgactgtatcagcagcagcagcctcctctccccgggcatgctccgcttcgcattgaccgcctcgtcgtccggccgccaccgaacgtgagtacgtggctctcgtccaccgtcaccgccagcggccggatcgccgcgacgtctagagcccccccgcctctgcagccagccggcgctcgcgatgcctcctctggcgccgccgcacggtgagaagggcggcaggcagcggcagggggcggcggcggccccggccccggtccagcggtcggcgtcgttccacgggcgcgggacggagcagcggcaccaccagccgcagaagcagaggcccaagacgctgcccgacctgctcgccggcgtccggtgggcgagctttcgctccgggtccccgcccccggacggcgacaccgggcggaggacgccgacctaggtcctggtcagcgtggcggtgcagcaaaacatgtggcccgtgcacgtcat

SEQ ID NO: 22552 - DNA, 293 bp, Zea mays
  unsure at all n locations
  Clone ID: cC-zmle1890011e06d1
cgcatgttcccaataannttttgacttgtgtaatactccatggtctacatctattattcggtgcgagtatggaatagctacgtatgcgtcaccacataatatttattacttctagggaatatagacaatagacacttggttgatgataaatcggatcagaatttcgtgtggaataaaaataaaaataaataaaaaataaataaaataaataaataaaaataataaataaagaaataataaataataaataaaacaaataaataataaagaataaaataaaaataacaaaaata

SEQ ID NO: 22553 - DNA, 384 bp, Zea mays
  Clone ID: cC-zmle1890011e07a1
aagggaaaaaaaaaaaacctacatgggggtccaaaaagaatttccatttaagcaaataaccaggcagggggggttttattacaccctccaaacaaggaaaaaaaaagatcctaaatctaaccaaaaacaatttttataagatttgggggggggggcccatttttcaaaccaagccaatttttaaggggggaccccttgttgccttagcccgttaaaaaaaaaaaaaaaacctccgggcccggggggtgaaccagaaaaaactccaccagaagggttttaaaggaccgggccccctttgtgcggggagaaactttaatcccttaccgggggaggcactttttggggggggggggggttttttttatgaccccccttaaaattttg

SEQ ID NO: 22554 - DNA, 464 bp, Zea mays
  Clone ID: cC-zmle1890011e07d1
gactagttcaagacgatcatcagcaagaaaaaatcgaatcgttgaaagtcaaagcacgcaaagctctctggccaagtaacaaatggaggcaaccagacaaatcagaagttagacggcccttcttcaagtagtgaggaccacgaagacaatgcagcactagaggaatgggctgctactcgcattcagaatgcgtttcggaaatacaaggcaaggaagaccctgcgttgtctcaagggagtcaaaagattgcgcgttgtgggtcaggcgaatccggttaagaagcagactgctgccacgctgagttacatacagtcttggaacaagttgcagtcggagataagaaaccgacgtgctttcatggtcaccgaaggacgcaacaggaagaagaagcaggagaaccaaatgaaacttgaggcataactgcataatttgcaagtgagtatttaagtttaagcgcacaagag

SEQ ID NO: 22555 - DNA, 446 bp, Zea mays
  Clone ID: cC-zmle1890011e08a1
aatgataaggggccaaggaccaggtttttttgacactgacaattacagcttgcacgcgacacaatacagcaggattcagcaccacacgcggtactgtactgcaaacccaattgggttcatcatttttcaggaaggattgaacgaggtcatggtggcccctccaggttccggaaacacaacggagcaccgaccccaaaggccaggtagagaaaagactacatggcatacctttggggccaggccctcgcggggggctcgtacttgtgccggaccggcttgaacatgtgagctatgtcggggaccaaagggtactacgggttctgatcaaggagaagggaacagatggacagctacaccttggagatggggagagccggactccactggttcttcaagatgcctaggcaaaagctcccgctgctgttgatgtttggatggaacacctt

SEQ ID NO: 22556 - DNA, 506 bp, Zea mays
  Clone ID: cC-zmle1890011e08d1
ggttcctttccccatccccaactccattatttgcttgatccttgagaagagagaggaagacgagagctagaagcgaaggagaaaagcagttcttcagctaggcaggagggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagttacaatccattttcctcctgattatcctttcaaaccaccaaaggtggcatttcgcactaaggtgttccatccaaacatcaacagcaacgggagcatttgcctcgacatcttgaaggaccagtggagtccggcactaaccatctccaaggtgctgctgtccatctgttccctgctgactgatccgaaccccgacgaacctttggtccccgagatagcttacatgtac

SEQ ID NO: 22557 - DNA, 468 bp, Zea mays
  Clone ID: cC-zmle1890011e10a1
ttttgaagaaaaggacctatgtatattcattccacagttaggtgccaatctaccaaaaagtagaacatccacatcctagacaatcttgtggaaacaaattatctccctcgcggcaaaaccgcctccatctaatacctagcatgccccctcatttgctgtcagtaaaatctgcgtcaatcacatcgcctccgtcacctggcttctcagaagtgcccgctgaaccagcagaagaagcatcagctgcaccaggtcctgcgcctggggcaccctgctggctgtagagggcctgcccgatctgcatgacttcctggttcaacgcactcatggcgtccttcatcgtctgcgtggagccaccagcaacagcatccttgagctcttgcagcttcgactcgactttcccttgacgtcacctgggaccttgtcccctagttccttcagttgcttctcggtctggtagatgaccgaccc

SEQ ID NO: 22558 - DNA, 372 bp, Zea mays
  Clone ID: cC-zmle1890011e11a1
ttttagcacgttcaaccaaaatgttatgaggcaaagttgacacattacagacttgtttcgctacatatcacatagccgcgggtgtctaaacaaaatacggacagcctactaacatcgacaatctttccagactcgtttggatctcccatgcttcaccttcatggactcgaatggacctgcgacttacttggacaccatgcttgttcttcatggactcaagtggacctgcaactcatttggccccatgcttccccttggagtgagcctggcgagccatctcactattgaatgtcttgctgcatgatttgcaagggactgacccaacacatgttggagacttctcccgtgatttgacattgtctgcaggggtct

SEQ ID NO: 22559 - DNA, 429 bp, Zea mays
  Clone ID: cC-zmle1890011e11d1
cagtaatccacacaagcacttcgacgtcgcacgggttttgtactcagacacaccaagtgtcggcaccgggggcttactaccaggaggtggactactgctcggaggaggtgaggtcggtggccccggccggatttggtcgccacggaagcggtgtccagtagcacgttgctaaggagaagttcgaggaggttgacacggttttacgcgccggcgccaactaccaccactcaccaccatggtcaccacggtggccaccgatttatggtgcgcgagaccagggttgatgaggacattaacacctgcaccggataggtccatgagcgcagggagagctttttcgccagggctatttgagccgtccggtggccggaattcacgcccgttcgggcctgcctgcgtgccttatgtatgtctgggggttgactgggt

SEQ ID NO: 22560 - DNA, 307 bp, Zea mays
  Clone ID: cC-zmle1890011e12d1
gattcaacccacgcgttcctcatacgttctacaacgccatcataatcgtaaacgatttttttatcgtctgggcctttacccataggtgggcatgaactgtgaagagctccttgcgatctggcacgtagcgctacctaattggttcgacgtggttactgatgaataaccgatgcacgggcctcgtcattgcactggggcatactaaacactcaacggacgatgggattgttaacccacgggcaaaaccctgacttggcctatcatgcgtacattttacatttttctctgatgcactttcgagtgctgt

SEQ ID NO: 22561 - DNA, 421 bp, Zea mays
  Clone ID: cC-zmle1890011f01a1
ttttggtttcgatacaactatattccaaaacaggggcgggatatctaatagggcaatgacacttgggccctatttatcaacccagcaaactttttgctgggctgcgctggtccgccgagaacatcaacactatcacgggccatacataagcgatgacgggtggaggacactacgaagaacccgtgtaagaaggggatacctaacaaatccgtggacgctgcaggctgctcaattgctggtgaacttggtgacggccttggttccctcggagacagcatgtttgcggagctctcctgggaggaccatgcgcacggaggtctggatctcgcgggaggtgatggtgggcttcttgctgtacctggcagagctggaggactcggcgcgcagctttttgaatatgtcgttgatgaacgagttcatg

SEQ ID NO: 22562 - DNA, 238 bp, Zea mays
  Clone ID: cC-zmle1890011f01d1
ccacgcgtccggtcaccacatgcactgggatgcccatgcagtctaccccactgcttctttaatgcgtcctactactcatggtgccggcgggggccatgaagatgccatgaccggcaaggactactaccgcggctaatgcgctcacttacatctccactaagagatgctcatactagaagcgcctgcccgcctttaacgtttcccccttcgacggcgccctgacctgtgaaagacaagg

SEQ ID NO: 22563 - DNA, 337 bp, Zea mays
  Clone ID: cC-zmle1890011f02a1
ttaatactaggaggtcgacttttacctaaaatggcatttcactagctggtttgaagggggggtcatgatgcatccaaatcaaagtaaaaaaaaattaacagttccaagttacatcccaatccatccatgtgcagaggaattgcatgtatccacgatgctcgtcactgctgaaatggcatacctttgcacgcacagaggaggatcggaggcggagctatattatatatatgcatctttatgaatttgtattctacttgcagcaccaggggaggtcgagcccctaaaagaagaagtatgcccagagcaccccggaaataccacccgagaagaacccttc

SEQ ID NO: 22564 - DNA, 535 bp, Zea mays
  Clone ID: cC-zmle1890011f02d1
gtagagatggctacagcagcttacgctcccatggcgagccaggtgattaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggtcaggcgggcgcgctcggcgccgccggcctcgtcgccatcctcagcgtctgcctcaccatgtacggcgtcgcctccttcaacgagggcgacccgttcacggtgcccacgctcacgctcaccggtcggaaagaaggaggccgacaagctgcagacc

SEQ ID NO: 22565 - DNA, 505 bp, Zea mays
  Clone ID: cC-zmle1890011f03a1
agtggttcgtttttttttttctgaatatttagttaagaccattccaaggctccttttggccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctgggccttcactaaccggggctaaaagtcctgaaatccaaaataccaaaataggaataaggcttgctattattagaaatgtccaaaaaatatcatattcgtaaagcagaaacataaatgtactcccattaatgtggaataggcggaactgaattagtcaattcaagttgacattgtcaatttatccagaacttctgtcttttcctcggtgaaacaagaatctgt

SEQ ID NO: 22566 - DNA, 522 bp, Zea mays
  Clone ID: cC-zmle1890011f03d1
ggaaatcaaaaagaagggaagtggggattacattggatgaatttttaaggaagacatatcacaaaagaaataagggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctagtttttgttgtttttgatgtggaaacagtctttttttacccttgggcaatgagtttcgacgtattgggtgtattccgttttatcgaagctttcattttt

SEQ ID NO: 22567 - DNA, 304 bp, Zea mays
  Clone ID: cC-zmle1890011f04a1
caactggaacggtgttgcgaattaaagcaaattaactctggtactggtacattcgactcgaataggatccaaaaatactcacggcaatatcactggccacacaaagcagacatatagctatggataaattaggctggtgcattgcccagccaccaccatcgccagcaccccaggggaaggactgatcgaaagtcacgcctagatcttgttgaaggcaactatgtcgcaactctgtacgtactcgttaactggctcagcgcacagatagtcctcaatgagagtgtcgacagagacaaggtcgtcg

SEQ ID NO: 22568 - DNA, 314 bp, Zea mays
  Clone ID: cC-zmle1890011f04d1
cgacgaccttgtctctgtcgacactctcattgaggactatctttgcgctgagccagttaacgagtacgtacagagtggcgacatagttgccttcaacaagatctaggcgtgactttcgatcagtccttcccctggggtgctggcgatggtggtggctgggcaatgcaccagcctaatttatccatagctatatgtctgctttgtgtggccagtgatattgccgtgagtatttttggatcctattcgagtcgaatgtaccagtaccagagttaatttgctttaattcgaaacaccgttccagttggaattctgtt

SEQ ID NO: 22569 - DNA, 459 bp, Zea mays
  Clone ID: cC-zmle1890011f05a1
ctgattttgctatatgaccattgggggcaatatggatggaatgtacacgtacgcacgcacacacgttacaaagtcaccacctgtacctgccggccggtggcgcgatctaggctgctgagtctgatcttaacaacggcgacgtagggatctagccgatgatctggacgagggcgccggtgtttttgagcccgagcacgatgccgacgccgaggatgtggccgacggcgccgcaggccagcgtgtcggcgagggtgaacccggcggggtcacccgtctgcaggccggagtcgcgcgccttcagattcagccccgccgtcgccttgcggttcgcggacggtgccagcccgaaccgccccgcgaacagaatcagcgttgtcggcgtcaccatgatcaggttggtggcggagccgatttattcgcagcggatggcctgcgacgacgacctttttctgcccaccc

SEQ ID NO: 22570 - DNA, 434 bp, Zea mays
  Clone ID: cC-zmle1890011f06a1
ttttatgaaagccttacgacgcactttattgtttatgaaacatgttacatcggattaccagtctgaacaataacaccagagggttcatgggccccctataccggttcctttcaagagacagctactgtggttgtacatgtgccacctgtgcgaaagaaaattggccacagtattttgggagcaaggcacgggatcctcgggaaaggtgagaagaaaaacaaggatatttcttcactgcctgcggctcctgtcatctccggtatacgtatagctggacaagacacacatctatacagatcgggtcactggtcaacttgcacagagtaaatgattacacgtgcagctctttatgcggctacagctaaaggtatttggctggtctcggacgcgtgggcggacgcatgggtcgctccgggaataccggaccggtacct

SEQ ID NO: 22571 - DNA, 529 bp, Zea mays
  Clone ID: cC-zmle1890011f06d1
catttaaaactgtgaaaccatatcggaagtgcatatcatctgttcatcgtatatatgagaatggctgtgtttgcccacaccacgacagtgccaaatttgtgttgggaagtgccttgaattgtgctaacatattctgtacatgctgccgtgcctaatatggatcctatggtcgccaattgccacaatggtacaacactgctcattgcaatacaagcttgccactgttggatacaggttactgatagagctgaaggctctgattgtgcacatatgtaatagattcaaaacattaggggagcttctgtgtgtgttgtacatatgtaattgattcactaatatttgagctgagttactgacttcatgttctactgtttatagattgcgaactgtgcttaaatcaggcattcagtattggtctctacagagtaagctctgccaagcattactaagaactgagaaggtctggacacacatatgtttgtgagcaattttgaacaaataggtctcccgataatagcgatgttttggg

SEQ ID NO: 22572 - DNA, 393 bp, Zea mays
  Clone ID: cC-zmle1890011f07a1
ttttaggaaagccatacgacgcactttattgattatcaaacatgttacatcgtttaccagtctgaagaataacaccagagggttcatcgaccccaaatacagtttcctttcaagagagagctactctgctagttcatgtgccacctgtgcgtttgtaaattggacacagcattctgggagcagtgcacggcatcctcgtgaaaaatgagaagaaaaaaaaggatatttcttcactgcctccgtctcctttcatctccggtatacgtatagctggacaagacacacatctatacagatcgcatcactggtaaacttgcacagagtaaatgattacacgtccagctctttatgcggctacagctagaggtctttggctggtctcggacgcgtggg

SEQ ID NO: 22573 - DNA, 393 bp, Zea mays
  Clone ID: cC-zmle1890011f07d1
cccacgcgtccgagaccagccaaagacctctagctgtatccgtataaagagctggacgtgtaatcatttactctgtgcaagtttaccagtgatgcgatctgtatagatgtgtgtcttgtccagctatacgtataccggagatgaaaggagacggaggcagtgaagaaatatccttttttttcttctcattgttcacgaggatgccgtgcactgctcccagaatgctgtgtccaatttacaaacgcacaggtggcacatgaactagcagagtagctctctcttgaaaggaaactgtatttggggtcgatgaaccctctggtgttattcttcagactggtaaacgatgtaacatgtttgataatcaataaagtgcgtcgtatggctttcctaaaa

SEQ ID NO: 22574 - DNA, 360 bp, Zea mays
  Clone ID: cC-zmle1890011f08a1
gggacaaagaacacaatttttccttggcgattgaacaatagtttacattatgggacaaaccgaaaaccagcgggcgctcacatgcattcggacacctaaagggcaccgggggggcctcccttacttgccggggacaaaattgggggcgtaggcccaaacgttgttgttgacggggtcggcaatgtggtcagcgaggttttcgagcgggcccttcccggggacaatggcctggacaaaaaatccgaacatggaaaacatggcgagggggccgttcttgagctccttgaccttgagctcggcgaaggcctcggggtcgtcggcgaggcccagcgggtcaaaactgccgccggggtagagcgg

SEQ ID NO: 22575 - DNA, 559 bp, Zea mays
  Clone ID: cC-zmle1890011f08d1
tcgatctgcaagtctcgctacgtagcagtgcaataaaaaaaatcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcatggccggctcccagatctacagcgagggcgggctggactacctcgggaacccgagcctcatccacgcgcagagcatcctgccatctgggcctgcaggtcgtgctcatgggc

SEQ ID NO: 22576 - DNA, 412 bp, Zea mays
  Clone ID: cC-zmle1890011f09a1
gaagagatgcactgattattgttacatgacgaagggtgagcattcatggaggctagattataaactgaggcccatgacgttacagaaggacacacacgacccgcccgccagggatatccaaatccagaaagggcgctagaggggcaaacaacgagggcgccgccgccgaggatcccagcgagggtgacggcccaaatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggagc

SEQ ID NO: 22577 - DNA, 306 bp, Zea mays
  Clone ID: cC-zmle1890011f09d1
cggacgcgtgggaaaaaaaaaaaaaaaaaaaaaaaaatttatttaaaaaaaaaaaaaaaaaaaaaaaaaggggagggaaaaattaaaaaaaaaaaaaaaaaaacaaccaacatttctaaaaaataaatctctgtgggccgcccttttagagttcccttccttctccccccggctcatcaatataatccctttttttaggtcctcctcaattatatgttgctggcccctctttttctcctcctatttggggaaaacccctgggtttccccctttttttcgttttgtaacaattccccttttctcctt

SEQ ID NO: 22578 - DNA, 402 bp, Zea mays
  Clone ID: cC-zmle1890011f10a1
aaactcacatgaagaactcaaatgggtatatgttcccttgattaagggttttttttcctttcaaaattatataatctagcttatggattatataataagcacataattatctggttatgtattatcataatctagggttctagattatacaatacatctaataacctgttttgtttggttgtctattaacttatttaaactggattatttaatataaaggataaacaaaccgggctaaactgacatgaaaaacccaaacgtttacgaagatactgctccctgcttttgggccacccgcgccagagatagtttgccgaccaatttggtcgcgaggctgccgaggaagatgtccccgttgaactccgtcaccgacgtgacgaagttgatcaccttcccctggga

SEQ ID NO: 22579 - DNA, 325 bp, Zea mays
  Clone ID: cC-zmle1890011f10d1
gagtcgacccacgcatacgttcgtgtgatgtattggaaagggaggatgggcttcttctgtattatcaagctgtagatgatgcttccgagattgggggtgatgaactaacccatgaacagaaggtgagtctggcttatattaggaagaataaggcttttctttatcccacaacataaaatgaagaacagaactgtagaacgccgttctattgtccctagaaagtgggacaatgaaccgaacatttagaactgataggatggcacgccagctttcatccatggttttggatcctatggctgccatcattacaacgacttatcagtct

SEQ ID NO: 22580 - DNA, 370 bp, Zea mays
  Clone ID: cC-zmle1890011f11a1
ttttagtatatatatagtatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggtctcgccggactccgccgc

SEQ ID NO: 22581 - DNA, 317 bp, Zea mays
  Clone ID: cC-zmle1890011f11d1
aatttgttggactacccacgcgttcgcccacgcgtccgtccacgcgttcgcccacgcgttctttcaaagtttaccccatctaacatggttccaagggtcaagatcttggtcttgaagatgcagttcataatccgctaggaagtcaagatgctgcccaccttcctgagaggcttttcccaatgtggagacattgcatgttctgtcacatgaaactgatgagcaaaatggtaagtttaatttgaagttctgggaggaggttgtctccatcaactgcctagagacacgcatcaccaagggggtgtttgaccaaatttaaa

SEQ ID NO: 22582 - DNA, 414 bp, Zea mays
  Clone ID: cC-zmle1890011g01a1
ttttaggataaaatcagggttgttggggcttagctataagagcacccagattctcaacgatgatcctatagagccgactcaagtataattctcgagcctacaaaaagtcttccaaccaacaacaaatttccgcacactacatactcagaaagtaaaaaaaaaaaagataacaaaaggtatagaaaggacgaggggaatcgcaagttcagaccaccaacacaaccctctacggacccaggtatctacgcttatgaggagtactcaaagggttgcggcggttgtggctcgtcgtcaacggccatggcagatgatccggacccctgttggcttgcagctgtggcagtgttgccggtgcttcctccaactgctgggggagcatcggtcagtgcaaggtcctcggcctcagtgggctga

SEQ ID NO: 22583 - DNA, 532 bp, Zea mays
  Clone ID: cC-zmle1890011g01d1
tcaactcctgacgaacccagctcgggtgatccctgcacaggagaagttcatcaagtttcttgaaaacagccgggacggccctgtgaaaccagcgccttctggattcatcctcctccgagaccttcagcccactgaggccgaggaccttgcactgaccgatgctcccacagcagttggaggaagcaccggcaacactgccacagctgcaagccaacaggggtccggatcatctgccatggccgttgacgacgagccacaaccgccgcaaccctttgagtactcctcataagcgtagatacctgggtccgtagagggttgtgttggtggtctgaacttgcgattcccctcgtcctttctataccttttgttatcttttttttttttacctttctgagtatgtagtgtgcggacatttgttgttggttggaagactttttgtaggctcgagaattatacttgaggcggctctatagggatctcgttgagaatccggggcttttattgctaagccccaacaaccctgatttatcct

SEQ ID NO: 22584 - DNA, 282 bp, Zea mays
  Clone ID: cC-zmle1890011g02a1
attggtctttttttttttttttttttatcaatatcaacttctggtggataagcaaattcggagttcaacaagaaacgcacgggcacttgtctcgggagggggtaaaaaaaacagtcgtcaagtccaggagagggttaagaaacataaatatgtgaatcttgaccaccccctaaatctaatcaccacaaaggcttggacttggccctaacgcgactgcaacacagcacgcacattcaacaacgaattattgctatctacggagccatggtaaaaggccggggc

SEQ ID NO: 22585 - DNA, 517 bp, Zea mays
  Clone ID: cC-zmle1890011g02d1
acccacccgtccgcccacgcgttcggcgccgggcgagtctagggccacctcccttttttgggcagcggtcgcgagaggctcccgcggggagccactccaccgcagcctggagctcctttcccttggcagcggcaagaggaaatagcgggaaggaagccgatctgatagcggaagggaaaagaatgcctgttggcgactctgtaaatgacggggcatgtcacctgttcttcgccagcagttcttcccctggggcatcccgtaatttcatggtgcccgccccggccttttaccatggctccgtagatagcaataattcgttgttgaatgtgcgtgctgtgttgcagtcgcgttagggccaagtcctagcctttgtggtgattagatttagggggtggtcaagattcacatatttatgtttcttaaccctctcctggacttggcgacttttttttttacccccttccgagacaagtgcccgtgcgtttcttgttgaactctgaatttgcttattcaacag

SEQ ID NO: 22586 - DNA, 483 bp, Zea mays
  Clone ID: cC-zmle1890011g03a1
ttttgaaaagaaaactatacgtatcctgctattgcactgcagtagcgcaggtgatcaatcgttttgggttttggccatatacagacttgagcatggcagtaaagagaagtctgaacttatttgctaacgaagctcagatagagagctgatgagtagcccattcgcccgcgtgatcactttgtgagctgctcctccttgctcgcttcctccagctccctgaggcccccaaccctctgctcaatctgctcgagcagctcctcccgcagcagctcctccctcgcagacgcctccaggtcctcttgcctgtcgtagtaccagtgcacggtcccgtcgccaccctggctcctgtacgtctcgctgtcgtagaagggatccttcatggacgcgaagaagcagactccccagacggtgaacatggcgtagaaggtatagacgctcttgagggctgcgtcgctgagatgccagatggacttggtcacgacg

SEQ ID NO: 22587 - DNA, 527 bp, Zea mays
  Clone ID: cC-zmle1890011g03d1
atgccatcggaggagcagctggacgaccatggcctcgccgctgctcatgtcgcactctcagctcgccgccgccggcgccctgcactccgtgaggagagccgaccgctgccctgcgacaatacacctgggcaagttccatgaccacgggctcaggtccggccgttctaagagatccggttcagcgaaggtgggcgccttcccgtcgctggacgtggtgccgctgatggtgacgatggtggagcacgtggacatgtcgcgggactacgtcgtgaccaagtccatctggcatctcagcgacgcagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgccagggaggagctgctgcgggaggagctgctccaggagaatgagcacagggttgggggcc

SEQ ID NO: 22588 - DNA, 492 bp, Zea mays
  Clone ID: cC-zmle1890011g04a1
agcgtggatcctctagagcgggcgcccttatagtggtcttccactttctaaacacaatgttttacatacggagtatgggcttacaggcgtgatgccgtagtcaggattgaggattgcgcgcttggtgcaaatctagatgtacatacaggctgccgaggaatcaggcccttacggatagatgtcaatatggccaaacggcgctagctagcctcaacaagtttcgaagaccactatggcacacttaagaacaagcttcagcttcaggaaactggtggtgacagatttaatacactatctaggttacaatgactgatactgcggtacaggcagttccgaggatgttgcaattttgaggcaccaggtacggttacttggcagctggagaactcatgcctcttccacttgctcttcctcttcctggagaaggttcttcctgttgttgtgggcccagaagccgcgcacatctataagcatgctggcgacagtcccacc

SEQ ID NO: 22589 - DNA, 538 bp, Zea mays
  unsure at all n locations
  Clone ID: cC-zmle1890011g04d1
cacccgtccggagggatgaaatctgggacatggtgaaacccgcagatcctcttatgatctcgctatcagaccttctttcttgggggcagggtgggactgtcgccagcatgcttatagatgtgcgcggcttctgggcccacgacaacagggagaaccttctccaggaagaggaagagcaagtggaagaggcatgagttctccagctgccaagtaaccgtacctggtgcctcaaaattgcaacatcctcggaactgcctgtaccgcagtatcagtcattgtaacctagatagtgtattaaatctgtcaccaccagtttcctgaagctgaagcttgttcttaagtgtgccatagtggtcttcgaaacttgttgaggctagctagcgccgattggccatattgacatctatccgtgagggcctgattcctcggcagcctgtatgtacatttagatttgcaccaagcgcgcaatcctcaattctgactacggaattacgcctgtaagcatatactccggatgtaatacatngtgtttagttcg

SEQ ID NO: 22590 - DNA, 477 bp, Zea mays
  Clone ID: cC-zmle1890011g05a1
gtgcaatacagtttccggtctcaataagagcaatactagtttggggttacaggcagcaggctggccatgcatgaatcatgaccgatgcaacgcttcaggttcctttacaacacgcatgcatctagctttccacagcaaacaactggcggcggcggcagcaggtatgctgatgcaccaacgttctagtggaacttgaggctggtgagcacgttgttgttgacggggtcggcgaggtggtcgagcaggttctggaacgggccaacgccggtgacgagcccctggatgaagtaaccgaggatggcgagcatggcgagcctgccgttcttgatctccttgagcttgagctcattcatctccttctcggtcttgccgaagccgagcgggttgaagaggggcccgccggggtaggacgggtcgccggagccggcgaggaacttctcgaggccgaggaagtactgcttgcccatggagcccggg

SEQ ID NO: 22591 - DNA, 521 bp, Zea mays
  Clone ID: cC-zmle1890011g05d1
cccacgcgtacgacgagcaccgacgactacaggactggtacattctgtgctccatgggcaagcagtacttcctgggaggcgagaagttcctcgccggctccggcgacccgtcctaccccggcgggcccctcttcaacccgctcggcttctgcaagaccgagaaggagatgaatgagctcaagctcaaggagatcaagaacggcaggctcgccatgctcgccatcctcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatggccagcctgctgcctgttacaacaaactagtattgatcttattgagacccggaaactgtattgcac

SEQ ID NO: 22592 - DNA, 359 bp, Zea mays
  Clone ID: cC-zmle1890011g06a1
cattcaaacatggcagagttggcatttcccgctacctatcatacgagtccgccgtagtattccaccaaaaacaactcccatgtccgagtcttcctctgtcgaacaatgcgcgccagccgagagcgagtagtttacttcagcttcttcttggggcggagctggttggtgtgaccgcacttcttcttgcggcaattggtggcacggggagggagactagcgtagcacttgcggcagatggccttgtcccagttgtacttggaggcaagggccttgagcgagggctcaatgataccaccacggaggccgaggaccaggtggggggtagactccttctggatgtggcactccgacagggtacg

SEQ ID NO: 22593 - DNA, 525 bp, Zea mays
  Clone ID: cC-zmle1890011g06d1
agcaaagatgcagatcttcgttaagaccctgacgggcaagaccttcacccttgaggtcgagtcctctgacacaggcgacaatgtgaagagcaagatccaggacaaggagggcattcctccggaccaacagcgtctcatcttcgctggaaagcagctcgaggatggccgtaccctgtcggactacaacatccagaaggagtctaccctccacctggtcctccgcctccgtggtggtatcattgagccctcgctcaaggcccttgcctccaagtacaactgcgacaaggccatctgccgcaagtgctacgctcgtctccctccccgtgccaccaactgccgcaagaagaagtgcggtcacaccaaccagctccgccccaagaagaagctgaagtaaactactcgctctcggctggcgcgcattgttcgacagaggaagactcggacatgggagttgtttttggtggaatactacggcggactcgtatgataggtagcgggaaatgccaactctgccatgtttgaatg

SEQ ID NO: 22594 - DNA, 338 bp, Zea mays
  Clone ID: cC-zmle1890011g08a1
ctttgtttatctagtgagtggaggtcggtctttttgtgtattttttgtaccagaaaattttgacggacaaacaatggtcccacatggtcatcattacgcgagaaatgcggacacgaacatttctgggtcaccctgcaatataaaccccgctggtttaccaaactgggaggaccacaaaaacgggggaacaaacatccccccaagtggacactggccactggaggtaagaccttcttactgaactgggaacatatttcaagaatgcatcaaacaatgggtgccgctgccctatcaaagctggggcaaaaatgaaaacgatccttgctcagaggtgcaga

SEQ ID NO: 22595 - DNA, 473 bp, Zea mays
  Clone ID: cC-zmle1890011g08d1
cggacgcgtgggccagccgccgccatgtcgaagcgaggcatgtgaggttcggcggggaacaagttccgcgtgtggctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgttccgccagcgcaagccgtggcgccgcaaggacggggtctacatgtacttcgaagataatgctggagtgattgtgaatcccaagggtgagatgaaaggttccgctttcactggacctatcgggcaggagtgtgctgatctttggcctaggattgctagcgcagcaaacgccattgtttgagagcttcgttggaatatgttcagac

SEQ ID NO: 22596 - DNA, 378 bp, Zea mays
  Clone ID: cC-zmle1890011g09a1
ggagaaaggagatgagatctcatacatagttgattcagagtacagacataagacatgatcagaaattcataatgcagcagcctatgaccaggcccttctcttgagtcagtcacccccacttcctcgcgcaagcaggctgacaaatgttggaacactagccacacagtggctggctgtctaacgcaaacaccactcgagagtcgagaagaccgcgatgcatcgcaccctgcctcttttatttggggatcgccgcagccagcagaattattattagggtaccagctagtagtttctttcgttcgttcaccaagggaggatcttccagcgctggttgtcgccctcgcaccacttccagagcacgatctcggtaccgtcatg

SEQ ID NO: 22597 - DNA, 541 bp, Zea mays
  Clone ID: cC-zmle1890011g09d1
ccgcatggtcaacaacacccgcctcaacttcgacgccttccacggcgacaaggaccacggcggcgtgcacgacggcaccggcgtcgtgctctgggagtggtgcaagggcgagaaccagagctggaagatcctgccgtggggtcccgaggccaactccgccgcggcccacgcgggaggcccgcacgccgtgcgcgtcttctgcaaggccggcggcgaggactacagcctcacggtgcgcaacggcacggcgtgcctggcgcccaccaacccgcgggacgagtaccagcactgggtcaaggacatgcgccacagcacccgggtgcgggacgaggagggctacccggccttcgcgctcgtcaacaaggtcaccggcgaggcgctcaagcactccacggggcagggccaccccgtcaagctcgtgccctacaacccggactaccaggacgagtccgtgctctggaccgagagccgcgacgttggcaacggctttccgctgcgttccgatggtcaacaacatctaccttaacttcgacgccttcca

SEQ ID NO: 22598 - DNA, 529 bp, Zea mays
  Clone ID: cC-zmle1890011g10a1
aggagtactacaatttttattgaagacgacaaatagttcgaacgtacaggtacgacatacaagccttcaaatttattcagtgaaccaaaacagtaagccatctgtctgttttttaggactatacacttcaccggttgggaagatatctacttaatcacagctacgtgtgtgcaatatatacagtggcatatcatcttctcgctatgagatacagtatatacagttgtattctagagcccacgggggaaatgtcagaactcgaaacccccgttcaattgaacggataaagaaggccttgccatgttgtcaaggggtgtctccaaggtgattactagtcccgaactgccgacctggccattccatttggatcgcccaagagagagagctgtgaatgctgagggatgtctttgagcaagagaaaccacacattacgctgacttcctccttcaaagagtggacaaactcggtgcatattccaggatcagttcctccgaaagtggggcaaacactgatttgaatgctgggcctg

SEQ ID NO: 22599 - DNA, 269 bp, Zea mays
  Clone ID: cC-zmle1890011g10d1
gaattatggagtcgacccacactttcgtacgggttctcgaaacactagacaccgatcgtggctttcatctttaccaccacacgcgaggcctacgggcgcagggagagcttcctcgccaaggctctctgtgtcgccccgcggccgtcattatacacccgcaaatgcctgcctgcccagcctatgcatgactgatgccgactagttgtgcaaggtcatcgaacatgacatttataacgtgcacgcgcttggccgctgttcgaaatatgacc

SEQ ID NO: 22600 - DNA, 366 bp, Zea mays
  Clone ID: cC-zmle1890011g11a1
ttttagaaacaaatgaaagaatttcattaataagcacgcggggcatgaaccatgattttcatatgggacactccatgggtactacacccaccttgaatcgatcacatatacctctgctgtctcagtatctaagaaagaatcaccctggaccaaaacacactcacacacacacacacaaaagtaaaacacgatggtgtatacagggccgaccaccgggacgccccggggaggcgtatataacatgactggggttgcgaccgctcccgcgactgcaaccaagaaaacggcggaggcacgcgaagtagtgaatctgccaaagggcgcgaaggggggggctccggccggggcggcggggacggtctatgt

SEQ ID NO: 22601 - DNA, 332 bp, Zea mays
  Clone ID: cC-zmle1890011g11d1
acccacgcgtacgtggacgcgttatcggatggatttcccaagcacacttttgccatttgtctgcagtctgcaagcatgcatcggcgttgcgcagtcgaaatggctgttactgcagtatatgccttcctggtgccttttattcgcggttgctctttgttgtttcctgatcgtgggctgtggtcggacggcgactttcaccatttgcgaacaatctgttgctacacggtgtggtcggggttgctgaacagcgcgggcttcgcgccgttgttcaccacggggatagatctggggtccttgggagttccttgccgtggatgctccccgctgagtgg

SEQ ID NO: 22602 - DNA, 415 bp, Zea mays
  Clone ID: cC-zmle1890011g12a1
agcagcaaccaacaaatcattgtttttttttatattgcaagcatgcgggggcaagtcacaaacagggtacaatcacatatggccattaaaaggggggacatttgcccgcattatttcaactaatctaaacaggcttatttcattttgaccatccagctgcaaaaaataagctggggggtatgtagtcctggcaaataaaaaaacgggagaggaaatacctgaagatttccaacgataatggggggcattattacacgagcctttcatgactaatttatttttaactatccaaaccatgcctggggagccaccgcatgggggacagagctcaacctatcgggcaggggggtacattttggagggtggcctgcatccaccatacggggcgcaagggcatcaactacttgatcctttg

SEQ ID NO: 22603 - DNA, 392 bp, Zea mays
  Clone ID: cC-zmle1890011h01a1
agataagcccgactgcccggttatttatttctccaaaggtacgattatacacgcacactcgtatggtgcagatcattatttcagcaaacaaatcacttgtttgcactaggattgtatagtcgtagcttgagactaatacgacatgatttgttattgcttagtatttactaactcatccccgaataatatatataagcttgaatgaatcttttgcatgtatgtacgtatagttcgtgcttcttcccacaacatgcatgtatcttacgcctggctgtagtcgatgacgatcttgccggcgccgaggttgccgatggtggcgaaggcctgctgggagaggtcgagcgtggcctggcagccgggcgacgggcagaggtcgacgatcttgacggtga

SEQ ID NO: 22604 - DNA, 535 bp, Zea mays
  Clone ID: cC-zmle1890011h01d1
aaaatatcgtctagcatcagtagcatccccctgcagtgctggccacataatggcgaataagtccgctgccgctgctatgctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgcgggcaccaacgagaccccgaacccctgcaaccccggcgcctccgtcaccgtcaagatcgtcgacctctgcccgtcgcccggctgccaggccacgctcgacctctcccagcaggccttcgccaccatcggcaacctcggcgccggcaagatcgtcatcgactacagccaggcgtaagatacatgcatgttgtgggaagaagcacgaactatacgtacatacatgcaaaagaatcattcaagcttatatatattattcggg

SEQ ID NO: 22605 - DNA, 438 bp, Zea mays
  Clone ID: cC-zmle1890011h02a1
caactgaacattcacataataatggttatatccagtggggaacacatgccttccaccactgaactttactcggccacagaattactcactgatcctgcaatgtgtgtattatatacaggtacgcagtgcatgaacaaccaagaaccatctattatatactagctgcggcggaatgacggaggaaaaccctgtttttataaatctctgggaacaccagcggccaagcaagctcagacagccagcgtaaacaggaactggattcactcgatgcacaaagtaactccaaaaaccagagtgcgaagcagctattaaatccttcaaccaaaagccaccaacattcacagaattccttgaatctccagattagccgtccgcttcgagaactccatcagccaaatcttcattttcttgaccttgtcatacaagaacctggcacca

SEQ ID NO: 22606 - DNA, 425 bp, Zea mays
  Clone ID: cC-zmle1890011h02d1
gtacttcactctattataggtgcttggaaaaatttggtctgttgcattcaaatatcacttgcgcatgccacctgagtagacacttgttctacggtcacttgcctctttggaaggactagccgtggcagcagatgggactcttataacatttcaggcagcatacccatatgttgttcggaagcttctgtccgaaaattcacttgaaacaagaagactcttgaatcaggcaatttttaacagaaggaacgagttccattggcagaagattgacgcgtttctaaaatgggcttcagcaaggaccaacttcaagtctaacagcgaagttttgtcagagcctgacatgaagtccatgaatgtggctagccttgtggagatcagtgatgcatattcactggaccgagctatgagctccaccagagagagca

SEQ ID NO: 22607 - DNA, 301 bp, Zea mays
  Clone ID: cC-zmle1890011h03a1
attgggttcttttttgggttatattttaaaaaaagtttttagccatttaacattgttcccgaagagacatgactaccgccaatgcacggacggccacctacagaaatagcacagcgccctggggggggggggcgaaccccgaactccggaccccggcgccggggcaacaacccccataataatgggaagcggatccacgggggaatggacccagggattaaagcaaaaacacagagagaagaatgcccgcattaagcccccccccaaggtcgggggggaagccccggtgacaacaggcggg

SEQ ID NO: 22608 - DNA, 62 bp, Zea mays
  Clone ID: cC-zmle1890011h03d1
cttatgtatgtgttatttgacaatgcttatttatgatatattgtatagtacttatttatatt

SEQ ID NO: 22609 - DNA, 313 bp, Zea mays
  Clone ID: cC-zmle1890011h04a1
tttttggtgtcgaattactgttttcaaccaagatgaccgaaagccacgctgcaacaaggagtaccagactgatcctttagaccaggtctcataactagtgcaaagcatatggcgctctatcaaacggagggcaaccatgtggtacaggactggtactttatttattcgacttactggaggtagaagagaccgggggaggacaaggtccatatatttgatcacatttacttcacgggtccaagactttaccgaattatacactgctattctaactgaaggcctgatgtttacgagctccgggctggtgaatgcg

SEQ ID NO: 22610 - DNA, 368 bp, Zea mays
  Clone ID: cC-zmle1890011h04d1
gaagcagcgcttcaaaacgcattaatagggacaactacagactgtcattgacccttgttactccagctaggcgacgcggcatggactgtcgacttgtgacttacgacacatccacgctacaggcgataagcttggcatcgtattcaatgacgctgctacaagatatcagggcttgtcagagcagtaaaatcattgcattgggaatacgtgacagatacaagaagtttgctgatcgattgacgccctatattgctggtaccaatcgtgtgctagatgaatttattactcataagaagatattactgatcgaaggcgggcaaacagatatgctggctacagattttggtactgaggacatatagtgactt

SEQ ID NO: 22611 - DNA, 375 bp, Zea mays
  Clone ID: cC-zmle1890011h05a1
attattattataattattatgtaggggagacgattccattctacaccggaaagaaacatcagcagatctcacagccatttcatgcacactcgacaagaaactaatcagagcagcaatactgccagtactccatgagatctgcgcaaatttctttctagtaggagagaagatggtgaacgaagcagacgacacacacgacgctagctgagccttgagatctctgcagctctcaagaacccaccgccaccggccgcgtcacggggaccaccaccacccgaggcggcggcggcccgagcccgactccgacgacgacggcttctcgtgattcgcctcgtagttccacttagtggacggcccggacggagggatggtgag

SEQ ID NO: 22612 - DNA, 509 bp, Zea mays
  Clone ID: cC-zmle1890011h05d1
cggacgcgtgggcggacgcgtgggtactgcttcgtcgccgtcttctcagctcgacgcggctatagctgcactgaccgcacctcgaccgcgtgcccaccggcaccgctcagtgctagcgcgcgctcatggcgtcgcttggccagctcctcctcgtcgccggcctggccttcctggtgctgctgctgggtgcccaggatcacgggcgtggagagcaagcgaccggcggcggcccggccgttggagcagcagccgccgccgctgctcctcccgcgcgggaggctgtaatcatcagccggcaccagcattcgcagccgtcggccgcggcgatggcggagagcaagcggctccccatcccttcgtccgggccgtccactaagtggaactacgaggcgaatcacgagaagccgtcgtcgtcggagtcgggctcgggccgccgccgccttcggtggtggtggtccccgtgacgcggtcggtggcggtgggttcttgagagctgcagagatctcagg

SEQ ID NO: 22613 - DNA, 434 bp, Zea mays
  Clone ID: cC-zmle1890011h06a1
ccaagaaagaaactggacgtgtgagatcaaatactagtgatgagataaattactatttgtattcttctctcagctccacataagctagctatttgagatagcaattgcggacggcctaagcagaagaactagaatagcttgttttctgcatgcatgttgccggtcccacaaatgcgcggccggggcgcattcattcccagtcttcactagctagttcatcgatcatccattcatccttgcttgcactgaacgtggatcttgtttttccttggtcagcctgactttttgttggctatctcgatggcttccgctagctcgtcgatcttggcgccggagacctatttgacaaccttcccgcccttgaggatcttgaacgtcggcacaacctttatgcacagcttcttcgcgagaggcttgttgtcctggttgccttc

SEQ ID NO: 22614 - DNA, 507 bp, Zea mays
  Clone ID: cC-zmle1890011h06d1
ccagagagtacggccgaccagaccaatggcactgcggttacccatctcctcgacccacgggctggcctcgtgggcagcgcccatctcctccacgacgacgtgccggccggccgccgccagtgggagcttgatcccgccagctgccctgatcgcagttgccatccgctgggcgtcggcgtcggcgtcccaaaagaggggcctgctgctgacgacggcgaggggcggcggagtcgcgccggtgaggtcgagcgggatcgagacgacgtcgacctcggtgggagctgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctcccaagttccaggagatgtccgagaagaacctggacgtcgtgttcctcaagctggactgcaaccaggacaacaagcctctcgcgaaggagctggg

SEQ ID NO: 22615 - DNA, 436 bp, Zea mays
  Clone ID: cC-zmle1890011h07a1
ctcgtactaatacatgtgtttccacattgaaccatacgctggcaagccagaagtaagcgcacaaaacgaaaccccatgcatgggatatacagatgatactgatcaaacgatctctacccttaatatccccttcagctaatgtacataccagtcactcctcagccctcgctcccttcagaccatgcatgcattgcaacacggcccgaatctgtaccctccagatagattaacaacacacacaaactgatccagaaaggaacttaaggtttcaatgtttgccttccagtccatatcagctcaccagcgatggatcgtatccctcctcgaccttgactcaaccggagaaggtctggatgatggtgttgtgccatgggtcagacaggtgctgcagcaggttgtccaagggccccttgccggtgacgttgtgctggatcag

SEQ ID NO: 22616 - DNA, 547 bp, Zea mays
  Clone ID: cC-zmle1890011h07d1
cccacgcgtccgcggacgcgtgggccctccgccactccatccatctcctcgctcccagtccccgggaagcatggggtccgtcaccgtccgcgccccggtagcggcccttcgcccgtcgtcggcatcgctcaagtcgtcgtcggccttccttggccactctagccgcctcggccgcaccgcgtctcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcattggtacgacgccggcaagtcggagtacttcgcgtcgtcgtccacgctgttcgaggtcgagttcatcctgttccactacgtggagatccggcgtggcaggacatcaagaaccccg

SEQ ID NO: 22617 - DNA, 318 bp, Zea mays
  Clone ID: cC-zmle1890011h08a1
tttttggagctatatgtccattggaaccaagatggatgcaatgtacacgtacgcacgcacacacgttacaaagtcaccacctgcacctgccggccggcggcgcgatcgaggctgctgagtctgatcttaacaacggcgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgcctccagcttcagccccgccgtcg

SEQ ID NO: 22618 - DNA, 519 bp, Zea mays
  Clone ID: cC-zmle1890011h08d1
ccactccgcgctagctgaggacggtacagcggcacagatgtgtgacgtacgacgacgacgacgcaggcgcgacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggtctgcagacgggtgaccccgccgggttcaccctcgccgacacgctggcctgcggcgccgtcggccacatcctcggcgtcggcatcgtgctcgggctcaagaacacccggcgccctcgaccagatcatcggcttgatccctacgtcgcccgttgtttagatcagactcagcag

SEQ ID NO: 22619 - DNA, 423 bp, Zea mays
  Clone ID: cC-zmle1890011h09a1
gactcgatgaactgcttcttgattgaataagcaaatttacaatcaataatctgtacaattgatatccaattctgggagaacgaaaagatatgtgggcctcccctgcttcaaatccaatctgcaagcttctcttcctcgttcttgccagcgaagaggaggcatcattgcatttggtccttggagcatcgaatcctattagtagtatcagtagcagcagctgccgacgggcggctaccggcggccggccaggcggttgagccaagcgttgcggagctggagctcgacagggtcgccgaagcactgcgcccgcgcgaggcagaagtgcgtgcagaacccggccgaggagcgcatcgcgcaggtggaaagcacgtagcacgacgcgcgctccatgccgtgcgcctgcaccaccaggccccacacctg

SEQ ID NO: 22620 - DNA, 556 bp, Zea mays
  Clone ID: cC-zmle1890011h09d1
cccacgcgtccgaattctacttctacttcggaaccgccgtcgctcccggcgcctcggattatcaactaccgcaggaggtcgcggcggcaggatcggtggtccagcgtgcgatggcggcggcgcctaccgtgcggggctacgggccagcgtcgccgtcgtcgtcgtcgtcgtcggtggcgctgcctcggccgcgatcgcgggtgcccgcgccgctcgtgcccgtgacgacgcggtggggggcgccgtcggtgcgcctgcgcgcggcgggcgcggacacgcctccccgcggcggcctgcagctccagcggcgggaggaggacgaggggctgtcggggaccgtgttcggccgaggggaggacgatgaggtgtcggagaaggtcggggaggacaaggtggagcggtggatgcgggagtcgatcgcggagatcgtgcggcacgtcggggaagcgccgttcctggtgcacctgttcagcggcggccagggccatcgcgtgacggggcgggtggaagcccccggcgccggaaagctggccggacgttgccgcgccggtggggg

SEQ ID NO: 22621 - DNA, 436 bp, Zea mays
  Clone ID: cC-zmle1890011h10a1
ccttaagattaacttaaaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgtcgccaccgccgtagccgccaccgtcatcacggtgcccgccaccgccgtagccgtcgtcttcacggtcaccaccgtacccacc

SEQ ID NO: 22622 - DNA, 291 bp, Zea mays
  Clone ID: cC-zmle1890011h10d1
caccgtacgtggagacgcacgtacaccagcacgaccttctgagttttcggccagaaggtcgatgacgacgtgaagacggagaccccgccgtatgcattgggggaggagaagaaaggcctgctggacaagatcaaggagaaacgttccctgtggctccaacaagaagcctgaagccgctgtcgaaccgggtccgtccgttcacgcgccggcgccagcgctgcacgctgagaacgtgagcagcccggatggcaaggagaagaagggtttgctgggcaagatgatggacaagat

SEQ ID NO: 22623 - DNA, 416 bp, Zea mays
  Clone ID: cC-zmle1890011h11a1
gaggggaactaacagcttttatgggaaaaaactgtcttatctagacttatttatagaaaaaaaagaacggggcttctcttctctaggataagataaatttagacaaacacaaacccctagctaattaatttattctaggggtaacttttatcattagcctctgcactactgtagcacagcagacaaatcagcagagttaccgactaacgacaaactggcagtaataatgaactgaataatctagagcttttcctcctcatggctcatattgctggtcctcttcatcctctccggctccgctagccttcttggcctcttccagcgccttcaccaagtccgcgaggcacgagtccggcccgtcgtcgaggctcttgggcgtgaggttctcggcgacgtcggccggcgtcatgtccacc

SEQ ID NO: 22624 - DNA, 524 bp, Zea mays
  Clone ID: cC-zmle1890011h12a1
ttttgaacttggggccctgtgtatggccaaaaaaactgcataataataataataagatccactttgtaattgacgcaattatttaagcaaaaatacatatatcagaatttcctcatttagtcgacttcttcgatcttgggtccagcaccgctgccaccagccggcgaagcattctgatccatgccaccggccatgtcaggaccagcggcgccctgatacatcttcgcgatgatggggttgcagatgccctccagctccttgatcttgtcctcaaactcatcaacctcggcgagctggttgttgtcgagccaattgatggccccctcgacggcgtcatcgatctttttcttgtcgtcctccggtagcttggaggcgatcttgtcgtctctgatggtgttgcgcatattgtaggcgtagttctcgagcgtgttcttggcgttcaccttcttctggtgttcctcgtcctcggccttgtacttctctgcctgctgcaccatcttctggatctcctccttacttagccg

SEQ ID NO: 22625 - DNA, 331 bp, Zea mays
  Clone ID: cC-zmle1890011h12d1
tgaacaccttgagctgacgcggtgcctcatgggcgcttttattttcaaacacacttgtggttacataataggcgagggctttttctaccggctagtgtaccacattagatcaggattatatgaggaagaactagaaggacattactggcaacccctaggtgcctccggtcggctgatgaccgcttgctacaggcctaagaggacgctctcattcaacgtccaatccaccatcgacatcgactcgctctatgagggctttgacttctacacgaccaataaccctgcccggatcgaggagtttaacatggacctcttccccaagtgcatggag

SEQ ID NO: 22626 - DNA, 397 bp, Zea mays
  Clone ID: cC-zmle1890012a01a1
atgaagagatgataaacaggtgttcttgttttatacagtgtgtatatatagagagagacaaagagcaagtgaatttgtaggaacaacgcccacggagaacgaacgcaagcctattttctcatcacaaggaacggaggcatacataggtctcatgtgtgagcactgagcaccgctggttccggatcatcctcatgccttccaccatgggtccttgccggtcctgaagtcggtctccacccacgggacgaagaggaccttgccgttgtcgacgtcggcgtgaaccagggccagcgacagaggcgccgggccacggaccaccttgccctggttgttgtactgggatccgtggcaggggcagatgaacttgttttcacccacgcgtccgcccacgcgttcg

SEQ ID NO: 22627 - DNA, 444 bp, Zea mays
  Clone ID: cC-zmle1890012a01d1
ggaaggacccacgcgttcgtccacgcgttcgaagtctatggaccaatcctgtgtgttttttattttagcactgaagatgaagccattgtggttggcaacgatacacagtatggtttggttggtgctgtaatttctggtgatcgggagcgctggcaaatgttattttaggagattgacgctggatgcatttgggtaaaccgttcgcaaccctgcattatgtcaagctccttggggcgggaacaagcgcagtggatttggacgtgagcttggagaagggggcattgataactacctgagcgataaagcaagtcacggtgtacatttattgatgagcccgtggtggatggacctatcccccttcaagcttgtatctggcaagacgaaaaattgtctgttcgggagaataaatatattctgatgctatacagaacgaacccgtgtatt

SEQ ID NO: 22628 - DNA, 395 bp, Zea mays
  Clone ID: cC-zmle1890012a02a1
attctttttttttttttttttttttttttttttttttttttttgggttggtgtttttatttacccatatattcccctcatttggcccaacacaggaacacacaaaccggggcaccgaccagcccggggacacgggcgcacggagccagccctccaacccccccccctcaaggggccaccaaacgcccaccaacggaccgccccgccccccccgagcccaccggcccgcgcccggggaggccggggcgggagacccgccgccagccaaggccaagcccccccccaccccccccctcccacgacaaagggggccccccgggcgaaaaccccaaccgcccagggcccccgggccacggaccaccaatagcggggggaggggagcgccccccacgggga

SEQ ID NO: 22629 - DNA, 491 bp, Zea mays
  Clone ID: cC-zmle1890012a03a1
tttttggggttaccaatatgatattttccagttgcaactatgcccagtatgcagtacatcacaactgagaaactagccagtgacaacatttggaagtagtcaactcaagagcagctatgcagaacctatattttcaatagtgaaatgtcaagcagcgctttccataaactatatacctctcctgattcactcagaactgtactcacatttacagtcaacacaagacgagacaagattctagggaatgcctagcaagtataccctgaatgacaaagaacaactgattggctcaggagaacaatagaattggtcatggaatatgtcatcgccttgagcttcacaaattgaaggggtcagtaacagaaagatcggatgctctctcaaagtaccaggcgctgtcaccctcacgggcaactgccaacagagtagggaaatcgctggcttcgttcaccgtggtcagagacttcaacttggcaagcatctcatccact

SEQ ID NO: 22630 - DNA, 484 bp, Zea mays
  Clone ID: cC-zmle1890012a03d1
tggagtgaacacccgtccggtcggtcatttaccagaccgagaagctactgatggaactagggtttaaggtttcaggtgacgtcaaggggaaaggcgagtcgaagctgcatgagctcaaggatgctgttgctggcggcttcacgcagacgatgaaggacgccctgagtgcgttgaacctggatgtcatgcagatcgggcaggccctttacagccagtagggtgccccaggcgcaggacctggtgcagctgatgctatttcagctggttcagcggtcacttctgaaaagccaggtgacggacgcgatgtgattgacgcagattttactgacagtcaatgagggggcatgctaggtattacatggaggccgatttgtcccgagggagataatatgttgccacaagattgtctaggatggggatgttctactttttggccgattggcaccctaattgtggaaggaatatacaaaggtccttttctttc

SEQ ID NO: 22631 - DNA, 369 bp, Zea mays
  Clone ID: cC-zmle1890012a04a1
gagagccacgcatcgccattttaatggtggggtgaaagccaaagaggacagattatcgaaatgggttatataccccatttttaacagggtttctacaagacccagagatgatgcgtgacaattgtgacggatcgaacggcggttgcagtacaaagcaagctacttgagcatgcatatggcaaagctttggtgacaacttgccgtgcggtcccggctgtcgcgagtggtgaggtgcgttcttgatcggaatgaggaccggtgactccaaggcgctcacgtttgccttaagtgagccgtcttccagcttggggaacttgaggagataacctttcttggtgaacagaggcgcgaacgtctcaaataacttgc

SEQ ID NO: 22632 - DNA, 423 bp, Zea mays
  Clone ID: cC-zmle1890012a04d1
ggatggatccacccatccgaagaccccagctaccatgtcagattatttgcaattcttcaatttctggtgccaaattcccttgctataaatgcggcgagactttctatagcgagatggctctcgcaggctcactccacggcgagacacggtgccaaaatgagtttcaagttcaaactgggttccatgaggaaaagccatggcggccacgtgagtttgcagtcctattccaattcctggaaggggacgcagggaaaaaccaggctagtctgggaagaattgttcgggcttgtacggctcttccttatttcgtttaggcgactcgcggcctttcggatttggtacaaaacaaggctgtcaggggacaacattgccttaaaaaatttcggaaaaaggtctaaaaaagaaaaaaaggggggccctttt

SEQ ID NO: 22633 - DNA, 410 bp, Zea mays
  Clone ID: cC-zmle1890012a06a1
aactagaaagagaataatccattattattaaatatcttttggggcgataaatagacagacacgtataaaacgagtaaacgacactacagacgttttggtgtacagaagggacaattacatattcatcgatcagtatgaacgacaattgaccactagcaactgtgtgttgggtgtgggtgcaaattctgttggctcgattgttcacgcactctccgccgtctgcttcatttcctgaggccgatgagcgcgaggaagagcgagacgtattccaagcggtagacgcgcctgagcattccgatcttggtcttgtcccacggcgggttgcggaacatgaactcgacgaggaagctccttttgagcaccgtcttcttgtgggtgaacatgtgaaaacgagtacttgccgtggtact

SEQ ID NO: 22634 - DNA, 493 bp, Zea mays
  Clone ID: cC-zmle1890012a06d1
aggtcgacccacccgttcgcggacgcgtggtatctcattcccgacccccgcaccgtagcgtattccctagtccccggcggcgacctggttggctccgctgcgctctgactggtgcgcgtttagacgaggagctgcggcggtcaagaccaatcgaccatggttacccgtatccagtttgagaacaactgtgaaattggtgttttctacaagctgacaaatgccttactgtctggttgcgattggagggtcagagaacttctacagagcctttgaggctgagcttgcagatgccattcctgtgggcaagacctctattggtggcactagaataataggccgtctttgtgttggaaacaagaatgggactttctattgccacatactacaaccgaccaagagcttcagcatttgaggaattgcttgcctgatcaagtgggggtcagcgcattgatgagaggatatctgccctttgcaattgcatagcctgcaatga

SEQ ID NO: 22635 - DNA, 472 bp, Zea mays
  Clone ID: cC-zmle1890012a08d1
ggccagtgtcattgactcgctaaggtcagtactctcttgtccagtgtacccaataggcccctgcgttccatacatgatgcttgaagaccataccgtgtccagtggcaaagttgccaggcaaggagattatttcacatggttggattctcaacctgtgaactcagttttgtatgtctcccttggcagttttgtttcagtctcagcctctcaacttgaagagatcgcattgggcctaatagccagtgaggtcaggttcttgtggattcttcgagaacaatcccctcgggtgcaagaactcttctctggcatcaataatgggatgatactgccatggtgtgagcagcttgaggtgttgtgccatcattcagttgggggcttcatgacccattgcgggatgaactcgacacttgaaggcgtcttcgctggtgtgcctatgcttgccttacactgttttttgatcaaccgattgatg

SEQ ID NO: 22636 - DNA, 421 bp, Zea mays
  Clone ID: cC-zmle1890012b01a1
ggaaaacaaacagtagcacgagcttcaacgcagaagtctacaattcaaaaaccacggataaaccacgaacatatcagagggttatgttgggctactgataattcgactatagcttgcaatacattttttagcaaaggcaaactctgacccacatttggtggccccccagttacacgtaactgtctatcaaagacttcctcatgtcctccacaatcgcagggggctgcccttttttcagcttgaagaccctttcgatgactgaaagctcgggggctgtcgtgtccgagccacaaaaggcaggccagtcgttcactggcatgcctgcagcaatgacctcgcttcctctgttcacagttcctgcgacaagaggaacttggaggagcgtggagagctcgtcaaggtcttcaacggatgtatgggg

SEQ ID NO: 22637 - DNA, 427 bp, Zea mays
  Clone ID: cC-zmle1890012b02a1
gggccatattttttattctcttttttttttttttataacaattttaaatcataattatttataccgtctcttattccccaaaaaacaagccccccccccccaaagggcacaccccccaaacccccccccctcaaatacaaaccccccaccccccaaaaaattaggggccctccccccttcccccttggcccccccaccaaaccccaagaggtccccccccccggaaaaaaaaaaacaaaaacccccccccccaaaagaaaatgggggtgttgccaaaaaaaaaagcgggccacccccccacaaaaaaaaaatatgccccggggggggggggaaccaaaaaaacgggggccaaaaaaaaaaaaaaaaacccttgttatgtccaaaacccccctgcccccccccccatgaaccccaattttcccccccc

SEQ ID NO: 22638 - DNA, 400 bp, Zea mays
  Clone ID: cC-zmle1890012b03a1
ggattatccccccaatcgaatcaatcaaccaataatcgcttttgggggtacaacacattcttctcccgatgcataccacctaactaggaaaaagaacagggaaagaatttccccccacccccctgtagtctgcccaacggatgaaaaaaatattttcgaagccaaaaacaaaaaaagaaattttactcgtcctacctaagctacgtatgtttgctcaccgggtttttgataagcggggcccacatgacagcgatgatgaccggtcacaggcaaattgagccccaaagccccagccccacggtttttgggacggggacggtgacggcaaaaaaaaagttggcataaaaggcggcggcccttcttgtctgtgtgttgccgccaaaaaaaaccatgggggggc

SEQ ID NO: 22639 - DNA, 355 bp, Zea mays
  Clone ID: cC-zmle1890012b03d1
ttgatcacgcgtccgcccacgcgtccgtgccacatcggtgaagtggtgtcgtggtgactatggcgcttggcctcctcgctgccgccgccgagctggccgctgaggcggtattcctcgcgggccacgtagcgctcaactgccccgtgcaaacggtgccgtagcattgtccgccgaccactctgacgaccaacaacctactacagaggctggagaagctcggagaaggggcgctggacgcgcctgaggacgtgtacgtggacgcggttgtgggcggtgcgctgtacacggacactagggacggatggctgcaacggatgatgcaccccaacaacggctcctgggaacggtggcgctt

SEQ ID NO: 22640 - DNA, 311 bp, Zea mays
  Clone ID: cC-zmle1890012b04a1
ttttggttttttacatatacttgtttacatatgtgtttgcaaaaaataatgagtttttaattaaatttctgaatacctttttttgcatccagacatgcatgtatgaccgccctaaaaaggaggacataggggccaacgaccatcgcattcttacattttttacaacatagtgcaagcacaccatgcataaaaaaaagaaccctgtattataaaaggctccacccaaaacaggccacccctttttccgcccacaccaagggggaaaggtgcatatcggccgttaaacttaacaaaggatgcttgtccaaaaa

SEQ ID NO: 22641 - DNA, 360 bp, Zea mays
  Clone ID: cC-zmle1890012b04d1
cgcgttcgtgattcttgaatagatcgagcttcttttgcaccacaaggtcgaggatgtcttgcaactgcggatcaagctgcgggtgcggctcaagctgcaagtgcggcaagaagtaccctgacctggaggagacgagcaccgccgcgcaggccaccgttgtcctcggcgtggccccggagaagaaggccgcgcccgagttcgtagaggccgcggtggagtccggtgaggccgtccacggctgcagctgcggtggcaactgcaagtgcgacccctgcaactgctgatcacattgatcgacgaccatggatatgattattatctatctagcttgtggggggggttgaacaataaataagcgag

SEQ ID NO: 22642 - DNA, 365 bp, Zea mays
  Clone ID: cC-zmle1890012b06a1
gtgaacctcaaaagcatggatctggattaaaaaaccaaccgaccgacccaaaaaagggggaacttttctgaactaaataatggcgttcgtataccgattaccgagtagcaagctcatttatttatgaccctagtttttagtatagtaaacatgttcacgcccgaacaaccatggcccggactttacagatgggacaaacaacaacgtaccgtacgttcgtacgtgttgctaccccgtcacttctttctgggcttggaccggcggagtgcctgtgccctgcggccagtaccgccagagcccccccggaaaacggcgctaaaggcgcaaccggacaccctttgtgaggggggatccatgttcggggc

SEQ ID NO: 22643 - DNA, 571 bp, Zea mays
  Clone ID: cC-zmle1890012b06d1
cccacgcgtccggcatcatccgtctcgtctcgtctcgtctcgcctctcctctccttttcccccctccctgcacagcgccgctcaccgtcaccgtaccacagcagcgatcgatggctgaggtacacaacgagcggcccgtgatggtgggcgacgtccgggacgcgccggtgggccgcgagaacgacctcgaggccatcgagctcgcgcgcttcgcggtcgccgagcacaacagcaagaccaacgcgatgctggaattcgagaggctggtgaaggtgaggcaccaggtcgtggccgggaccctgcaccacttcaccgtcgaggtgaaggaggccggcggcggcgaaaagaagctgtacgaggccaaggtgtgggagaaggcgtgggagaacttcaagcagctgcagagcttttagctcgtctgagacgccccggtcggctgagcgcacaggcttttcgctggaagctgggagacaacaatgaaagaatttaactgtcatcccactggaaaagtatgatataatgaataaaccagcgtcttaccacatgtattgtaccctaatgagaaatttga

SEQ ID NO: 22644 - DNA, 403 bp, Zea mays
  Clone ID: cC-zmle1890012c01a1
aaaagcaagaagactttcagattccttagcacatctcattctattacaggggtcaaatatctcattagggtacaatacatgtggtaagacgctggtttattcattatatcatacttttccagggggatgacagttaaattctttcattggtgtactccagcctccagcgaaaagcctgtgcgcctcaggcgaccggggggtctccgacgagctcgaagctctgcagctgcttgaagttttcccacgccttctcccacaccttggcctcgtacagctttttttcgccgccgccggcctccttcaccttgacggtgaagtggtgcagggtcccggccacgacctggtgcctcaccttcaccagcctcttgaattccagcattgcgttggtcttgctgttgtgctc

SEQ ID NO: 22645 - DNA, 469 bp, Zea mays
  Clone ID: cC-zmle1890012c02a1
ttttacatttattccatctttattgatagtattaattcaaaagtattaatacataacgcgctatcattttatattgttcctaatggatgtgatatagttctgttattggatgataaagctgtagtagtaatatcctttgtcccggatgacttctttctttgagtattgtctctgtattttggtacacattcctcaaatccggatatataagaagcatacggcgacggcgacggcggcggcgctctcgcgtacatttattcggcggcagacaaagtaggacagcatgcaagaagcagccacacgaacgcgcagccggtccgacgagcttgcacgaagctaataggcacacagcagcagcttgcgtcgccacgaagaccatcaggcaggggcggcgtcacggacctcgaagacgtttcgggtcttgacgacgacgtcgtacatgtggaccaccttgaggcgggagaagtca

SEQ ID NO: 22646 - DNA, 416 bp, Zea mays
  Clone ID: cC-zmle1890012c03a1
gaaatagaggaaatataatttaatatgtatactatgtgcaccaaaagattcatggacacttataccataagccccttgcaaaaaaataaaagtaaccgaaaacaaaaacatgtatcttttttatataaagtttgcagtcattcgctgtgaaattttaactgtccgtccaaaataaccccagcagagtggggaaccaacagctggaatgtcggagcagatcatgtatcataatcccggactcttaaatagccttgaggatgtcgaccgccgcctggtactcggcgagggtgaggatatttggggagtccatggagacaacgttctctgccagaaacccgtcttggtggcggaacaattcctcgctgccggggcaaactaactccggcaggaccagcgttctgtgcaggccaaggagc

SEQ ID NO: 22647 - DNA, 232 bp, Zea mays
  Clone ID: cC-zmle1890012c03d1
acccgtccggccaattctcagtatcttacaaccccatagcaccaacacctttttagattattaatctcacgaggagacctttgggggttggggtaattccctggccatttaacttcaaggaatgatagctcaccacttttccttgctcaacttgggcctttacctgttagataaagacttcaccctcctgttgccggatcatcttacaaatcaacaccttttttggtctgga

SEQ ID NO: 22648 - DNA, 478 bp, Zea mays
  Clone ID: cC-zmle1890012c05a1
tttttgatgccaacaggtcgtgcttatattagggccgtgctgaggacggtccgtttatacatacgatacattatgttttaataagaaatcccaggctggaccataacgatcaatgcgtattttgttccataaataaactgtcatacacacgtatgacttgagtacttgggaaccccaactgacaatctacctacacagccggggagacgtacaagtaggggtccgggcaacttctttctttcatgattctctattcacaaacagagtttacgttctgtataacccatcgccaagctcagggtaaacatgcattattgatgccaaacagaccatgtaacattccgtaagggccttatgcgacaatagggtatgatgcacacgtagcaacaccgcacatgtgcttgctcattttcatcttgaagtaaccatcattaccccagacaggggcccatgaattcttgatgagccagtaggggac

SEQ ID NO: 22649 - DNA, 531 bp, Zea mays
  Clone ID: cC-zmle1890012c05d1
tgggtcgacccactgcgtccgagaaccttatgtacaaaaggtatcaacaagatcagtagagtttttctagttatcaagggatgctgtgacacctcatgctgtcaaagttaaagtgtttgttcattcctactaccagaaagccaagaagttttttaagccttacattgatcaaattgctgagattactaaaccacatgttgagaaaattagaacttactctgaagccatacactaagagagcagttcatgcatatgggtcatttctcaagccggcaaccacataccatcgacaggctcaagtcagcatcatggactaccttcaccagcatgatataacaaaatcattggcaactaacgagttagtttggtttctggcttatgctttgcctggctctgcctgtcttaattatatacaggcttctaatagggaccttctgctccaaaaagaataaaaggcctcgcaataataatggtaaccatggacacaagagatacaagcggcgacatgctgacatgttgatctagttactg

SEQ ID NO: 22650 - DNA, 99 bp, Zea mays
  Clone ID: cC-zmle1890012c07d1
aattgttggttcgacccacccgtccgactagtattagatcgagccaccgactacaaagtgcatgatgattttttaaaaaaataaagcaaattaacgtaa

SEQ ID NO: 22651 - DNA, 478 bp, Zea mays
  unsure at all n locations
  Clone ID: cC-zmle1890012d01a1
ttttagttaacttatgttagatacacccagaaatgacagttttacgatacaaagattttatagtaacaggtatcttgcaacattaaaactattgaaccaaaatgtgtttgttttgcaggtttcagcaacaaacaccacgttaaccgaaaggattacagtagcgtaccagatgcatcgtcagattcctttgagactgcatgagagggcagctggagtctgaaattaggcggaagcgaatgccctggtgggaaagaaccatccatctgtgccgttggctgctgaaagaacgctggtcgcatgggttgctgcatcggtgagaatccagcacttggacttgggccactaggcatataccccatgtattggtagggtggtactgaatgagaggctggaccatacatctgagggtagtaatgttgtagcacctgttggtatgaataatcaggtgggtaccagtactncgcgtactggggactgt

SEQ ID NO: 22652 - DNA, 423 bp, Zea mays
  Clone ID: cC-zmle1890012d02a1
aaaccaaagcgcgttggggccgggcggcatagattttatattgaagcgcaaaagtagcatcatacattacattcgacgaaatcggaaccctatacagcaaaggttcgattgcggcgagcacgcacgcaacgcaacgcagcgcagcaccagggatgatggataggatcttaaccgcttcacttctcgaagtagtcctcggtcctgcccttgaatccgatctggccgaaggtgagcacgatgaacaggcccaggtgccacgtcactagccacagccagaactgggaggtgacgggcgggggcgtggggaagtgggccagctcctggccgatgctggagaagaagagccccgtgaggctgttgccgttgatggccgggacgctggacggccccatccagccgatgagcccgaagccgatgacgctc

SEQ ID NO: 22653 - DNA, 151 bp, Zea mays
  Clone ID: cC-zmle1890012d02d1
aattgtcggatcgacccatgcgtccgcggacgcgatgtcaaccagcaaaaatatgcattaatcacttctattatcttaatcacgctctcctgcacagggcagtacaatttattttgcccacctcattcattcatcgctagagtacacaccc

SEQ ID NO: 22654 - DNA, 426 bp, Zea mays
  Clone ID: cC-zmle1890012d03a1
gggcgcaagctaacttaagggttccatatcattcccgacaaaatatccagagcacacccattcttgatgaagtttgaaactggtccacaggaaacattttacttattttggctttgacaacactcaaaacaaattgctggtccaacatgaaaccaaaaactaacatgtcatccaccaaaagggacttaagcaggggacgccttttttagcttggagagctcttgcctgatagcaccaccccttttgatccttgccagcatgaccttgaacctgtcaaagtcactgagggcagcccttcttttttggacaatcagctttttgccccatgagctggtcttccacttagtctttacattagcttcctccatagccttgatcaagggtgacttcttggggacacgtttgatgtcaatcttgatgtcggta

SEQ ID NO: 22655 - DNA, 523 bp, Zea mays
  Clone ID: cC-zmle1890012d03d1
ggcgaggtcctcgagtccaagatcatcctcgatcgggagacgcataggtcctgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgatggcagtggcggctacggaggtggcggcggctacggtggcggcggcggctaccgtggtggtggcggcggctactgcggaggcaaccgtggcggcggttacggcaactccgacgggaactggaggaactgagcggtggggcccgcgccgccaaattatcctgttcgctaccgggaagtttaccctagtccaaaaggtttatctttgttcgtgtcgtgtttgtagcagcccatctgtgtttttgattgcaaggtcgctctgtggcacgtgttaatgctgg

SEQ ID NO: 22656 - DNA, 263 bp, Zea mays
  Clone ID: cC-zmle1890012d05a1
tttttatttaacaaaccatcccaaattcgtgaggggatggtgcaaaagttgtggctgaaatgccaacaatggtgctcaagccgtgaatgctgagcatgactcaggcgacgtccaaattttgttcgggtagatgcaagatttaccgctccatgacaggcttgttgtaaaccatcctactgcgtggagatcacagcgtcgatcaggtcatctacaacgctactgagagcaaactcggtgtggtgccactagtccagcactttcac

SEQ ID NO: 22657 - DNA, 610 bp, Zea mays
  Clone ID: cC-zmle1890012d05d1
gaattctcgggtcgacccacgcgtgcgcccacgcgtccgggcaacttcgccatgatgcccgacgcccactttttggtcgtcggggccatgacgcacagctgggtccggacgctggagtgccagccgcgcggggtcacctacggccacctgctcagctccatgagggccatcatgaagaaccgcggcgggggctgcgatctgcagggggccatcggcgcacccatccgcaccgtcgccaactttagcggcgtgcaggagcctaacctgtcctcttcggagacgtttgacatttaccgcatgcagttcgtcctgtagacaccacgccacaccagtgtttgccccgccggccgcttgtaatgaattgcccgtgtagtatcagaataatcaattatctatcggccatgatatgatatgatatatcaagaaagaaggaactaatacctagaggacttcgttcatctgtattagcagggaacctttcaagaaataactaagcatgttcaatggtctttttttattagagagagacaggggagaaacccggaatttgtgagacgtgtgccattgtgcttgccgtttacgtgatcaataaggtccatggaattttttt

SEQ ID NO: 22658 - DNA, 389 bp, Zea mays
  Clone ID: cC-zmle1890012d07a1
cttaacaaaaagcatttataggtttaaaatttgagtgctctgacatgttagcgtacaaatgaatgatttgtgtaccttgagtacagattttagtactatacacaggtgaaaaaaatttagatccaagtgaacaacaaggaaatactttgttacggccttacggatccgattttcaattacacaaataaaaatttaagtacaggttgaaaagaatgaccagtgagatcaactattggccaaaacgggtggcatcatagaacccaatatttcttatattttttgggaaattatttttgcttgaacttttttagctgtggttgttgcacatccaacaaggataagcactgaagtcccaactatatcacggaatgctgttaagtgacttgttt

SEQ ID NO: 22659 - DNA, 513 bp, Zea mays
  Clone ID: cC-zmle1890012d07d1
cacagcaatccacacaagcactttgacgttgcacgggcgctgttacatacacaccaagcgtcggcaccaatggggtactaccagtaggtggactactgctcggaggaggtgaggtcggtggccccggccggcttttgccgtcacggaggcggtgttcagcagcacgttgttaaggagaagttcgtggaggtcgacacggtctcacgcgccggtgccaaccaccaccacctccaccatggtcaccacggcggacacgggttcgtggtgcgcgagaccagggttcaggaggacattaatcacctgcccggtgaggttcacgagcgcagggagagctttctcgccagggttaactgagcccgccggcggacggcatccacgcccgttcgtgcctgcctgcgtgccttaatgtatgtctgtggttgactggttgtgcaaggttcattgtacttggctattcgacgtgcacgctctcagcttctgttcgaattactacaattagcttgggacctgaat

SEQ ID NO: 22660 - DNA, 241 bp, Zea mays
  Clone ID: cC-zmle1890012e01a1
gtggggctgttaatttcaaatcttgacccgggggcgaaccaacacccccccttgggagaccaacttgagctaaaccgagaaattctaaaaggtgcccccggggggaaaatagtttcctcttggggggacaaattaacactggaccaaaaccgaaaaaaaaaaagctccggggggaaaaagggaaaagctaacaaaaacaaaaaaaaatggggccccagacaaaaatggggaaaccaagggg

SEQ ID NO: 22661 - DNA, 450 bp, Zea mays
  Clone ID: cC-zmle1890012e02a1
attaaacaccaaaattcattgatcaaatgttatttttccttacaaaaaccagacccaaacacccttgtccttcaaaggctgctcaagtcttcaggatcaaaatggtaagtacaatccattttgctataagtacaattcaaaggctgctgtaaatttgaaacttcaagctaattcgcagctatcttgaaacgaagacattttgctataagtacaatccaaatggagctcggacaaaataacaacgtattgaacaaatcgtacatcaatcgcatcatcaccctttccgaaagttgcacaaattctaaagagttgagctgcgcaagggttgattgtagaattgatatttgaagcatgatggttacaggttacaccaccactacagtggttttagcacataccaaatacaattccaattattttggagtgcataccgtcttcatcaatgaactc

SEQ ID NO: 22662 - DNA, 406 bp, Zea mays
  Clone ID: cC-zmle1890012e03a1
aataagggggggggtttttgtttaattggtggagtaattcatatgatttggggaccaattaattttatgggcaacaggagaaacaaggggctcaaccaacctgcagggaggaacaccttccaacaggaccacaaagactgacgccaaacaagcaaaaaggggtagaaaaccgaaaaacctgggttatctttttctcaaaacacaacaaaatacctatggggggaagccaggggggcccaggtaataattgtaccaccaccaccacccgatataaaaataaaaaccatctccgggggcggcgaccgaagggagcagtagatgcaggggccgcacctaactgtcaccaccaaaaaaggttacgggggcggacatggaggacttcgccgagccctaaacaagagggggg

SEQ ID NO: 22663 - DNA, 726 bp, Zea mays
  unsure at all n locations
  Clone ID: cC-zmle1890012e03d1
tccggacttnttgggtcgacccacgcgttcgcggacgcgtggtcggacgcgtgggctttaaacagaagcagcttttggtttattggacaaccccactaatccacaagaagctgagaggtgatgcgtgggctggttatctctttttttttctgtattttttatcattatttttttttttcttttttctttttttttttttcttattttcacttttttttttatcatttttttttttcttatatattttatatattttattttttttttttcttcttattttttttcttttttttatttttttcttcttttttattttatttcctttttcatattgttattttattttcttttgtcttttgttcatgcctctactatttttcttttatattttttcttctctttacttctttatttttcttttctatatcccttttcttttgtctctatttattttttattaaattctctcattttttctcttccttctacttttttatactcatattctttgtactttctacatccaatctccaattttttatctttcttctctgtctttatattctttttttcttatatttcttttttactcccttttattttctttcttattcttattctattctttcttttcacagtttcttcatttttttttctcttcttcaattactctttctcacatcttttcatatttaactttctttttgtctcctcctatcccttatt

SEQ ID NO: 22664 - DNA, 367 bp, Zea mays
  Clone ID: cC-zmle1890012e04a1
gggcagaaaccaaagcaatttttaacgcatccaggtagcccagccgaattacaacacgcagctgctcattattgaacaaacccaagttcacaacattcagaccgaccgtgacttttgacttgggaccaaaataaagcccggacgtaccacgttctacacaagcaggaacactcactggcagagtcacgcgatccaccttaatggagcacacgggccttggccaggcgagccaccttgaaacaaacttttggtaaaagcaaaccagaacccaacacacatgccaacgctagctagcttctaatcgccgcccacggccaggacacgctgcgactgggaccttaattagaggagctggtcctgtgctcgc

SEQ ID NO: 22665 - DNA, 417 bp, Zea mays
  Clone ID: cC-zmle1890012e04d1
gtccggacgacctcgacatgttcaagggcggcagggactactacgcgtttgtcggttaggcgtggaagcgcgggtacctggtgtacgggccccccgggacggggaagtcggccatgatcgccgacatggccaactacctagactacgacatctacgacatcgagctcacgttcgtgcactccaacaccgaccttcgtaagctcttgatcgagaccaccagcaagccatcatcgtcattgaggacatcgactgctccctcgaccttaccggcgcgcgcgagaagaagaaggtggaggaggaggacggctactaggacataaaggacggtggtggctccaataagcccggtgagaagaaggacaccagcatcaaggtgacttttgtgggcctgttcaacttcatcgactggctgtggtc

SEQ ID NO: 22666 - DNA, 483 bp, Zea mays
  Clone ID: cC-zmle1890012e05a1
gagagaaaatctggacccgttcatgagtgttcttcaacaactcgtgcaatttaagagggataaacacgtacagagaaaaactttgaaccacctgatctaatcctacgacagactttccacgcttatagacggactatacgcatgcatacagggctacaaataatgctcaacatccgcaacattaaacattgcaacaaggccttcacattatatagtattcccccaattacgatcctacaaacacaaactggccattcgaaccagccgattcaaaaaagagggtaagctattaacggtgcaatctgcacaagtccattacattagaatatcagatcacttcccgccggccgccagtggggcgccgacgccctttccacggagcttgacctctagggcgcgcttcattttggaaagcacggcctgggccggcgccgccttgccgttcttgtacttctgcaccacctgcgcgcgctcgttgatgcg

SEQ ID NO: 22667 - DNA, 166 bp, Zea mays
  Clone ID: cC-zmle1890012e05d1
cgcacaaaacgttgctacgacggacctcgggctaaccaaaagtctcaataatacactgctgtgccgagtagtgttttaaaacccagaaactcgcgaatctatgggggatagatatcgagttatacatcaagagtgacgagcagtaacaacatgaaacaagtattac

SEQ ID NO: 22668 - DNA, 371 bp, Zea mays
  Clone ID: cC-zmle1890012e06d1
cggaccgcgcagccgagagggagaggaggaggaggaggtgccttccgcgagccgcacgggccggatcagccgccgcaggggtcgccttacagctacaggttgccgtcgcagatgaccccgcctcaggccgccgcggtgttctacagtccccagtacggcgggtactggtacccacctgattattcataccaacaggtgctacaacattactaccctcagatgtatggaccagcctctcattcagtaccaccctaccaaatacatggggtatatgcctagtggcccaagtccacatgctggaatttcaccgatgcagcaacccatgcgaccagcgttttttcacaagccacgggacagatggatggtttttt

SEQ ID NO: 22669 - DNA, 429 bp, Zea mays
  Clone ID: cC-zmle1890012f01a1
gggaaaacaaccccccaaataccaggcattttttcccggagaaggactcccacgggacgggacaaaaaaaacacagggggggcatgtcaatgggccggggggggggctttaaacaccacccacttttggggggcaaattaataatacccccccccttaataaagcttccccaggggaattcgatcgattcattattgaacaacaggggaattaaaaaaaaaccctggggggggcaatccccctttttggttgccgcactaagggggccacaacctcgggggccttggacccaaaaataaaatcctcgcgcaacgggggggaaatgggcccctccacggggttgggcctgcccagggccttgagcgccaggggcccccccttttgggcggaagatattaaggggccaaaaggggggcccatcctgggggg

SEQ ID NO: 22670 - DNA, 556 bp, Zea mays
  Clone ID: cC-zmle1890012f01d1
gacccacccgtacgctcacgcttacgggcaacattgccatgatgcccgacgcccacgtttcggttcgtggggccatgactcacagctggggccggactctggagtgccagccgtgcggggtcacctacggtcacctgctcagctccatgagggccatcatgaagaacccgtggtgggggctgtgatcagcagggggccatcggtgcacccatgctcaccgtcgtcaacttaagcggcgtgcaggagcctaactctgtcctctttggagacgtttgacatttactcgatgcagtttgttctgtatacaccacgccacaccagtgtttgccccgccggccgtttgctatgaattgccgtcgtagtatcagaataattaattattctatcggccatgatatgatatgtattatcacgaaagaaggaacttgttcctagaggacttcgttcatgtgtatttagcagtgaacctttcaatgaaaatactaagcttgctcattggcctctttttattaagagagacagggagaaaaccctgttaatgtggagactgcgcaat

SEQ ID NO: 22671 - DNA, 163 bp, Zea mays
  Clone ID: cC-zmle1890012f02a1
gggttggggtattttttttttttatatggtggggcctatcggttttcgacagaaagatgcgcggagacccccgcatgcacggactaaaccagagaaggggagcgagagggcacaaagaaagcacaatgggcggggcggagccagaggaaaaaagcagggcccg

SEQ ID NO: 22672 - DNA, 134 bp, Zea mays
  Clone ID: cC-zmle1890012f02d1
cccacactttcgtccactcgcccggggagaggcttaggttcctttgtagagacatagacaggaagataggcaaggcgaagctacagaatccgtactactgtgtctcaccccagagttggatgaatgtggtgata

SEQ ID NO: 22673 - DNA, 442 bp, Zea mays
  Clone ID: cC-zmle1890012f03a1
acaataatcccaggtttgaacttgaatcccaccagaaacacggagcatccacagaatacacaccagccctagtctaatccaatcgacatcgacaaaataccagtagtcttataacagagagagagagagagaaaaaaaaagaaaagaaaagagggcgataacgcaggacaaagctagaatagcacggcccagttccagctcttccgtaagctggttgcttcacttgcagccgtgttgaacccggcacggatggttccgtcagaagcaggcgtccaggaggcagcagcagcagagggcagccaagcatccttccatgaaggaaggcccgctgctctgctgctgctgtggaggcggctgcgcgtactgcggcgggtagccctgctgcgggtaaccctgctgcgggtagccctgcggcgggtagccctgcgccggcggggggtag

SEQ ID NO: 22674 - DNA, 322 bp, Zea mays
  Clone ID: cC-zmle1890012f03d1
tgggtgaccacgcatccgcacttgaggagggtgtgcggatactcggggagggcaagctgtttgtttctgttagcttccctggtaatgaacgaggcaagtgctgtctgagctccaagattccccttggagtagttttggcaatcccgccgttcaactatcctgtcaacttagcagtttctaagattggcccagcactaattgcaggcaatgctcttgtgctaaagcctacaactcagggcgctgtggttgcacttatattggacactgcttccacctggctggttttccgaaaggtttgatcatttgtgtgactgggaagggt

SEQ ID NO: 22675 - DNA, 441 bp, Zea mays
  Clone ID: cC-zmle1890012f04a1
ctaacacacaatgcagcgagagattttgatatttgccatcagcaagaaacaagtttgtaaaattgccatcaggctcacattttatagacccagctggacccacaatttatagacgcagtagttatttttacaagaagataacattatgattggcaaaaatccaattttttccaatgcagcaggctttgtctcaaacaaaaacaagagaggggatcagccgagagcttatatgcttggtaacaacaccgagtaggaatgccccactaggctctagccacaatatcaaaaggcctgagacggacgggtgggtgacagctgaatgtcaggctttaaaaatctccgcaagctgttgctggcaccaacggtattttaacaagcacaactgccaagatttttgacttgttgctgacacaactaggctagaaggggcaactggaatgt

SEQ ID NO: 22676 - DNA, 424 bp, Zea mays
  Clone ID: cC-zmle1890012f04d1
tgggtcgatccacgcgtccggggaagactatgcggtgggtatgggtccatggcaaattccaaattccacctttgtgacaccagttagggcttgtagagttggagctggaatattgctgtgtcaagtccgtgaaccgaaagaatgggaagacgatgctttggatttacctcatcaaagaataggattttgggaatattatgcgatcagatggtaccttttgatacttcttttcattggatactgtgagagaactctttcatgctgctgggctaatagagatggagctggaatattgctgtgtcaagttcgtgaaccgaatagaatgggaagactatgcggcgtgtatgggtacatggcaaatttcaaaaacccccttgggacacctgttagggctttgttcggcttcaatttaatccttatgggt

SEQ ID NO: 22677 - DNA, 349 bp, Zea mays
  Clone ID: cC-zmle1890012f05a1
aaaccccaattttgtaataaaaaaaaagccccctgaaggggcccgaagaacaagcgtcaaaaaaaagctggaaaaaacgctttcaaaaaagaaaggcataaactcttctcgaaagacacaaaaaggggggcgggaccgggggcggaaacgggggcgggaccccggggggccccccggggtcccccccgggacctggcccgggaaccatttgacctaaagaggagggaaaaaaagagtggcgaaaggaagggcaaaaaagatccccggggaaaattgtcacacgctcaaaatttccaacaaaaaagccccccaaaaattaaagggaaaaacccgggggggccaaaggggg

SEQ ID NO: 22678 - DNA, 494 bp, Zea mays
  Clone ID: cC-zmle1890012f05d1
cccacgcgttcgcggacgcgtgggcgctgaggcacgcactggttgcattgtcttgccaccttcatactctacaaggtcctcatcccagcggaagcatcatgaagctgctcctatttacgtacaaagcaacacagtttctgttccattgacggagcagcaccagcagcttcattcacttggcaatggctcatttgtacctcagccaagcaaagttagtccatgcggtgtagcatcatatacggtacaagggaatgcacaggcctacagccctgcttacggaagcccttccagcaatcctgctactattgttgctgtccttaatcaacaagcacattgcagtgctcccatggtgcttcatcacctgggaccatctcagtcagtgcagaaccatccgataggcattgctgataaggttgctcgaatgggttacccaaaggatcaagtagttgatggccttgcgctccgtttggtggatgcaggccagcctgcaaaat

SEQ ID NO: 22679 - DNA, 283 bp, Zea mays
  Clone ID: cC-zmle1890012f06a1
cttaaagaacgactcttgcagcccttcatgtccaaataacaggattttgccacacaaacatgtttcttctttttaacggggggactttcccaaatctaccgaaggttaccgggtgcgagattgaagcctgaaaaccacagggcggaaactaatttttccaaatgcttatttagggggcggctcctttttactacaggggcctttccgctttttggtccaagattcatccaacctggcccctttaaaaaccatgttaaccaattgggtttttgggcttggaaat

SEQ ID NO: 22680 - DNA, 119 bp, Zea mays
  Clone ID: cC-zmle1890012f06d1
agaatgggtggtatggacccacgcgtccgcccacgcgtccgtactgtgctgaccatatgaaaaaaaaaaaattttaataatacaaaaactataaactttctaaggggggagagaactca

SEQ ID NO: 22681 - DNA, 518 bp, Zea mays
  Clone ID: cC-zmle1890012f07d1
tgaaggttcgaggagccatttctagttgccttccggacaacaacttgaaagttcttgtaccagtgctagagaaatttgtgtcatttcatctgcagctcaacatgatgacaagggaaacgcattcagctgtgactgaagtcatcgaaagatgccggctatcatagaagtgggaagaggcgccctgtacagattagctgacctctttgcagccgaagcacacacaggtgttgctcatcacctggccagggcgtaacaaatggatgccagaggctggcctgcagtgggctttgggagctaacagtgattttattctttcttttgtccctagattcttgttctccgcatcccccgaaatcacatgtttcattgtcgtaggaatagtccgtattatgaatgtacaataacagcataggccgtagggggaatgtagttgtgctgtttaagttcctgggctgactggcttttcaggtgatgctcgcgtcacatggaatcagtgaccgcatgcctaaatctgagtt

SEQ ID NO: 22682 - DNA, 465 bp, Zea mays
  Clone ID: cC-zmle1890012g01a1
ccgggggaccaaaaaaaatttttggcccgggaacaatttttttttagggagggcaacttttacgggggggcaaaacccacccttttttggactaagggccctgctaaaggctaattttggttattttttgccggccccgggggtccacccggaatttccggcccgtgccctgggggggtcccctttttccttttaggggggtttattaaagctgggggaaaatttgggtatagttgtttccggggggaaattgtttccccttcaaaattccccacaaaatacaagccggaagcttaaaggtgaaacccgggggggccttaggggggacccaccccccttttttggggtggggctcccggccccttttacaggggggaaacctgttcggccacttgttttaataaatcgaccacccccccgggaaggggggttttttatttggccccccggggggttttttttttc

SEQ ID NO: 22683 - DNA, 360 bp, Zea mays
  Clone ID: cC-zmle1890012g03a1
aaagacaaacggggtcttttttttaaattcgggccaaaaattttgcttatccccaaaaaaattttgaaaacccgggaatcttggccattggcaacccccgacttttttttttttttggccatagagggaaaggcccccctttttttgggagccaaaaaaagcgggggaccccccccagaggggggggggacccctgggcccaacgatgggtccaacggggggcggtatgacgggggggacctttttggaaaaaaggggcgttcgcgcggacggtagccgcccccccgcccgtttgggcccctccctggggggggacccagggttcgggcgctttttccttcggggggcctataaaaaccg

SEQ ID NO: 22684 - DNA, 477 bp, Zea mays
  Clone ID: cC-zmle1890012g03d1
gtacggtgaagcggcggatagaggccaccgtaccgccgggctctccctttggagtttttcgatttgctctgcctgcaatggcgccccgtacggactgtactgtacctatacacctatatactacgacgtgcacctgtactacgacgtgctgttgtaccatactaatactagtgcgctgctgctcccttgtctacttgcttgcaccagccacttccgctttttttgatcgaacgatcgactgcttgtgttgcgtttggccacggcacggtcgttagtttgggtgtgtccactccactgtaaagctcctctcttttttttgggcactcccttcatgccaaagttatgcggacatttactatgctgttggttctgaaacacaggttgttttactaacccaccctttttaaaaggaaaaacccttcttaaattttttttgtgcgttcccaaaaaaaaaaaaaagggggggctttttttagg

SEQ ID NO: 22685 - DNA, 335 bp, Zea mays
  Clone ID: cC-zmle1890012g04a1
tttttttttttttttttttttcttttttttttggttttttttggggggtttatgttttgtttaacacaacaccccttcggtattttttgggaaaggcctattggtttcttttcgggaaggggcttcaaacatgtctagaaaaacacccatttcaaattttcctgaagggggggtgaatattactatggtggggggggggggcaacacccctattggggaggcgtcctcttaagtaggttgatcacccccccctggggagggggttctttttatctgactcaagagtttatctggggaattcggatcaatccacggccgggggccaaggtgtacat

SEQ ID NO: 22686 - DNA, 400 bp, Zea mays
  Clone ID: cC-zmle1890012g04d1
cacgcatccgcccacgcgtacgggctcgacggctagcacgtcgtctttggccatttcgtctttggcatggacgttgtcaaggccgtcgagagggtggacacccgcaacggttccacctccaaggtggtcaaggctgttgactgtggacagttttcctacatctctctgatctggtctgttcggccgccctacctacgtcatcgtcgactccccctgcgtccgtttctttggatctgaataagacggtggagatctgagtggtggtcccaggatattatgtatcgctcgcatattaattgcaccggtctagcgtgtggaatcttgtgaaccccatggcgcctctgcttgattcgagtttcacctggtatgttctgagaatcatgattatgctatgagaact

SEQ ID NO: 22687 - DNA, 488 bp, Zea mays
  Clone ID: cC-zmle1890012g05a1
ggacaaaatcccccttttataaggggcccgtcccaaaatttttgggttaaactaaacttttgccttttttcgggaaaggggcctttttcaccatgctatttaaggggatacacggggtccttctgttttccccccaaatttttttttttttcccaaacaaacaaaattttgttttgccaggttacaagttggggggggatgggtcccatccccccggcttataaaaaatgttccccgggacctggttgatgctccggtagatattaatgcccccttcttcaaggttacgtcccaaatctctgggcttggtccccccccagggagtttggattaaacaggggtgggagcatttttcccagatgccttcgaggtgcaatttcttaaataccctttgggaggggtcccgatccccaaaaattacgggcccgccaatcctattgggttttttggcaggccttgggttttttttagggctaattttaacccca

SEQ ID NO: 22688 - DNA, 453 bp, Zea mays
  Clone ID: cC-zmle1890012g05d1
gtctctacaagaagttgagcatggactgcgagaagaacgtcctcatcttcgacctcggcggcggaacctttgacgtctcgctcctcaccatcgaggagggcatctttgaggtcaaggccaccgacggcgatacccacctgggaggcgaggacttccacaaccggctcgtgaaccacttcgtccaggagttcaagaggaagaacaagaaggacattactggcaaccccagggcgctccggcggctgaggaccgactgcgagagggctaagaggacgctcttctccaccgcccaaaccaccatcgagatcgactcgctctatgagggcattgacttctacacgaccatcacccgtgcccggttcgaggagctcaacatgggcctcttccgcaagtgcatggagcccgtggagaagtgccttccgtacgccaagatggacaagagcagcgtgcacc

SEQ ID NO: 22689 - DNA, 457 bp, Zea mays
  Clone ID: cC-zmle1890012g06a1
tttttaaacaagtccatccaatgggctgggatattaattaattattacaaaacagcatgcagattgtacgatgtttattattacaatatgtataatatgccaagattttccacttggacttgacaacaagagtgaatattaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtctttcaggccgggcgggtactcgctcgccgggttcagattgaccagtccggcgggcttgttctcgtcggcgaactccttggacagcggcggctggggcgtaaccttgaagttggggttccttatcc

SEQ ID NO: 22690 - DNA, 450 bp, Zea mays
  Clone ID: cC-zmle1890012g06d1
cctgctccaacccgccctacgacctgacgtccttccggttcagtttcatcaaggagtccatcgtgtcccgcgagatgacccgtcgctacatgacggacatgatcacctacgccgacaccgacgtcgtcatcgtgggcgccggctccgtggggctgtcctgcgcgtacgagctcttcaaggaccccgccgtgagcatcgtcatcgtggagcagtcggtgtcgccgggcggcggcgcgtggctgggcgggcagctgttctcggtcatggtggggcgcaagccggcgcacctgttcctggacgagctgggcgtggcgtacgacgaggccgaggactacgtggacatcaagcacgccgcgcttttcacgttcacggtcatgagcctggtcctggcgcgccccaacgtgaagctgttcaacgctcgtggccggggaggacctcatcgttagggga

SEQ ID NO: 22691 - DNA, 178 bp, Zea mays
  Clone ID: cC-zmle1890012g07a1
ggtcaaggctaaacaaacaggaagaatttgacggttatatgggctgttgattaccagttacaggcaaggggggtttgttcatgtgcccaaaaaaggggtaacctggaacgatccgaaatcactttatgaaaggctgtatgatgctatttatgataaatgggcagagcctaaaggtccc

SEQ ID NO: 22692 - DNA, 463 bp, Zea mays
  Clone ID: cC-zmle1890012g07d1
tccggaattcccggcccacgcgtccgccggataatattctgcggtagtttctcgagctcctgtgtctagaaagataccatgtcgggggtatgggtgttcgaggacgggatcgtgcggtgtgcggacagcgacccgcccagtggcgccggcgccggcgggttccggccgaacaaggtgctggtgcacgttcccagcggtgaggtggtgacgtcgtatgacgtgctggagcgggggctacgcgagctcggctgggagcgcttcctatacgacccctgattggtccagttccaccagcgctccagcgtgcacctgatcacggtaccccgtgacttctgccgtcttaagctggtccacatgtacgacgattgcgtaaagacccgaaacgtctttctaggtccgtgacgccgaccctgcctgatggtctttgtggccacacacgctgctgctgtgtgcctattagctt

SEQ ID NO: 22693 - DNA, 355 bp, Zea mays
  Clone ID: cC-zmle1890012h01a1
gggggttggttgttttaaatctccctttttgatccacgggggacctcaaaaaaaacaaaccaaaaacttgggaccacccgggaatcgcggaggggacccagagagcaaaccaacaccccctcaaggggcccaaaaaaaaactgggggaaaaaagggccaaaccggatccctgggggaaaagggttcccgggagaaatgccctaaaaaaacaagccgaaaacaaaaaggggaaagccgggggggcgaaaagggggaccaaactaacaataaaggggagacgactaaggcccggtgtccacccgaaaaaccacacgggccccctggataaatgaaccccccaacccccgggaaaagg

SEQ ID NO: 22694 - DNA, 481 bp, Zea mays
  Clone ID: cC-zmle1890012h01d1
accacccgtccgcccacgttttcattgacgcgtggatgctgaggcacgcactgtttttctattgtctatgcctaccttacatactactacaagggggggttattcccagcggagagcatccatgaactctgcatacctatttatcgtacaatagcacacacagtactctgtttcattgacggagcattaccaacagcttcattcacttggcaatggctcatttgtacctcagtcaaacaaagttagtccatgcggtgtagcatcatatacggtacaagggaatgcacaggcctacagccttgcttacggaagcccttccagcaatcctgctactattgctgctgtccttaatcaacaagcacattgctgtgctcccatggtgctttattacctgggaccatttcagtcagtgcagaaccatccgataggcattgctgttaacgtggctctaatgggttacccaaaggatcaagttgttgat

SEQ ID NO: 22695 - DNA, 477 bp, Zea mays
  Clone ID: cC-zmle1890012h02a1
ttttttttttttttttttttttttttttttttggggtggtgttcttttttttttttcttttcttttttatttttttttacctcctttctttttaagtttttttttttttctcaggatccccaaaaaagttttttcggggccccgccctattgggggaattccccccggggcgggggggggcccccccccaaagccaaataccaagaccccgccaaacccggcaacccaaaaaatacaaaagggccccccggcgggcccaaacgggggggggatcccccccccggggggataaaaaaaccccgggaggggaacctcccccgcccccggggcccccgccggggcggggggggggggcccccccgacccggggtgtcgcccccacaaaacccgggccccccgggagaccccaggggggggggggggggactggccccccccccctgaaacaccggcacacccccctcagaaacttcccct

SEQ ID NO: 22696 - DNA, 472 bp, Zea mays
  Clone ID: cC-zmle1890012h03a1
cttcggtctaatagggcaaagacggggaagggaaataaatatttgaccatatccccacaaatttgctaaataaatatagatctagttgggtaaacatatgccggtatagatcctacgaatttttatctttttgcccatccaaaaaagaagcaggaacgaacagttccgcgcccgtgaattcggtgggccagcttgtctccccccgcatacagagcccccttcttgcatgacccgggagagcccctgtcgtggagaggcgaaatgagacactgcgttggtgcctcggaccgacggacggacgggtcgggggtcatctggcagaccgggcggtcaatggggttcctgctgacctggtgaatcgtacggggggcgtcgggggcggtgccggaccccccgtataaccggacggggtgtggggagtgtcccattcacagcccgcaccggggcggtttggtttttttcccggccccgg

SEQ ID NO: 22697 - DNA, 157 bp, Zea mays
  Clone ID: cC-zmle1890012h03d1
gggtcgaccacgcgtccgcccactcattcggccatatccgccatgatgccggacgcacactctatcggtttgtaggacgtgacgcccagctaaggaccaacgctaaggtgccattcgagaagtgtcacatacggcaacctgctgaattacttgaagg

SEQ ID NO: 22698 - DNA, 369 bp, Zea mays
  Clone ID: cC-zmle1890012h04a1
aaccaacccagctgggtatcatatcatacggggtgctgctgcggcggcggcggcaggtaaaaaaacattgaggtatagcttcatacaagttcattccacgtttgacgcgccgatcgagagtatcattccacgccctatatagctaccactatagctagttgtcgaaaatgcggcactcctcggagtccgggttctccttgcagtacttctcgagcgggtcgttggcgttggtctccttgaggctgtcccgggcgtggctggccctggcgctgagctccttcaccttgtcccacgccgtcgggcactcggggtcgcccttctggtggtccgtgcacgtttcctccgcctgcttgatgttctcagacacct

SEQ ID NO: 22699 - DNA, 516 bp, Zea mays
  Clone ID: cC-zmle1890012h04d1
gggtggacccacgcgtccggtgaaaggagatgatgtggtgtgtataatcaagaacacagccatcttggctgtgtcactgttcacgctgcattgctcccagattcacattgacttgcccaccctgtctgatgaggataaggatgtcattagaaaatggggtactcccaataagattgacttcctttctctgtcctacacaagacatgcagaggatgtgcgccaggcacgggaattcctgtcaaaattgggcgatctaagccagactctgatttttgccaaaattgagaatgtcgagggcttgaaccaatttgatgaaatactggctgaggcagatggtatcattttatcaagagggaacctgggaattgatctttcaactgagaaggtcttttggtttcaaaaatctgtctttacaagtgcaacatggctggaaagcctgttgttgtcacttcgtgttgtggacagtatgactgacaacctcaggcttattgagcggaggcaactggttgtggcaat

SEQ ID NO: 22700 - DNA, 214 bp, Zea mays
  Clone ID: cC-zmle1890012h05a1
agggacccaagattggttgcttttacaacgtgacaacatatttttattatttatgcttggacagggacaatgtctttctagcagtaccagtaacaaggggggtttgcagcagggactataaacaacagagtaccatccgggttgatagattttttattactgtaaaattgaaccccgcagtactaccggtacggacgcgtgggcggacgcatgg

SEQ ID NO: 22701 - DNA, 207 bp, Zea mays
  Clone ID: cC-zmle1890012h06d1
aaaaatgaacaaatattagcatttagcagcgcctctagtcttttgctatcgttggtattgcacaactgaaaatggtgccttgcattgaacaaacttgcttccgtgccagaattttattttggtcacctgataaaatgagctataagaaaatctttattatttaaataaaaaacaaaataaaattacaaaaaaaaaaaaagataatag

SEQ ID NO: 22702 - DNA, 336 bp, Zea mays
  Clone ID: cC-zmle1890012h07a1
ttttatttatgttttataaaagggacaagaacaggctgcagccacaagatcatagatctactaggttcagctggatacagcaccagaaattaagaatctaggctaacggaaaatgggttccgattcaaccactagacaaagtgtccaggaacagataaatttattacaaagaagacactagacaatttgatggttcaccctgaatcgcacgagtccatacaggcgggagttcgtgtcccgctccaggatatggcccattttagcatcagcataccccagttcgaacagcttgaggagggcctttttgttttcataaaagaaagcccgggcgcgtgg

SEQ ID NO: 22703 - DNA, 78 bp, Zea mays
  Clone ID: cC-zmle1890012h07d1
cccacacgttttagaacgcgagccctaacacatattattcgatgcttttttctactgtaaccccggcgcatactatgg

SEQ ID NO: 22704 - DNA, 313 bp, Zea mays
  Clone ID: cC-zmle1890012h12d1
cgcgttcggattatcattcccagaggaaaataatggctgtttgaacaagatttcgaatctttcagaccctgcataatattcaagacttgggctagtgccaagaagagctgacctggacatgaaccaacatgttaataatgtctacttacataggttgggttctcgaaagtatacccgaagagataactgatacacacgatgtacatacaatcacctctcaactactgaagggagtgtcaacaggatgacttagctgattcctttacttgcataaaggaaggagaggtgaaaaggatgaacgggtttgttttct

SEQ ID NO: 22705 - DNA, 521 bp, Zea mays
  Clone ID: cC-zmle1890013c01a1
ttttataaattgaccagttattaaagtattgtcggcgcctcggcagttttgtatatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaaggagggagagagagagaggaaccaatgcaagaaggtgatccgatcaacaggcagaggcatggccatgggtcgatctagccacggtctctactcgctgccggggggcttgtaggcgatgaagctgacgcactgcgtctgcctgacgttgtcgaagccgatgacgcggtggaaggcgtccgggtacgcggcgatggccttctgcagctccttgtacacctgcgtggcgtcggtgcagccgaacatgggcagcttccacatg

SEQ ID NO: 22706 - DNA, 485 bp, Zea mays
  Clone ID: cC-zmle1890013c02a1
agccatggttctttacaaactcaagccagcacttaaaacaatataccattatttctgacaaaaatataccaatgaggcagtgaagataatgtacaccacaatattttctctgattgatacatagcctagtactagcatacagaagtgatgtccaaaactgggatgtctcaattgtcgcaaaatgcatgtagggtttcatcgagtgcattcccctcataatcccccgtaaatacacagcaccctagtggtcctttcagaaggatgagtttcaacagaccatcagcaaccttcttgtcaacagccatgatgtttttaaacttctttacggtcatggtctcaggaggtgcaatgggaagtttggcttgctttattatgtcaaccacacgttttctgatggagtcatttatccaccccaggcggtgagacatgtcagttgccataactgttccagctgagacagcctccccatggagccatgctccata

SEQ ID NO: 22707 - DNA, 456 bp, Zea mays
  Clone ID: cC-zmle1890013d02a1
ttttaagaaactagaaattcactttcttattcttgggaagccacaaacgggagcaaaaaaactttattatcgaactataactcataagcaatctaaaagagggcaccaccaatgatggggagtgggcataacgctgtccacataaagacaaagctttggttgaatggaacacatggcaggatttgaaagagggtgccaacgttaggcgcatcgtgcaagtagaacggcaacaactgttgctgtgtaaagaaggcagcagggctcacagcagataactggctgaatggtagtagttgttgttgtacataagcaggagaggtcaaagctgccagtcggttgaatggaagaaattgctggtggaaggaagcagctagctggctgaatggtagcatgtggtggtgttgtaaataaaccgcacagtacaatgcagcttgttgggggaatggcagaaactgt

SEQ ID NO: 22708 - DNA, 390 bp, Zea mays
  Clone ID: cC-zmle1890013e01a1
ttttaacaacaaattcaggttataagcacgggtggcagtcatggctgtagatgtaatacattcttaaaccgaaagagaaacaatgaaccagaaaacaaaacgcttccagtgtggactggaggaatgcaacagccgaacagcgtcggtgttattgactcggctatacagatagacatgcagtaaatatgtcagtgttacactcgatttacttttccaaaaacatgtatgcgcctagctacaatagcagatgtccgccacaggcaccaagttcgttcgttgcttggcaagggacctcaactgccgtggctaccctaacaaaacgtgtccccttcctagaacgccaactgctctttctcttaagctgcaaccggcagcgatccctccgaggct

SEQ ID NO: 22709 - DNA, 476 bp, Zea mays
  Clone ID: cC-zmle1890013e02a1
ttttagggaaagcacttccatgattcttaccaatacacatgcagaacagcagtagatttataccattcaaaaatgcgagataaaacacaccaaataggatcccactgcaacagatgcacatctcataattcccaatgactgcgtcaattagttatgggcaccaaaaggatgtccaccgaaaagaaaaaaaaacatggcattctactgtgctacaaaatttcaacaccatgctcattgtctactgtgcgatgcgaccagaagagctgttgccgcatcaacaaactctactacaatttgttaacaggcataataacactgcaactttttacacttgatggtgccatagtttcttgtgaagtgcacatatgaaggatggagtggatttagtttgatagagggcttaagagatttttacggaggggggcttgaataagattatggaatatggatgcttctgaataatgtatggctataat

SEQ ID NO: 22710 - DNA, 418 bp, Zea mays
  Clone ID: cC-zmle1890013f01a1
tttttattttttttttttttttttttttttctttgtttttcggttttttgggtttcttttctatctcttttcctttttttgcagaagggcccaacgtgttttttttgcctttggaaccaaaatgggtgcattgttcactttcgccccccccccatctttaaaattaccaccttcaccttccgcccggggggcgcgaccagggttttgcttcattatttttatccaggtggaggaagggcttttcccatcctctggtggagggccactttttttttgtaccctaacaataaaacgacgactaggatgtggacgatgggtccatcaagcactatgttttagagggggaacctcggggggaacccctttggtttgctgggtccagccaccacgattgttaccacccccctctttttttggg

SEQ ID NO: 22711 - DNA, 457 bp, Zea mays
  Clone ID: cC-zmle1890013g01a1
gaaccgaccgactatcacgaggtccaaaaaaataaccaccacaaaagtaccaaccaaccacaaataaagtttaagcggacacaccgcaccaactgacgataactctcggcagcaactgggccagccagcaactgcagcacactcaagactgacaacaaaccgcttagtccacctcctcgatcttggggccagggccgccgctgccggcaggggcgttctcgtccatgccgccagcgccgcccatgtcttcacccgcgccctggtacatcttggcgatgatggggttgcagaggctctccagctccttcatcttgtcctcgaactcgtccgcctcggcgagctggttggcgtccagccagctgatggccgcgtcgatggcgtcctcgatcttcttcttgtcatcggccggcagcttggacgcaatcttctcgtccttgatcgtgttgcgcatgttgta

SEQ ID NO: 22712 - DNA, 491 bp, Zea mays
  Clone ID: cC-zmle1890014a01d1
tcgacccacccgtacggagatctgcggaggaagcaagcaatgcaatggctttagatggtttaatgtttgagggagcaccagtcaaggttagaagaccaacggactataatccttccctagcagctgctcttggcccgagccagccaaatccaaatctcaatcttgctgctgttggcttaacacctggctctgctggaggattagaaggtccagaccggatctttgtaggtgggctaccatattatttcactgaggctcaagtgcgggagttgctcgagtccttcggacctctgcgtggattcgatcttgtgaaggatagagaaactggtaacttatagggatatgccttctgggttaccaagatcttaatgccaccgacattgcctgtgctggccttaatggcattaagaagggggacaagactcttactgttaggagggcaaacccaagagctttccaaccctaggccaaagcagaaagcttcttgctgc

SEQ ID NO: 22713 - DNA, 413 bp, Zea mays
  Clone ID: cC-zmle1890014a03d1
gggtcgactccacgcgttcgctctactgcaagcctcctccgatgggaggatcgttaacgtctcctcccacttcggccagctaaggcttttccgaagcgaggagctgaagcgggagctgaacgacattgacaacctcaccccggagaggctggatggcctgctggacatgttcttaaatgacttggaggccggcgaggtggagtcgtcgaacggctggccgatgtatttctcggcgtacaaggtggccaaggcggccatgaacgcgtactcgaggatcctggcgaggcggcaccccgagctgcgcgtcaacggcgtgcaccccggttatgtcaggaccgacaggaccatccactgggggtggtggcacccgaaggaaggggccctcaggtggcccaggggggcctctttcccga

SEQ ID NO: 22714 - DNA, 224 bp, Zea mays
  Clone ID: cC-zmle1890014a04d1
acaagcttgaagcagcgagctatcctggtggatgagatatggcatgctgctggagattctgggtcagatattgattggtatgtgaaacgtacagtgcttggtggtatctactcaacctcagaggtgtatatgttgacagacaattctccagagttccgtgatacttggacgtttgtgaaccgcagaataaaggatgctcttgatcttcagaaaacctttcaaga

SEQ ID NO: 22715 - DNA, 188 bp, Zea mays
  Clone ID: cC-zmle1890014a05d1
gcctctgcctctgcctctgcctcgtggcccgcgcgcggtgtcctttcttccttctccgcccgctgcccgcacgggttgtttgtacttgtacatgtaccactgctagactagtactgctgctgtgcctgtactatgcactgtgtattgtattgtattgtacgtgctagtaataaagctgctggcttttt

SEQ ID NO: 22716 - DNA, 408 bp, Zea mays
  Clone ID: cC-zmle1890014a06d1
aggcagtacagcgccagcgcctcgctcttcaacgcctacttcgtggcagccatgattaggatgggcaacgttggggtgctcaccggcaccgccggacagatcaggcgcaactgccgggtcgtcaacagctagatacgcatcggattcgatcgatatacttgtagctatagctagcttgctcgtcgaccgagcgcccattgatggatcgaccgacacagagctcgcttctgatgaaccccagtacgtgtactctctagtatatatacatagatatagctatagattgaacacgtcgtcaataccagtagaataagtggtgaacgaccacgcaaggacaaagcagagtgatcgaagcagtgtcacttgggtaccgaaatgattcatctgacattttcgtattggattttg

SEQ ID NO: 22717 - DNA, 555 bp, Zea mays
  Clone ID: cC-zmle1890014a08d1
cccacgcgtccggcaacgcgggcggggtgctgttccaggaggcggactcgcccgacgccaccatcgactacttgggcgacttcgcgcccaccatggagctcaagcgcctcatccccaccgtcgacttcacggacgacatctcctccttcccgctgctcgtgctccaggtgacccacttcaagtgcggtggcgtggctatcggcgttggcatgcagcaccacgtagccgacggcttctccggcctgcacttcatcaactcgtgggcggacctctgccgcggcgtcccgatcgccgtcatgcccttcattgaccgctcgctcctccgcgcgcgcgatccgccgaccccggcctacccgcacatcgagtaccagccggcgcccgccatgctatctgagccgccacaggcggccctcacgtccaagccggcgacgccgcccacagccgtggctatcttcaagctctcccgcgccgagctcgttcgccttcgttcgcaggtccccgcgcgcgagggcgcgccggggttcaacacgtacgctgtgctggcggcgcacgtgt

SEQ ID NO: 22718 - DNA, 620 bp, Zea mays
  unsure at all n locations
  Clone ID: cC-zmle1890014a09d1
tcccgggtttacccacgcgtccgattgggataatgccagaaatgtggggtggtgataccccaatgatcgatataagtgctcttactggggataatgttgatgaacttctggaaactgtcatgcttgttgcagagttgcaagaattaaaggcaaatccacataggaatgcgaagggcactgttattgaagcatgccttgacaaggccaaagggcctcttgctaccttagttgttcagaatggaaccctaaacaaagctgatattattgtgtgtggtgaagcttatggaaagatccgtgcattgtatgatgactgtgggaagctcgttgacaaagcatgaccatccaatgcagtgcaggttattggcctcaataacgttccccttgccggtgatgaatttgaggttgttgacaaccttgatgttgcacgtgaaagggcgaatgggcgtgctgaagcacttgcgcatagaaaggatatctgcaaaagctggggaaggaaaagtcacacttctagctattgcagcatcggtttcatctgcgaagcangttgaattgatcacatgagctaaaagtatccttaaagttgattttaggggtcaatcgaggcttttatgcaagccatc

SEQ ID NO: 22719 - DNA, 234 bp, Zea mays
  Clone ID: cC-zmle1890014a10d1
tcccgggtttacccacgcgtccgcggttttggttcaatattatcagagagcaatcaggcattgttacctgcgtcaattgtggtccgcaaatgcaatcttgcgaattttgcaagtgcgctgtagcacttgtaacttgcgagcgcccttcgcaagaatgcatcagcgtctgctgtgtctgtaaaactgtcaaagatagtgtttacctattagcttgcatggtatattggtggtgag

SEQ ID NO: 22720 - DNA, 586 bp, Zea mays
  Clone ID: cC-zmle1890014b01d1
gtccgcccctcaggaagaccccagggaggtcgctgctgccaaagcagatttgaactatattggtcttgatggacagattggttgcatggtgaatggagcaggattggccatggcgaccatggatattataaagttgcatggtgggacgcctgccaatttccttgatgttggtggaagtgcatcacaggggcaggttgtggaagcttttaagatactgacttcagatgatagagtgaaggcaattctagtgaacatttttgggggcattatgaaatgtgacgtgatagcaagtggaattgttaatgctgctaaacaggttgacctgaaggttcctgttgttgttcggttggaaggcaccaatgtagaccaaggaaaaaggattcttaaggaaagtggaaagactttgaccactgcagaagatcttgatgatgcgggagaaaagcttgtaaagcttccggcaaatactattgcgtatcaatttgaagctatttttttactggtacaagatgagcagtggtcttttacggtttccggctggggcaaaatcacaaccgcacttttttgaagtggggtattagacctaatt

SEQ ID NO: 22721 - DNA, 141 bp, Zea mays
  Clone ID: cC-zmle1890014b03d1
gacacgcggacgaccaccttcagaggttgagcaccaaatttccgacggagatgggggtggttgaggcgaggtcagggatgaggtacatgttctacgattctgccttcgcgccccataaggcgcccagagcgcgccccaggg

SEQ ID NO: 22722 - DNA, 320 bp, Zea mays
  Clone ID: cC-zmle1890014b05d1
aaagaaacttggctgggtgttgacgcacgcagccggcggcaacctgtgcggggagcgccaagggctccaggaaagaatcggccgcgggctcgcgatcgggaaggggagcggggcgcatgcgcgagcactggcacggcgacggcgacggcgaggacgagcatgagccccagccggggtgcggggagggcgcggggcaggcggcggcgaactgcgcggcggtgtgctgctgctgcccgctggcgctgctcgacgtgctgctgctcgtcaccgtccggctccccgcgggcgtcatgcggcgggtgaggaggaagagcccggcg

SEQ ID NO: 22723 - DNA, 400 bp, Zea mays
  Clone ID: cC-zmle1890014b06d1
cccacgcgtacgaccacgcgttcgcgtttacgtcgacgccaacgggagtaagggtatgggcaagggcgtgtaccatgttcgtcgacaggtgcggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgct

SEQ ID NO: 22724 - DNA, 493 bp, Zea mays
  unsure at all n locations
  Clone ID: cC-zmle1890014b07d1
gaattctctgggttcgacccacgccgtccgattgtcaaaatcagggagaaactggaagatgcaaacaggtttgatgatgaatgtatggagagccataggggatcagtcctgatatctatatcttacagtgtgctcatgagtggctacgcgaaaggaggcatgattgatgaagcccatgatctacttcgtgaagctaagaaaattcatccgaagctaaaccgggttgcttatcacatacttatccgtggatactgcaagatggaggacttcgagaaggccaatgagtgcctaaaggagatgaagaaagatgggttgcagccaaatgtggatgagtatgacaaactgattcagtcattgtgtctcaaggctatggactggagaagagctgagaaactcctggaggaaatggaggatagtggtttatgcctaangggtataagtcgcagcctcataactgcagttaaggagttggaaggggaggaaaagcagtcaa

SEQ ID NO: 22725 - DNA, 502 bp, Zea mays
  Clone ID: cC-zmle1890014b08d1
ccgtgccgctcccggagctggacgccgtcatcggccgtgtcgccgagaccttccgggtgcgtaaagtgctgatgcgttcgccggctccagatgacctcgtcgccgtcatgaccaacagctggaactgcaacgtcatcttgtgccgcgccgggaagggtacgttcgtgctaccctactacaggatcgtcgacgtggcgttccttggagaagacacgctgtatggaatcaccaccggcgaagaactccttgccttccacctcggcgaggatgacgacggcagacctaatgttgccaggattgagctggtcatcaaaaacacgttggccaattattattatgatgaatttggatggatgtggccagcagaagtagctagcactagtagcaacaacgacgaggatatggatatggatgacgatgattatatggaggaggatgatccggcagtcgtcgatgatggtgaccacgaccaagctgattgcttcaacggcgatgagatggt

SEQ ID NO: 22726 - DNA, 615 bp, Zea mays
  Clone ID: cC-zmle1890014b09d1
ttctcgggttgacccacgcgtccgagcgcgagcaacccacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgccttgacctctccatccgccgcgtcgcctactcctccctcggcggcgccttcgcgggcctcctcctcttccgtagccctactactcgctgggcatcagttgcccttggagctggtgtggggataggggctgcatacactgaatgctcatacttattcaatggtgctccaaagtgttcacccaaagtttcaactattccctctgcacactctgatgggggagataagtaaacccttgctgttggattggtccatctcgggggagtttttgtatgtgtgaagtaccggttgtttcatgctggatattgcgctacttgtggccatagcattgcatcgaagctagatgcgcctacttgagagttttgt

SEQ ID NO: 22727 - DNA, 425 bp, Zea mays
  Clone ID: cC-zmle1890014b10d1
aacgccattttcgggtttacccacgcgtccgctcgtgacaggggtcatgcacgtcttcatcatgttctcccaggctgatctgtcgagctcagccaaggcggcacggaaccgggtcaataaggaatgaaaacggagggtggagatgtgattctgggctctatttatggctagctttcaaaatgactcgattcatattaatgtatacagcaccaaattccagacattgatatgctctgaaacaggatgctctgctcctcttgtatttgtgtgcaggaaagaattttagggagttcatttttgccccccttttttgggcagaggaactgtaggacatgaacttgatgttggtacatttgccctgtagacattctggaagccttttcagtagttcatttatcagtaaagcttgcatctttcttccaaaa

SEQ ID NO: 22728 - DNA, 592 bp, Zea mays
  Clone ID: cC-zmle1890014b11d1
acgcgttcggaaacacaccaagcgaagcgcactagcaacgacctaacaacaatggcttttcaagatattagccctccttgcgcttcttgcgctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgcttagtcaactagccatggtgaaccctgccgcctacgtacaacaacaacaactgctttcatctagcccgctcgctgtgggcaatgcacctacatacctgcaacaacaattgtgcaacaga

SEQ ID NO: 22729 - DNA, 247 bp, Zea mays
  Clone ID: cC-zmle1890014b12d1
tccacgcgtccgcccacgcgtccgcccacgcgtccgtccacgcgttcgatagcatactacaaactaagctaatacaatatccaagtttgctaaaaaaaaaaaaaaaaaaaaaaaaaaaaaaataaaaaaaaaaaaaaaaaaaaaaaaaaaaaaaataatttaaactaaatataaatgaaattaaaaaattttaaaaaattaaaaaacttactaaaaaaaaataaaaaatataaaaagggggggttat

SEQ ID NO: 22730 - DNA, 468 bp, Zea mays
  Clone ID: cC-zmle1890014c01d1
cctcttgggtcgattccacgcgttcgtactactactactagctggtacacatactagccagcttgccatttcagcttgtcatggcgcccaccgtgatgatggcctcgtgggctaccgccgtcgccccgttccagggtctcaagtccgccgccagcctccccgtcgtccgccgcagcaccaggagcctcggcatcgtcagcaacggcggaaggatccggtgcatgcaggtgtggtcggcctacggcatcaagaagttcgagacgctgtcgtacctgccgacgctgttgacggacgacctgttgaagcaggtggactacctgctgcgcaacggctggataccctgtcttgagttcagcaagctcgggttcgtgtaccgtgagaacttcaccttcccgtgctactactacggccgctactggaccatgtggaagctgcccatgttcggctgcaccgacgccacgccggtgt

SEQ ID NO: 22731 - DNA, 375 bp, Zea mays
  Clone ID: cC-zmle1890014c04d1
cggacgcgtggggtctgacggcgtgaggctgagaccataggatatcagagacggagaggagcgcggcggcccgggcgccggagcctgtagggtatgggaagagaagagaataggcgatggcgtcaatcgggtcctccaacatcggattccagctgctgaagatgtctggttggaaggagggcactggccttggagcgcaggagcagggaaggttggaacctgtagagactcgtgttaagaataacaagcgtggtataggttctaaagaaccataaccacatcctaaggttgaggatgacattgaaacacattcctcaaagcctaaacaggaaatgcaatcaaagaaaggggcaaattttcctgcaaagaggttaa

SEQ ID NO: 22732 - DNA, 400 bp, Zea mays
  Clone ID: cC-zmle1890014c05d1
cccacgcgtccgcagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggaaagccacgactccgggtttcaagtgagg

SEQ ID NO: 22733 - DNA, 443 bp, Zea mays
  Clone ID: cC-zmle1890014c06d1
gcagcagaggcagcgacacgatcgcgagcgcacgcacgtaagcacgttgtcggaagctcaagttagaagaagcaccagtgactgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgttacgccatgctaggcgcggtgggcgccatcgccccggagatcttgggcaagatgggca

SEQ ID NO: 22734 - DNA, 278 bp, Zea mays
  Clone ID: cC-zmle1890014c07d1
cggacgcgtgggcggatcacttctttaatttatataagttttgatcaacgagaaaaaatctggagctagttcccggagaaacgaacatggcctcaatcctcttcaatccatttgctcccaaacaagccaacgggtgtatggtgcaggagctatgtgctcgaacaatttaatcaacaggttcttctgctgcagttacggcattttctgtgctcgctgcagaagatgaactgctacacggacaagaaagacggcggcggtcccagcacgcacgttgaggg

SEQ ID NO: 22735 - DNA, 544 bp, Zea mays
  Clone ID: cC-zmle1890014c08d1
gcttcaggggtcgaggatgccaagtggcagggctattttagcatgtggacggttcaagatttgttctcttaagtgtcgcaatggaagaccccggactcaggttcagcaccttatgcagattgatctgaagggatggttcttgaactactctactttctttcagtatcattctttactgtagatactgaactgtgttgctggtactgaaatactgtttttcttatgacacaaccattaacaactttatatttactatgaaagaacaaatgtaatttttaaattaactactcagcccgttgtcctgccaattcattctggtccttatggctctaatctacacttactcccagggctgcgtgaatatttttcccaaatagatgatattcatataactccaaggattcttgcaatggagagcatggctaatgtgaatttagcacaaaaggacgagaagcttaaagaagttgacttcaaaactaaaccagaagatcaacaactagcagaaaataaaaatatgggaacaattgatgaagaatcagatgac

SEQ ID NO: 22736 - DNA, 528 bp, Zea mays
  Clone ID: cC-zmle1890014c09d1
tcccgggtctacccacgcgttcgcccacgcgtccgcccttcccagatccatcgactcgctcgggccgccccttccgtcgtccccgttcgaaggtgcggtagccggcaggcgagcgatttgattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaacttatgcgaagcaatggttgaacgagatagacccgtatgcaagtgataatgttaacaagctccttgttgggaacaagagtgaccttactgcccacaaagttgtggctactg

SEQ ID NO: 22737 - DNA, 557 bp, Zea mays
  Clone ID: cC-zmle1890014c10d1
acgcgtccccccacgcgtccgtccttcccagatccatcgactcgctcgggccgtcctttccgacgtccccgttctaaggtgcggtagggggtaggctatcgatttgattcgacatgaatcccgagtaccactaccttctcaaacttctgcttattggtgattctggtgttgggaaatcatgctggcttctcagatttgcagacgattcttatttggacagctatatcagcacaattggggttgatttcaaaattcgcacagtggatcaagatgggaagaccataaaacttcgaatttgggatactggtgggcaggagcgcttcaggacaatcacttatcagcttctaccggggagcttatggaataattattgtatatggacgtgacagaccaagaaagctttaataatgtgaagcattggttgaaacaaatagaccgtattgcatgtgatattgtaacaagcttcttgttgggaacaagagtgacccttactgcccacaagttgtggctactgagacagtaaggcgtttgctgatgagatgggcatccctttcatg

SEQ ID NO: 22738 - DNA, 60 bp, Zea mays
  Clone ID: cC-zmle1890014c11d1
cgggtttacccacgcagtcccccgacagcgtgggctgacccactgggcagaaagatatat

SEQ ID NO: 22739 - DNA, 516 bp, Zea mays
  Clone ID: cC-zmle1890014c12d1
ctagcacttattggcaatccttcgaaagtccacagctggtttcttgggtactcgtggacgattgcagcatgcatggcctgcgagtcccacataggctggctattcagagccaccaagaagaatctgcggcctaggtctttctgggggatccgcagctcacaaatcgcagacgacacacaagtagatcagggtgactgatgctccaaacttccatgcgtataaggccatagtagcagtggactactaagccatgtatgacctggtgttcccaatcctccagtcgtctctggttcatacgcactgcctgcctttcgtgtgtaggcatagtagggacggtggagttccctgtaaaacaatcactctttttctactgttgtagtagtgctctgcactgaagggatttactgaatctctctttttttggtctaaataagatatctgtttccatagtacatgcatgattttcatttacagatgttccatggtgtggcatgggtgaagaaaactgttctatgt

SEQ ID NO: 22740 - DNA, 225 bp, Zea mays
  Clone ID: cC-zmle1890014d01d1
gtagagaggatcgtcgaacagaacagcatgaagatggtcatcgttctcgttgtgtgcctggctctgtcagctgcgagcgcctgtgcaatgcagatgccctgcccctgcgcggggctgcagggcttgtacggcgctggcgccggcctgacgacgatgatgggcgccggcgggctgtacccctacgcggagaacctgaggcagcccgaatgcagcccgctggcggcg

SEQ ID NO: 22741 - DNA, 510 bp, Zea mays
  Clone ID: cC-zmle1890014d02d1
gggtggacccacccgtccgcggacgcgtgggcgacgctccctctctccgtgctcaagcggtcgcaggcggagctggtggattaccacggctccgggatgagcatcatggagatgagccaccgcgggaaggagttcgacgccgccatcaagaaggccgagtccgacctgcgcgcgctcctcgcggtgcccgacacccacgccgtgctcttcctccagggcggcgccaccacgcagttcgccgccgttccgctcaacctctgcgcggggccctccgacccggccgacttcgtcgtgtccggatcctggagcgacaaggccttcaaggaggccaagaagttctccgccgcctccgtcgcctggtcgggtaaagacggcaagtacacggccctcccaccgttcgacgccatcgcccagaaccccgaggccaggttcctccacatctgctccaacgagaccatccacggcgtggagtttaaggactacccggagccccgaacaggtcgggcattc

SEQ ID NO: 22742 - DNA, 275 bp, Zea mays
  Clone ID: cC-zmle1890014d03d1
cccacgcgtccgcccacgcgtacgcccacgcgtccgcacactcgtctctctcacgagccacagcccacaggctagctctctagcggtctagccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcaccaaggggaccatgctcggggtgcgcaagaccgccgactactc

SEQ ID NO: 22743 - DNA, 404 bp, Zea mays
  Clone ID: cC-zmle1890014d06d1
tagtatagtgggggaggcttacttagttctatagcgggtcgttaagagggtaactgtgtcttagccgcggttcgggttttgtatgtggctgccctcgcggggtttgggtctacagcatcaacttctactgtgacgtgtacctgctcaagtgcttcatgcggtgattgctcagcggcaaggcatgggacgacctcctatagaacaagaccgccttcaccaccaagaaggactactggcgggaagagagggaggcgcaggggtccaccgcgcaaaggacgctgcacgggctccagccgccggaggcttgctccaacacgctgttcaacaactggatcattgacccggccctgtccgagataaaggcgcatgccaaaagacgacctgacacctttaggctgtgggag

SEQ ID NO: 22744 - DNA, 627 bp, Zea mays
  Clone ID: cC-zmle1890014d07d1
gcttcaggggtcgaggatgccaagtggcagggctattttagcatgtggacggttcaagatttgtcctcttaagtgtcgcaatggaagaccccggactcaggttcagcaccttatgcagattgatctgaagggatggttcttgaactactctactttctttcagtatcattctttactgtagatactgaactgtgttgctggtactgaaatactgtttttcttatgacacaaccattaacaactttatatttactatgaaagaacaaatgtaatttttaaattaactactcagcccgttgtcctgccaattcattctggtccttatggctctaatctacacttactcccagggctgcgtgaatatttttcccaaatagatgatattcatatcactccaaggtttcttgcaatggagagcatggctaatgtgaatttagcacacaaggacgagaagcttaaagaagttgactccaaacttaaccagaagaacaacaccttgcagaaaatatattatgggaacatttgatgagaatcagatgacgatgaggactatcttgtccctgagctgaatagaggaattactacaaatctaccatgagctagccacagataatgaatcctgaacat

SEQ ID NO: 22745 - DNA, 338 bp, Zea mays
  Clone ID: cC-zmle1890014d08d1
tcctgggttgtcccacgcgttcgcgtcacccggcacgggtgggctggggacggacacccaggctggctcgctggctgggggcgctttgtccgcttgttttagctggagctcttgttgttttgggtcgtgtgatttcagttcaaaagcgcgacagaattaggagctgcccaggccagttgtttatacaggccgtcgtcctgttccagacgcgtttctgtctgtgggctcttatttcttgggccgtcgtctagtgcgccctggtcttcaatggtttgtttgtttcctggactctaaataaaagaactattatattaaaatttaaatatttaataataagg

SEQ ID NO: 22746 - DNA, 605 bp, Zea mays
  Clone ID: cC-zmle1890014d09d1
gggtctacccacgcgtccgcctttccttcctcgcgagaacgagaggctagaccgcatccagtggtgggtctcggtatgggcggaagcgaatgcgccctgggcgacgccgctataggcgaggaaaccctaaattacgacggcgatgacgttgagatggccgacgccgactcggatacggaggaagcccgagcagctgaggtctccgctgcaactggaggatccgtcggaggtgttaggcaggcggagaaggacggaccggatggaaagaagaagaggaagaagaggaggaacaaagggaagaagaacaaagggaggcaagatggggcgcccaccaacatcgtggacattaatcgatttgttcttaacacttgcaagcgcttgaaggagaagaagtcgcaccttgtctggaatgctgttggctgccttggtgtcactgctgtcaatgatcttgttagagaggtggaggctaatcataagcgcggggggcagactattggtgatggaagccgctttcgactgggggggaattctctggacatcttaaagtcgggggacccaatgcttacaggaaattatggcaaagggaagggaactgagaagcattt

SEQ ID NO: 22747 - DNA, 300 bp, Zea mays
  Clone ID: cC-zmle1890014d10d1
ccgggttttcccacgcgtcccgtttgtctgttttttcaatcaattggtattgttgccgccagtgtgatggttaagtgtaattcgtcatgcgaacccgagtggagtcgtggcaaagtgtgattcatcgtatgcttgagtcgagtcgtgtcagttgcttagtttatttggctgctctatttccaaatcatcggatcgggttcctctgatctcttgttaaaggttcttcattcattaatccattacaacaattcatttacattatattatatcttctcatctctactcttagttcaaacatgg

SEQ ID NO: 22748 - DNA, 477 bp, Zea mays
  Clone ID: cC-zmle1890014d11d1
ccacgcgttcccggctgtcagtggtgattgtctgtccccagtccgaggctgaggagcacttcacgtcgctcaggggcaacggcctccggagctcgatctagcccgcgagtggcggctgctgaggttcgagacttgggggtataccttcagcttgttcgctgcggcttgctgcggctgcaatccggctgcggctgcggcttctacagtatttttctctctatggattgcagctgcagcaatccaaacagctgcaacagtgtcggcttgtagccagccgaacacgccccttgttttgccagcgtatagtttgtaaatacccagcgtatcaagctaaagctgaaacggattggttatatgcacttatcgatacaacgaagctgagtacccctctcgggtaggtgtaaatcgtgcaagggtaccctgtagaagaagaaacatagtattttcggttttgatttataaaatatttagttgcac

SEQ ID NO: 22749 - DNA, 573 bp, Zea mays
  Clone ID: cC-zmle1890014d12d1
cggacgcgtgggcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgtcgccaccatgccactaccctactcaaccgccccggcctcagcctcatccccagccacacccatgcccgtgccaacagccgcattcaagcccgtgccaactgcagggaacctgcggagttggcagcaccccgatcctgggccagtgcgtcgagtttctgaggcatcagtgcagcccgacggcgacgccctactgctcgccttagtgccagtcgttgcgggagcagtgttgccagcagctcatgcaggtggaggcccagcaccggtaccaggcg

SEQ ID NO: 22750 - DNA, 275 bp, Zea mays
  Clone ID: cC-zmle1890014e04d1
gaagatcacagggccagtgggcaaggagatgctcatgcccaaagaccccaacgcaacaatcatcatgctcgcaacgggtaccggcatcgctccgttccgctccttcttgtggaagatgttcttcgaggagcacgaggactacaagtacaccgggctggcgtggctgttcctgggcgtcccgaccagcgacaccctgctgtacaaggaggagctggagaagatgaaggagatggcgccggacaactttcggctggactctgcggtgagccgggagc

SEQ ID NO: 22751 - DNA, 449 bp, Zea mays
  Clone ID: cC-zmle1890014e05d1
aacccacgcgtacgctgactatcattaaagaaagggtagagcaattcttttttctagtgattctacagaaagtgagacaaagggaagcgaaagagttttctttgtataagaattaggtctatattatatctaaatagaagggaaatcaaaaagaagggaagtggggattacattggatgaatccttaaggaagacatatcacaaaagaaataaaggctaaagtaagcgctccttgcctttggtttgagcaaaacacattcttgtttcaccgaggaaaagagagaagttctggataaattgacaatgtcaacttgaattgactcattcagatccggctattccacattaatgggagtacatttatgtttctgctttacgaatatgatattttgtggacatttctaaatatagcaagccctattcctattatggtattttggattttaaga

SEQ ID NO: 22752 - DNA, 430 bp, Zea mays
  Clone ID: cC-zmle1890014e06d1
attttgtgaagttctcccctaccctcaacctctagccaaagtagctgcttgtgcgttgtagttcctgtctccacgacagttttagctcccctcctcagccactagatcgatctgcccttgttcatcacaaccaactcctgtgtctggtgaccacaacagcaatccttcaacctcatcatggccagggttcgtggagattgtctcggccgtgttgtgcccattccttgttcctcacaggagaagttttattcccttatcttttggttagttacttcatgtggaggccttgaagcttagaatgtctatgtgtatctcttatggaaaggcttcacccttccaattattgtaataagttatgcactttgggtactatcaggacttgtaataaatacatctctttctaccttgtaaaacttgagttctggaatgt

SEQ ID NO: 22753 - DNA, 77 bp, Zea mays
  Clone ID: cC-zmle1890014e07d1
ttcttgggtcaccacccgtacgggaaaaactgttctccctttccgaccgagtattgacttgatattttgttattcag

SEQ ID NO: 22754 - DNA, 489 bp, Zea mays
  Clone ID: cC-zmle1890014e08d1
gggttggcttctcctccccctccggttcgggttcgggttcgtgaggttctccggggttcgggttcgtgggttgagcggatcgagatggcggcgtcggatgttgagtaccgctgcttcgtcggcggcctcgcctgggccacggacgaccactccctccacaacgcctttagtacctacggtgaggtcctcgagtccaagatcatcctcgatcgggagacgcagaggtcccgcggcttcggcttcgtcaccttctccacggaggaggcgatgcggaacgccatcaagggcatgaacggctaggagctggacggccgcaacattaccgtcaacgaggcccattcccgcggcggtcgtggaggcggccgcggtgggtaccgtggtggccgtggtggcggcggctaccgcggtggcgggcgccgtgatggcggtggcggctaccgcggtggtggcggctactgtggcggctgccgttactgtggtggtggcggt

SEQ ID NO: 22755 - DNA, 565 bp, Zea mays
  Clone ID: cC-zmle1890014e09d1
tcttaatgcagacagagattctgaagagtgaagcaactcctgccatgagattgctcaatgatcttcttaatcttgatgatggaggcgacaatgagaagtggttaaagaaatgtagaaagcgcatgcttgaagtctttccaagagaggacccattcactgtggtctttcctgctgggttcaacatggagaatcgtgaagggcgaattgagctaccgcctcaggatgatgatcttcttctgagagtggactttgtcagggaagttgatgagctgctgaaagaggttcgtgctgtggaagacaagaacaagcaacaaattgggtttgacccagaatcagttgcatatatgctgaaacagcaggagaagatgcagacgatgcgtcaggtggaatctctcctgaacttggcgtcctcgttgaaatggtgaggattgagtactatcgaacaactgaacaactatgctgtttgcttagaagctaaacgtcattgacttgacatttatactgggtatctgttttcagctagttagacccaatacccttctgggtagagccatgcagtttactt

SEQ ID NO: 22756 - DNA, 499 bp, Zea mays
  Clone ID: cC-zmle1890014e10d1
ccacgcgtccgggatctcctggagctaataaactcgcatgggaagtacgcacagttcctatgtgatgtatgcaagatctacttggactggggcaccgagtcttatggagctcctgtgattttccttcacgatccggtcagcttagccgcgctagttcgtccggagctgctcacgttcaagaagggcgtggtgagggtggagacgcagggcatctgcttcgggcatacttccatggacatgttgctgaataagtggaactcagagaacccgtggactggctactcaccgatttcggtcgcatggacggtcgatgtgcccaatgtggtcccgtttgtgaaggagctcgtcaccaagccgtggaccaagttaactaacgtgttgtggtctcgcgcaccatatgtgcagtcaatttgagatgtcgatatatttacttacattctaagcactgctaacactattatctcaatggttgggtcctgtggaggaattgcaatcaatt

SEQ ID NO: 22757 - DNA, 502 bp, Zea mays
  Clone ID: cC-zmle1890014e11d1
cccacgcgtccccgctgatttcggctctctcccctgtagcaaatcttgttctgaatagcgtgccccggggggctgcaactacttgttacttggcattgcaccctaatgtcaaaggtgtatctggtaaatacttcgctgattgcaatgaagcaacaccgactgctgtcgcgagagactcatagctggcgaagaggctatggtcgttcagcgaagaacttgtcaagatctatgctgatatgtcacagacgacacaggcaagcgaagaggaggaaaccacggttacgaaagacgttttccaagacaagtagcgtaatatatgttgctgcgttttctactttttgtacatgtcctctgggcccgaatggccagtgactgtaatagcacctaagtgcccgagactggtaaggggtattcagacaatcaatcaagaaaccacggtgcggctgaagcctgaggcagtcctcttcgtcggtcacccatgttagcatttttattacattat

SEQ ID NO: 22758 - DNA, 440 bp, Zea mays
  Clone ID: cC-zmle1890014f01d1
gggtcgatccacgcgtccgggccaaggagggatgtctccgatgctgcagagccaggtgcagcgaatgatgatatcgacgacgatggcgctggcacccctccatcaaacaatgtgaaaaaacagaagacaacattgtcaggagaagctgccaacgatgagggaaatcatccgactcagaatccggcttctggtggcctggaaggtgattctgatctcaatgctgttccgtcttcaaaattttttgaagaaccatgtggagatgcctacattgatgcaagaccagatgacggtggcccaaattcagtagatgcgaaaccgggcagcacagctgacgacaacacggcactccctgggaacaccggcatggacgctaccaccccaccatgaataaagaacgtatcatggttcaatcagctagagaattgctgaagggtcagcgt

SEQ ID NO: 22759 - DNA, 390 bp, Zea mays
  Clone ID: cC-zmle1890014f02d1
aaggatggagtggaactgaacatgaatggaaaatgatcaaatggatgtgtctcaaaaggctggacttgatcgaagagatcccaggcgtcacgcttggtgtgcttatcgtcttcttggtgcccgtaaggatagctcagaatttggcgaactgtgtagagttttgtcattttgtgggcacagatgatgctcccagtagtgtgcacaatgaatgctttgtatgtattgtgctctattgcctgtgctaacgctacagaataaaatatttacaattaaaaaaaaaaaaaaaaaattaaataaattaaaacaaggctgacggggcggccgatctaaagggtccaagttttcgtacccgtgattgcgacgtcctattttttctattttgttacctta

SEQ ID NO: 22760 - DNA, 427 bp, Zea mays
  Clone ID: cC-zmle1890014f03d1
ggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacggccaaggtgatgcacctgctgctctggggacccaagtgaagcggcgagaggccaccgtaccgccgggctctcccgctggcgttgctcgttttgctctgcctgaaatccgccccgcaccgactgtactgtacctatatatacacctacattctacgacgtggccctgtactac

SEQ ID NO: 22761 - DNA, 514 bp, Zea mays
  Clone ID: cC-zmle1890014f05d1
tgctgttcgattgaacaaagagcttgctccattttaacttttaagttgaagggagaggatttaattcgggaaagcggtattccgtacactattgtaaggccatgtgcattaactgaggaaccagctggagccgatctcatgtttgaccagggggacaacatcacaggaaagatatcaagggaagaagttgcccgtatttgtgtagcagctctggcaagcccagatgctgtgggcaaaactttcgaggtcaagagcactgttccattcagcgaaccgtatgtgaatgaccctgcaaatcctcctcctgaaaaggactatgaagtatatttcaaagaactcaaaagaaggcattacgggtaaagaggcgttagaagcaacacctgctcaagtttgaagatgtcggtgaattaagaatttcgttgttttctaaaattttgacacagtaacccccactctgaatgtctaaagtcatttagaaacatagatgacacttatgcttaatttgtagctgaag

SEQ ID NO: 22762 - DNA, 424 bp, Zea mays
  Clone ID: cC-zmle1890014f06d1
gggtcgacccacccgtccggtgatggcacagctccctgtcaagaaagggctatccagatactacgacggcaagtcccagtcgttcgcgtgcatgtccgaagtgaggtgcctggaagatctgcgcaagaaagagacgccctacaagaagatcaagacatcaaggagtagcgtcgcgttagacgaagagcaggactgtcatacgccgccgggtcgtacgaacagcagagcgcccggaagttgttgcgcaaacctggtggctcggaacaacggcaaaaacatgctgtacagacctcccccagtccctgtaaacaaaagtggataccgtcagtaggctctaggacatgactggatgatatctatccagggtttcaccctttgttttttttttcttctccatttttgagggattttggtgacaggcgta

SEQ ID NO: 22763 - DNA, 474 bp, Zea mays
  Clone ID: cC-zmle1890014f07d1
cctactccagctagctcgcggcggcggccagcggccatggcgttccggctgagcaacaacctgatcggggtcctgaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctagtcggcgcatgctgccgcgtcacctggctgctctgggcctacctccttgccatgttcgttcctatcctcgtccttttctgcttaaccgtctttcgctttcgaggtcacaaacaggggcgccggcgaggtcgtctccggccgcggatacaaggagtaccgcctcggggactactccaactggctgcagaagcgcgttgagaacaccaggaactgggaccggatcaggagctgccctcaggactccaaggt

SEQ ID NO: 22764 - DNA, 583 bp, Zea mays
  Clone ID: cC-zmle1890014f08d1
tcccgttagactaggttaggctagggtgtcgaccagctcgcggaaatggtggccttcaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactacggtatctggctgcgctaccagagcagaaccggctaccacaacatgtacaaggagtaccgcgacacaaccctgaacggcgctgtagaacagatgtacaatgagatggcttctcgccaccgcgtgaggtccccctgcattcagatcatcaagaccgccacggtgcacttcaagctgtgcaagagggacaacacaaagcagttccacaacagtgagatcaagttcccactcgtgtaccgcaaggtcaggccgccgaccaggaagctgaagaccacgttcaaggcttcgaggccgaacctgttcatgtgat

SEQ ID NO: 22765 - DNA, 287 bp, Zea mays
  Clone ID: cC-zmle1890014f09d1
cccacgcgttcggaagagaggggactcggtgttctatgggccgttgccagagctggtctcttcagagaacccgcccaagtacaggaacttcaccatgtccgagttttacgggaccttcttctcacgagaccttgccagcaaggctctactcgacaacttcaagctgtcaccttaaagtgtcgactccagctcgaatagtttagatagactcgtgtatactatagtcatgcgtgaattgtgattgccggctggcaatgtatagaaattgttctgtcttggcctgcctc

SEQ ID NO: 22766 - DNA, 509 bp, Zea mays
  Clone ID: cC-zmle1890014f10d1
cgcgtccccggcaattaatgactttgaaaacgcgaaatagctgatgagggatgttgttgttgagaaataggaaagtggaatgaaatccggtcttagtcaaatatttcatatctcttctcttcttgtccaaacagaaggaaaaggagacaatttgagctgagcggaaaatccatatctctcttatccatttagagcatatggatcgatttataagaatcgaatgttttgtttttatgttattctgtgatagaatgaaaagaattctatatagaatgggttgggaattatgcctagatcccgtataaatggaaatttcattgataagaccttctcgattgtagccaatattttattgcaaataattccgacacctccggggaaaaaagggcatttacttattatagagatggtgcgatttgactctttttttttttagccctacctatatctcattcttaccagaaagagagagggttcgcctagagagaacaaaattagttaaggaaacc

SEQ ID NO: 22767 - DNA, 599 bp, Zea mays
  Clone ID: cC-zmle1890014f11d1
ccacgcgtccggcgatgaacaacggatagaagctgctcatcgtgcaaattttgtctcgtgatctgataatagataaagccccatctgcactagtgagtcttgttggtcgaaaggattatgaaagatgtgctcatgatatctatttctttcttcagtccccggtttgtttgaagcagctagcgttcgaactccttgagctgcttgttctttcttcatttccggagttggatggcactgtgaggaagtggcacgaagataaagagcaattctgcgcccagtaatgtttatcaaacgtttgaatttgtcacgggcggtgtttgtttccaacacatatcgtctttccagagtggtgtggcctgtgaattctgcgaaaataaggtggtcgcttcagaggagtgcccgtggatatctcagtttgaagtgggtggtggctttgtgcagtgtgaatatggttagatagtgcgaggatatggtccctttttccaccgggccatggcagaacggtttttggcccgaagagttcatttttcccccccagatttggatacgtaatgctgctgcctaaaggacagagagggggcgcatttttttgacccgtt

SEQ ID NO: 22768 - DNA, 388 bp, Zea mays
  Clone ID: cC-zmle1890014f12d1
ccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccaccttgtttgtggcggggggcgctggagcccggttctggttgggttgggaagccctttaaactgttgtcaccttgcattttaccttttccatcgctgtttattgtgagtggtcctatatcaatggctggtctcagtggtctatacgtatgcttttcggttct

SEQ ID NO: 22769 - DNA, 454 bp, Zea mays
  Clone ID: cC-zmle1890014g01d1
gggtgggacccacgcgtgcgcacttcttttacacactgggcctttcactctcaggttgatgatttctgaatttgatggggttactttgaaaagaagcattagaagatattctcatgggttctgatatggttgtcatttttcaaaattgggttgctggattgaaagattgtagtgctgtgaagtacctgcatgttggattcgaggactcgattttttttgtcaaccttgtttctttcatttgcctgtctggatgcgcatgaataagatatgaggtgtatgtctaaaggtttcgtttttttccttgatttctttggctggccgggaatcggatccatttattagaagcttgtgtttctgcactggatagaaacagcgatctaaggatttattcttggccttggacttttttttgctgtagctagagcaaaatattttttgggtgaaggtggcgtgc

SEQ ID NO: 22770 - DNA, 335 bp, Zea mays
  Clone ID: cC-zmle1890014g02d1
gctcggacttgggttggaactgttccaccttctacacttgaggtctgtagtatgaattaagagaaatttgtggaatgatgggacctaatgcccatggctattgcctattaaggacaatgtcataagatgtgtattaatcggggctggtctgataaacagtaactgttgacgaggaactggaagtggggtgctggcgtgtcagagtgcttgcttcctacctagcatagcatgcctgtgctatctggttattggtattggcttgatatcagtctatattatcatttacggagtattatggttaaaaattgtgtatttccttcactacttaagacttg

SEQ ID NO: 22771 - DNA, 457 bp, Zea mays
  Clone ID: cC-zmle1890014g03d1
gtggtgggggcgactcacgcgtgcgcccactcgttcgcggacgcgtgggccactttccccgtgcttcttcggcgtcgaggccgcgttccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcaggtacaagttcttcactgaccctaagtgaagcatgttgattggcatactactactactacttgctactggggattttacactttgctgggaactcaatatgtttggggaca

SEQ ID NO: 22772 - DNA, 393 bp, Zea mays
  Clone ID: cC-zmle1890014g04d1
aacgacgacagcatccatgaatcatcccgagcaagaacaacaagcagcagagagcgagaaggcggtgacgaccctgctcggcgtctgggcaagcccctacgtcctccaggtgaaatgggcgctggcgatgaagggcgtggagtacgagtacgtggaggaggatcttcggagcaagagcgcccagctgctggcgtacaaccccgtgcacaagaaagtccccgtgctggtctacaagggcaggcccgtcgcggagtcgcaggtcatcctcgagttcatcgacgacgcctggagccaccgcggggaccccatccttcctcgggacccctaccagcgcgccatgggccgtttctgggccacggttcagcaggacaagctctcggcgccgatctggag

SEQ ID NO: 22773 - DNA, 479 bp, Zea mays
  Clone ID: cC-zmle1890014g05d1
ccagggagtgaacaccagccgtcttggcccgcttgtcccctgctgcggccatggcgacctccgcggcgctctcggccgacgccaaccccacccagctctgccggtcccgcgctgcgctgggcaagccagtgaaggggcttggcctgcggatgggccgggagcgcgcatgccagcggatcatcacgtgccaggcggcgagcagcatccccgccgaccgcgtgcccgacatggagaagcggaagctgatgaacctcctcctcctgggcgccatatcgctgcccaccgacggaatggtcgatccctacggcgccttgttccgacccgctggctcccggaacggcggcggcggtacctacgccaaggacatgctgggcaacgacatcacggtggaggagtggctcaacacgcacggtcccaacgaccgaacgcttgcgcaggggctgaagggggaccccacgtacctggtggcggagcaggac

SEQ ID NO: 22774 - DNA, 330 bp, Zea mays
  Clone ID: cC-zmle1890014g06d1
ctaatttttgctcagccgctcgagcaggcaagcagaccggccgccgcagctgctgcagtgctgcccagccgctcgagcaggcagctccggccagccgcacgagagcaggccgcccagctccggctccggccaaccgcacgagagcaggccgcccagctccgcctccggccaaccgcacgagagcaggccgcccagctccggccagacgcacgagcagcaagcaggccgcccagctcggccagccgctcgagcagccagcagcacgagcagccagccgcacgaccagtgcacagcagagagcagaccacaccggcaagcagaccagcagct

SEQ ID NO: 22775 - DNA, 294 bp, Zea mays
  Clone ID: cC-zmle1890014g07d1
ggtcccggcagatgagcaaattggctccacgagaactggcatatgtgagaaccatacgcaagatttttctcggtgataactactactaacaactgtctctgttccaattacaaatcttaagaaattataagatgttttggtttttctagagacattataaatttatttagatatagtgtatatctaagtgcttaagttagctttaatgatgacttatgggttacattaaagtatattattttatattttaatagaggagagagaagctagctcttaatcaagagctaagtttat

SEQ ID NO: 22776 - DNA, 192 bp, Zea mays
  Clone ID: cC-zmle1890014g09d1
gacgcgccttgtagtggctcattaaacgcggtgggggggggggttccccccagcgggaccgatacacttgctagcgccatagcggcccgctcctttcgttatcctgccttcttttatcgccaaggttcgcgggttttccccgttaagctttaaatggggggcttcctctagggttcctattaatggtttatg

SEQ ID NO: 22777 - DNA, 199 bp, Zea mays
  Clone ID: cC-zmle1890014g10d1
gacccccccttgagcggcgcataaaccgccgcgggtgtgggggtcccccccctggggacccttaacttggccaggccccataggccccctcctttagttttttcactttctctttatccacccttgccggttttcccgaaaactttaaacggggccccctttggggttccaataaaggcttaccgccctttcccccaaa

SEQ ID NO: 22778 - DNA, 481 bp, Zea mays
  Clone ID: cC-zmle1890014g11d1
cgcgtacgcggacgcgtgggccaccagctgccattgccatctactgacctgtgacctttgcatttccaaacagcccgagcgagctagaggtagcatagcggcaggcacctccctcctcaaggaacatggcccgcacgcagcagttggcagtagtggcgaccgccgtggtggccttggtgctgctggcggcggcgacctcggaggcggccatcagctgcgggcaggtggcgtcggccatcgcgccctgcatctcctacgcgcgcggccagggctcggggccctccgccggctgctgcagcggcgtcaggagccttaacaacgccgtccgcaccaccgtcgaccgccgcgccgcctgcaactgcctcaagaacgccgtcgccggcgttagcggcctcaacgccgccagcattccctccaagtgcggcgtgagcatcccctacaccatcagcacctccaccgactgcttcagggtgaactgaac

SEQ ID NO: 22779 - DNA, 440 bp, Zea mays
  Clone ID: cC-zmle1890014g12d1
cccacgcgtccgcgacagggaacgtgttgttgaggctagagatgagctccacaggatgctgaatgaggatgagctgcgtgacgctgtgctgcttgtatttgcaaacaaacaagatcttcccaatgctatgaatgctgctgaaattactgacaagcttggtctgcattccctgcgacagcggcactggtacatccagagcacttgtgctacatctggtgaagggttgtatgaggggcttgactggctttccagcaacatctccagcaagtcttgaagcttttcggcagggctcctagcgagaggatgtctgaacaacttatggctgctttttttttacatattattactaagacacaagctacagcagatatagtacttgtgaaaaaaagaaacttctgagctcttttgagggattgatactagattggattgtgttaaaa

SEQ ID NO: 22780 - DNA, 373 bp, Zea mays
  Clone ID: cC-zmle1890014h01d1
ctactcctactcgtactagctagcagagagggagacgacggcggtggttagatcccattcccccacggcacggcgagaggtacgaggaggaggtacagatgtcggccgccactggttacagccggttcctgcggcagtacatgagagagccgcagcggcatcagctggtggaggcggaggagacggactccggccggaccatgcagctgttccccacgcgcgccggcggcggcacgtcgtcgtcgtcgcatgaacagtcagatgatggtgcgcaggcggccaacaaggcaacgctgagcattttctacgagggccggatgtttgggttcgaggagttcccggccgacaaggccaagggccttttccacttggc

SEQ ID NO: 22781 - DNA, 437 bp, Zea mays
  Clone ID: cC-zmle1890014h02d1
ctactcctacttgtactagctagcagagagggagacgacggcggcggttagatcccattcccccacggcacggcgagaggtacgaggaggaggtacagatgtcggccgccactggttacagtcggttcctgcggcagtacatgagagagccgcagcggcatcagctggtggaggcggaggagacggactccggccggaccatgcagctgttccccacgcgcgccggcggcggtacgtcgttgtcgtcgcatgaacagtctgatgatggtgcgcaggcggccaacaaggcaacgctgagcatcttctacgagggccggatgctcgtgttcgaggagttcccggccgacaaggccaaggcgctgatgcagatggccgccgggtcgtcgggctcctcgtcggcggcggcgcccaataacaaggacgccccactaccaatg

SEQ ID NO: 22782 - DNA, 359 bp, Zea mays
  Clone ID: cC-zmle1890014h03d1
cccacgcgtccggaggaggaatacgatccatcgctggtgagctgatatggactggaagacaaacattgaaaccttaagttcctttctggatcagtttgtgtgtgttaatctatctggagggtacagattcgggccgtgttgcaatgcatgcatggtctgaagggagcgagggctgaggagtgactggtatgtacattagctgaaggggaggttaagggtagagatcgtttgatcagtatcatctgtatatccccatgcatggggtttcgttttgtgcgcttacttctggcttgccagcgtatggttcaatgtgggaacaccatgtttagtacgagaactaatagacttatattaatttt

SEQ ID NO: 22783 - DNA, 515 bp, Zea mays
  Clone ID: cC-zmle1890014h05d1
caacaagcagatcaaaggaaacaagagggagatcatacagcttggtgtaccgttatttcaacctaccacagaggatgctaattgtcacacagaaccaatcccccttgtcctgcaggctgtcattgaccaccttgttctttggcgtttaataccagaaagcaggaaaccaaatagtgtcgtcatcaacttcttcgatgaggatgaacattcgcagccctacttcaagcctccccatcttgacaaccccatttgcactcttctgctgtctgaaaccacgatggcatttggcaggtcacttgtcactgacagcaacgtgccgacatggcgcgacatgtggtgtgcccgtcgtccaaccggcgcgtgagcatcacgttcgcaagggtgaggccatcgacgccggtggacatgagcccactcccgtcccccaccaaggccatgacaccctggcagccgcagccggtcacggcctcccaggtgccgtcgcccgtgagcatgacgcagaagcccccgtcagc

SEQ ID NO: 22784 - DNA, 534 bp, Zea mays
  Clone ID: cC-zmle1890014h07d1
cccacgcgtccgcatttttttttgcttgttgtgtccttcctggtacctgatatctgaggctcgtggtggctcactgtagcctcgctacacagttttcttctcctctcctctcctctcctgtgctatttgctgtttctcctaagattctttaggccgtgcttatccgtgctggagctgaacgaagcagcaggttgctgctgctgctgctgccctcgtgccctggtggtggactggtatcggtactcgtacttgcgtcgttttattacactctctatcttcgccggtgaggttccggccgttcggtacaggtagtttatttcaaacgctcgttttatttcttgttatactatattcttctgcttcctgttcgtaccggtggcttgtgcctttgcggtggcgctcctggatctggatgcagcgagcgcccgtcagcttttcttcccccggcacctggcagattcgcgtcatgctggctgagcgcttgacccctcgcgcttggcgccgtcgcctgcaggccagtgcgaggacttctgc

SEQ ID NO: 22785 - DNA, 273 bp, Zea mays
  Clone ID: cC-zmle1890014h08d1
gtaccgacagacagccatgggcgcatgacagagatgatctgaatggagaatttttttccactcattatagtcgggtggggagaaatctaagcagaagcaaatgaattttgcattatttctccccccattgccaaattgccattgatttggtggtccgaacaggtaaaatttgatttttgactaggggcaagactgtgaggaactgaatgggtgtaaataatttgttatatacaaaaatcaatggaatataatcattatagagttctctggatc

SEQ ID NO: 22786 - DNA, 580 bp, Zea mays
  Clone ID: cC-zmle1890014h09d1
gggtctaccacgcgtccgcccagactcaccatggagacagggagagtagggggaaatatcatttagtatacaacgaggaactatcaaagaaagagggatggctcccataataaaaatcgcctaatacgccattcatcttctccgcccgggtttcagaacgtgcggtagtttatccaggatggtggcgatcgagaaccaaaaccagagccaggccgcggtggcggtggcggctgaggcggtgccggcgccggcgtcgcggatccccagggaggcgcggcgcctgctgcacgagctggcggaggcgtgggcggacgtggacgactgccgcgcgctggaggttgtgctcgctcaagggggccatgaccaacgaggtctaccaggcgcgctggctcactgcaggccctgtcggccagaaggaggagcccagggcggagagggaggtgaggaaggtgctcgttctgatttacggtaacggcgtcgacctctattttccaccgacagggccaggtgcgcaccttcgagtgcatgtccacgcccttggtcagggtccccgctttctcggccgtttccagaacggccg

SEQ ID NO: 22787 - DNA, 376 bp, Zea mays
  Clone ID: cC-zmle1890014h10d1
catacgctgcagactcaccagagcgacaggaatagtaggctaaaatcttattgattttcagcgaggaactagccaagaaagaaggatggctcccatatgaaaaatcgtcgaataccccattcatctttttcgtccggctttcacaacatgcggcagattagccacgacggtggcgatcgagaaccataaccagagccaggccgccgtggcgttggcggtagaggcggtgccggtgccggtgtcgcgtatccccagggaggcgccggcgcctgctgtaccatcatggtgttggtgtggacggacctcgcccactggcgcgtgctggaggccgtgcctctcaaggtggccatgaccaacgaggtctaccatgcgcgct

SEQ ID NO: 22788 - DNA, 573 bp, Zea mays
  Clone ID: cC-zmle1890014h11d1
cggagaagaggatcaggttcgttccaagggaagggagatgagggtcacgagagagagagagagagagagagcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctgcatattcacggcgctgtgctgcttctgctgctacgagacctgcgagtgctgcctcgactgcctctgctgctgctgcaactagccgggctagctccggaggacggtcgagacgcagcagatggaggtcgcctgatccgtctcttctacctacctatctacgatgattcagttcccgtttagtctggtggtgtgcaagtgcaaacataataacgcacgcatgtcgtagcgtttagtacaggagagagatgttttactctgtcagttgcagtttgagcattcgtaaacaaacaaccaaccaaccatggtctgaactcttgaaaaaaaaaaaaagggcgggccgtctagagatccaagcttacgta

SEQ ID NO: 22789 - DNA, 428 bp, Zea mays
  Clone ID: cC-zmle1890014h12d1
ctaaaagatagcctgtactcttattcttatgataaaaccatgtaatgaattgtttggctttgtgtggacgaagttggtgtattctagatggtactcttgaatcttgatgcttccctgctatgctagctgagcatgtcgaaccgctatgaatcagacaatacagtatcaatgttaccactcaaaaaaaaaaaaaaaaaaaaaaaaaaaataaaaaaaaaaaaaaaaaaaataaaaaataataaatattaaacataaaaacaaaataattataataacttaaaaaatatttgggggggccctttttaggggttccagtttattttcccctggtttgcaacgttaaaattcttataaagggtccccataaacaaaattacggggccgttgtttaaaacaccttgaatgggaaaaaccttgggttaccccaa

SEQ ID NO: 22790 - DNA, 298 bp, Zea mays
  Clone ID: cC-zmle1890015a01d1
cgacccacgcgaacgcccactcgttcgcccacgcgatcacggacgcatggtctttcgtatcgcaagctcacgccctgacgtcgggcacaggtgacatggcgaccatagccacaatggcgctgctgaagcccgccgccatggcacgtggcgcggtcggcgccgtacaccagaagaggtaagtctattttgctcgtccggacagggcttgcccgcaagaaggctgcgctgtccgtgtccgagttcgccacgctggtgggcgccttcctcgtggagctggagttgtcgcccaacgctgagc

SEQ ID NO: 22791 - DNA, 427 bp, Zea mays
  Clone ID: cC-zmle1890015a03d1
ataataaacacactccgaacaactttattgggtatgttttattacaaggcacaatggcacatacatacagggatacagctgcaatatacatgaacaccctttgtctcgctcctgctttatctatgcaactgctggcatgcatgcaaaagacgcctcgggagataagacccctgttattctgctagtacgtatgcatgcatgtgcacgatcgatgggcgcgatggtcatattatccgttggttcaatagtagggctggatcttccaacgctggttgtcgccctcgcaccacttttcagagcacgacgttggtgccgttacggacgccgaacggccaattgttaacgtggagggtgatcaagtagaggtaaatgttgttgaccatgcggacgcaagtgaagtccttgtcgacgttttgggtttttcttt

SEQ ID NO: 22792 - DNA, 594 bp, Zea mays
  Clone ID: cC-zmle1890015a04d1
ggaattcttgggtcgacccacccgtccgcccacgcgtccgcctgagcccgctcccagactcccagtccccttcgcattccgcaccgccgcctcgccatggaggcagctgccgccgccttcttgtcccctccccgcgtcgccctcgacgcccgcacactcttctccccgccccgttgcctccccgtctcgccctcatcccagctccgccttgctgctcggccccgcgcgctcgccggcgccaagccgcggttcctgagcccccatcgagaacccgccgtcgacggcggtcgcggcgccagggatgtcgtcgcgatggtggtgccgttcctgaggggggccgcgtgggagcagccaccgccggacttggcctcattcctatacaagaaccggatcgtgtacttggggatgtgcctcgttccgtcggtcacggagctcatgctcgccgagtttctctacctccagtatgacgacgccgagaagccaatctacatgtacatcaattccactggcaccaccaagaatggcgagatgttaggctatgaaacaaaagcttttgcagtatatgatgctatgaggtatgttaaagtccctatt

SEQ ID NO: 22793 - DNA, 373 bp, Zea mays
  Clone ID: cC-zmle1890015a05a1
ggcagcatcaagcagtttgctcggtttgaaacatattttctcaattgaaattgttaagtcaccaacaaaatggagcgacgaccattcgaccaggtagccaacaccaatacaattatcggtcatcaaatccatttgggcccaccagctttttaaaacaaaacaagagtaacacctgttttgcttacaatgatccaataaataacaggggaatcagacccttcttatgaactcctcatgtttgaggcgagggcttcatgttatcattcggccctcctttccccacacctttgtcttcggagctgggggcagctttgttatcctcatcggcctcctcagcagtaggggatccagtccttataagctccttaacctt

SEQ ID NO: 22794 - DNA, 574 bp, Zea mays
  Clone ID: cC-zmle1890015a05d1
gtacggcgactgtccaggctgaagctatcttaacagccttaaatggtgttgcttcttcaagcattagcatttcaaaggaggatggttggggatcgtcagatgatgatacagatgccatagaacaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattggatcattgtatgcaatacaggtgttactcttgttttgttttgaaatgctggtgtgccaaaaggatttggtggaccgttattggattgggggtggcttcctgggtcgatggggccgcccttcctttttgtgggtgaccttaacattttcaattgagaaaatattgtttcaaacccgagcaaactgcttggtgct

SEQ ID NO: 22795 - DNA, 335 bp, Zea mays
  Clone ID: cC-zmle1890015a06a1
cataataatcatatatttacatgttatggaataaaaggagaaacaataattcaaaaataaattttttaacatgaaattatcaaagcataaaaataaaatgtggtaaatggatttccatatcacagaaaaaaaaagaaaattctcagccaaaaatatgcgagtcaaaaacaggtttgaattgaagataatttgttaatatcttaaaagtaaaaacaaacctaaaaaaaacaagagagtctcaaacttgactaatcaaagtttgaataataaagtaatgaagtatttacagtattcacatccctgattggaaaaaatttaggcttcaaccgttgttt

SEQ ID NO: 22796 - DNA, 489 bp, Zea mays
  Clone ID: cC-zmle1890015a06d1
cgcgtccggcggttttttaacaataaaatatatcagaatttttatcaaaattgaacatttcgatttttaaattttgtttatacgtttttgaattatcttcttaaaatgccagtttaaagaacttttttcaggaacaaaatgagtaaacttgggttttaagaagttgagaaatggtttaaaatttttgatcgaaaatgttcagaatattgttatttttggttttttcgattctaaaccatgctgatggagacgtacaagtcttcacgagatttatatatgacgatccacttctcgtcgatgaaattgaagacatcccggctatttttggcgatgatattccacagggaggagtgattgtaagttatcttactgaaatccctaatagaaacaaccagggttgccatttttttaggcaaattttgtgtatgcaagcccaaagtttgcatgcacaactatagcgccttcgtcgacatgaattcaactggagca

SEQ ID NO: 22797 - DNA, 368 bp, Zea mays
  Clone ID: cC-zmle1890015a07a1
aaaaaaaaaaaccgcttttttggtcccgacatcccggccaccttttacgctaacagaaccaagggggggcggcgggggtaaatccaataattggcgtcggaacgtcccgggttgggccgagaacccccccgtttttttaccaactttttcaaagaaaaacgaaaaaaatccctttggcctttattaagcccccaaattttttacctggccaagcggggggccttatacctggggtttgaaaccttttaccccccgggcaagatcagggggggacttttccaagaagccaccgaagtcgggattttaggggaaagggttccggggccccagagcaaaatttttttggcgggttccctcctaagcccagg

SEQ ID NO: 22798 - DNA, 569 bp, Zea mays
  Clone ID: cC-zmle1890015a07d1
gtccgacgagaattaccgatttggatgtaactgagggtgatcttccattgtggtgtgtggactgcattactctcaatcgagatccagaggagaatacaaaatgcgggttttatttacaccctgctgaaggctcgcctgcaccaaacataactcaagggaagcttagtgctccacggatattgcgaattcacaaggtagctaactatgtggttgagaaactcgttcttgacaaaccattggatggaggctctgatgcgtttgttatgggattgagttctgctcaatcacagctctcagttctagatagttcttcgcggcttggactaaagccatggcaaaaaacaaagccatgtattgagatattgtgcaataaccaggttctatcaccagagatgagtttggcttctgtgcgaacatatatatggaaaaagccagaagatttgattcttcattacagagtggtccaaccgagatgatcacggcttcagatcacatggttctcagcatgcctgcaccataaacggggtggtgaagacacccttggcttagcgaggaaaccggcagaaata

SEQ ID NO: 22799 - DNA, 414 bp, Zea mays
  Clone ID: cC-zmle1890015a08a1
aaaaaaaaaaaacagactttggtggccccgaaaacccgggccgcgcgctaagctaaaaaaacccagggggagccgccgggaccaaacaaaagatggccaccagcacaagcaggaaaaaagcagaaaccaccgcggattatgacacccgtgcccaaaaaaaacccgaaaaaccccgttgggccctaattgggcgccccataatttggcctggcccggcgggagggccctatacccgggccaaggaacaccgtaccccccggggtgggacgggaagggacttccccaggaagccaccggagtcgggaatttaggaaaaagggccccggggcccacaaacaaaaaaaataggaggggctgccccataaaccaaggggggtttaaaccccccggatgaggggcacggcttccgaaaac

SEQ ID NO: 22800 - DNA, 475 bp, Zea mays
  Clone ID: cC-zmle1890015a08d1
gggtcgatcccacgcgtccgcggacgcgtgggagctagattcggactgtgatgagaagcacgtttgggtgtttgattcaccttatactccgacgatcatctttatggcggacacaagagaggagcaaaatggggtgtgggtcaggctgagcgtctctgctgctgatgcatgatctttacatgtgtggcacttgagagtcaattcagatcgttggtaccccattggccgttagatcattgctatactggctggtgcacagcatttccagtgcgagagttagatgtcttggttaaccccccatgcgtattggatggctgggccagtggacttggctttggcttttttgttgttcctactggcaaacacgtcttgggcaccagcgtcttgctcgccctataccggcaacattgagaaaacagacggtgcgaaccgagatatggtctctcttttcttgggtgcttattattatcagggg

SEQ ID NO: 22801 - DNA, 293 bp, Zea mays
  Clone ID: cC-zmle1890015a09a1
gcagcaccaagaagcaccattttttccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctttggactagggtaaacattacgggagcgaacaggataacttggccgggcgggccccaccggtcagttcctccagtttcc

SEQ ID NO: 22802 - DNA, 475 bp, Zea mays
  Clone ID: cC-zmle1890015a09d1
aaccacccgtgcggttggcttctcctccccctccggttcgggttcgggttcgtgattgtctccggggttcgggttcgtgggtgagcggatcgagatggcggcgtcagatggtgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgctgaacgccatcgagggcatgaacggcaaggagctggacggccgcaacatcaccgtcaacgaggcccagtcccgcggcggtcgaggaggcggcggcggtgggtacagaggtggtcgtggatgcggcggctacagcggtggcggtcgctgtgatggcggtggcggctacagcggtggcggcagcttcggtggcggc

SEQ ID NO: 22803 - DNA, 296 bp, Zea mays
  Clone ID: cC-zmle1890015a10a1
ccatatgcgtggtaaccatgagatgcatttataatgattccgaaacctccaactgtacacagtgagccctaatgaacctccttttcttttattaacattgcacaggctttggggatttcacgtccctgtgagaaagatcatcttaccagttttcttttgtgtatacatgcatcttatcatggtttctattctatcaaatcactcagggcgatattgattacatgtaaataagccaattaaacttggggaggaaaccacgggttttattaaccaaaagtgaaaaaccaaagtggccc

SEQ ID NO: 22804 - DNA, 310 bp, Zea mays
  Clone ID: cC-zmle1890015a10d1
cactttggctattaactcttttttatttgttacccttggttgcatctccatggtggattgggttatttacatgtaaccaatacccccttgagtgatttgatagaataaaaaccatgataagatgcctgtatacacaaaataaaactggctagatgatctttctcacagggacgtgaaatccccacagcctgtgcaatgttaataaaataacaggaggatcattagggctcactgggtacagttggaggtttctgaatcagtataaatgcatctcatgcttattacgcatatggaaactatacaaacattt

SEQ ID NO: 22805 - DNA, 354 bp, Zea mays
  Clone ID: cC-zmle1890015a11a1
gatgcatccaacaaggtaaaaaatcgaacaggttacatcccaatccatccatgtgcagagcagaggaattacatttatacacggtgctgatcaccgctggagtgaaatgaaacaaggaccacacgactctacataccatgcagctagagaggaggatcggcaggagctatatatacgcatctttgatgatatctacttgaagaagtaggggaggtcgagcacgtagaggagaaagtaggcccagagcacgccggagatgccgccgaagaagaatcccccggtgaacttggcccagccgtcggaggtctgcagcttgtcggcctccttcttcctgccggtgagcgtgaacgtggg

SEQ ID NO: 22806 - DNA, 397 bp, Zea mays
  Clone ID: cC-zmle1890015a11d1
ggtcgacccacccgtgcgctcagctagtacctaccggccagtagtcgtcgcgtttgcaggcttatctgagttagccggcggatccgatccgggcgcgtgctgctgtgtgtgtgtcggtggagatggccacagcttacgctcccatggcgagccaggtgatgaagagcagcctcttcgtgcactcgaggccgaggggcctgtcaggcgctgctgcgctcacaaggcggcccggcctgttcaccgtcaaggccatccagcccgaaaaggcaacgtgccaagtggggcagcccatcaacggcgacccgttcatcggtagcctggagacgccggtgaccttcagcccgctcgtggcgtggtacctttgcaaacttccggactaccgcaccgacgtgagccc

SEQ ID NO: 22807 - DNA, 448 bp, Zea mays
  Clone ID: cC-zmle1890015a12a1
ttttagatcacaaggcggtcatattattattcatcatataagatatagtacataaaaagctcagcgttaggaatgaaaagtggtagaaaatgatattgcttattacattcacattgggcgattgatccggtatatatatgtagatgcagaaaacagatatatagtactcgacgcattcacattgctcgggtgcatatcggtaggtacgtagtagtatagtatagtatatatatttatgatgatgcaggagtcggcgggccggtagaattgccgtagccctagtttttcactttttccatgtgaggaactctcctgagacaaagtcgtagtgggcgccgatcagcttgagggtcccatttgcaagcccttccttgacgaaggggtaggtctttgaggttctccagggacacgttcacggccttcttctcgagaatggagcacttggtca

SEQ ID NO: 22808 - DNA, 490 bp, Zea mays
  Clone ID: cC-zmle1890015a12d1
attggccacagctgctgcggtggcatcagggcgcttttctccctcaaggacggcgcgcccgacaactggcacttggtggaggactgggtcaggatcggcagccctgccaagaacaaggtgaagaaagagcacgcatcggtgccgttcgatgaccagtgctccatcctggagaaggaggccgtgaacgtgtcgctccagaacctcaagagctaccccttcgtcaaggaagggctggccggcgggacgctcaagctggttggcgcccactacgacttcgtcaaagggcagttcgtcacatgggagcctccccaggacgccatcgagcgcttgacgagcgggttccagcagtttaaggtcaatgtctatgacaagaagccggagcttttcgggcctcttaagtccggccaggccctcaagtacatggtgttcgcttgctccgactcccgtgtgtgcccattggtgaccctgggcctgcagcccggcgaggcct

SEQ ID NO: 22809 - DNA, 374 bp, Zea mays
  Clone ID: cC-zmle1890015b01d1
cttctgggcttttatctcctcagatgacaataacacgctgtgggatcgtttcgtgctatcgtggcagtctggaagcgtctcttattttttcttctttctgttcgatccagttgtacccgaccaatccaatacaagtctctcccttcaccccaaagggacgagagagagagagagaggtcctctatggccgggcctgctgtccacccttttctcggcagccggccggtgctctgaactcccgagccggttctttatcagccacgtagcgcgccggctcagagaaggagctttttaatctgtgcttgcatcggtcccagaaaatgcgggatatctcttcgttgctgcaggtcctggcccggtcactttggtgggga

SEQ ID NO: 22810 - DNA, 502 bp, Zea mays
  Clone ID: cC-zmle1890015b02d1
atcgccaccgctctccgcaccgaatcgaagaaagcggcgatggtggcggagaagccggctccggtgcgcgtgctgtactgcggcgtctgcggcctcccggccgagtactgcgagttcggccccgacttccagcgctgcaagccctggctgcgggcgcacgcgcccggcgtctaccccgacgacctcgtcgccggtccctcctcgtccggcggtgcgggtggcgacagggacgtcgacaaggtcggggagcgcctccagggcgtcgggatctccgacggctccagcagcgccgcaggggatgcttccgcctctaagcccgaagaggtcaaacgcctgcctggtggtaagctcaagaaaaaggaaaagcaagaggttgtcatcgagaagattgtccgcaacaagcgcaaatgtgttactgtggtgaagggacttgaattgtttggtgtaaagctgagtgatgctttaaagaagcttgggaagaaagttgcaaccggaacttctg

SEQ ID NO: 22811 - DNA, 360 bp, Zea mays
  Clone ID: cC-zmle1890015b03d1
gaattatcggggcgaaccacccgtccggggcggtgccgagcctgtaccagtacgacgactcaggccagatttatactgctagagcgatcgcccacgggaaggggctccagttgttgttccttctgcaatttctgcttccttcttctcggcttcgcaacatgcaatcgctgtatatgatggaagaacactctgttactgggcatgtagcgcggtttccacgcatgcaagtaatgtagaagcctgctatggtaggtatttccatacacgttcattacttgtatgcatttgaatctttactggcacgaaggatattgcaatgccctttttccgggcatgaataagaaaaaggaaatatgctta

SEQ ID NO: 22812 - DNA, 546 bp, Zea mays
  Clone ID: cC-zmle1890015b04d1
acccgtgcggaaaaccctatagtattggcaacaggacaagtggaacggctttttctctgttaagtggcacattgtgaaggacgggcccaataatattctcaagcacatcatcctggagaacaatgagaacaagcctgtcacaaacagccgtgacactcaggagatacgcctcgaacaaggccttcagatgctcaagatattcaaggatcatgtcagcaagacttccatcctcgacgactttgccttctacgagagccgccagaagttgatgcaggataagaggtcgaaacagcagcagctccaaaagcaggtctgggacactaggacccccgtttctgtcaccggtgagcgaccgcaggaacctgctaatgggaagcccaatccgtccgtaccagatggtgtcacggcagaggtgaaggcggtgaaggctcccgcagagaacgggaatactgctcctgttgttcctatgcagcaaagggggccagacagcaccagagaaacccgtcctctcaaggagttgccaaacccggtaacttgatcgtgcaa

SEQ ID NO: 22813 - DNA, 394 bp, Zea mays
  Clone ID: cC-zmle1890015b05a1
ttttggctatcaaaatactagtagtgcataatataatatagtaatccggtccataacaacgccggcaggacctgtcttcggtgacaatacagctttcatcataaactaaaaaggtcccggcgcaaaaactatttacaaaaatgcccgtcgtcgacgtcgtctgtcggaggagagcgtctctcagcttagtagtaccgaattttcctcgagaaaaaggagaagaaagaactaagaagacagacagtcattaaaagcttcgacgactaggcttccgcctccgtcggcggtgagcagttcaggtcgagatcgaacgcggcgggcttcctcgccgacacagcggccggtggcgacggcgacagatccactaccgacgaacagtcggagtcgctctgcg

SEQ ID NO: 22814 - DNA, 398 bp, Zea mays
  Clone ID: cC-zmle1890015b05d1
gcccagagcgtactccgactgttcgtcggtagtggatctgtcgccttcgccactcggccgctgtgtcggcgaggaaggccgccgggttctatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttattggcccggattactatattatattatgcactactagtattttgatagccaaaa

SEQ ID NO: 22815 - DNA, 443 bp, Zea mays
  Clone ID: cC-zmle1890015b06a1
ggcaagaaagcaaatacattaccaggcataatatgtatcacatacaaaccataacgctaaactcccttctgcacacagctagccaaccactgttattctgtaaataggcacaccctaacatagatacactgatgcacaccactaagttcctgttctagaacctcaagactatcctgaagcgagtcacacctatacaatcttcgatgacagttttgttagtctgtttggaagcaccagagggggacttgatctgttctgctttctccactgatggactgagcaaaagaacaagacaccctcacacccctggcctgggaagaattaggcgggttcatttcaagaatccggctcggcggttccgtcgccgcagagctgctcaactcggcttacaatgtgcttgccgtatgtgtacttcctcaatgcttgcatgtggcccttgacac

SEQ ID NO: 22816 - DNA, 544 bp, Zea mays
  Clone ID: cC-zmle1890015b06d1
gcgtccgactttatgctggctcttgaagttatggaacttgaccagaaaatttatctagttcatgagcttgatggacatgttgtgagatgtgttcgtgatcaaaatggaaatcacgttatacaaaagtgcattgagtgtgtccctacagaacatattggttttgtagtatctgcttttcagggacaagttgctagcctttcaatgcacccatatggctgccgtgtaattcagagagttttggagcactgcggtggtacctcacaaagccagtgcatagtagatgagatattgcagtcggcgtgcgtccttgcgcaagatcagtatggcaactatgttacacagcatgttctagaaagaggaaatgctcatgagaggagccaaattattattaaattggctgggcaggttgttaccatgagccaaaataaatttgcatcaaatgtgatagagaagtgttttcaacatggtgatatggcggagcgggatctcttgatcaggcatattgtggagcagacagagggcaatgacaatttgctggcaatga

SEQ ID NO: 22817 - DNA, 411 bp, Zea mays
  Clone ID: cC-zmle1890015b07a1
ggcccttattttttatttttgcaactccataatgttaaaaaggttataatacaatgtcaagaaaagacctaaagctcacatactcagcaggcctctctagctagtttaccatgcagtttgcaggttgcagctcaccaacatactagggttaaccgtcaataacaaatagaacgaatgttctagaccatacaacaaccaacgccggatccaaccaagggtccgcgactatctcatctcatctcatctcatctttcccctgtccggaggtgaaagctagcagaagataccggactccgccagcgaaggcgcatggccttccttcacgcatgcccatggcgttcccatgacgacggggccagatatgggagcatagttgttttctctactggcctgttttcgcacgcttcatgc

SEQ ID NO: 22818 - DNA, 617 bp, Zea mays
  unsure at all n locations
  Clone ID: cC-zmle1890015b07d1
gggtcgtcccacgcgtccgaatgttcatggttcctctgcaatataatctattacttctacaatattttgcaatggacttgtagcctggcttacctaacattcccttgccacgcataatttttgttctatctctatttgatcctgctgagcacacagatgttttattgctctgttttttcctattcatttcctgtttctgcttcattgcaacaacctttacctacgtggcttcatgatttttcaaggaggacaaactacggggaaaaccgggctatgagcacctgagtgatccgctgcatatcttgatagaggccgagttccctgccagtatcatcgatgcaaggctgagacaagcacaggagattatagaagaattgcttaaaccagtggtgagtgatttctgatttgtatgaattcaattactctgtatgcgcatcatcttcatatatctatatctgctagattattgtatgacaccccttcctgttgctcactggaacatgtttgtacctcaacttgngagatatttttgtacggctaggccttattctaagaaaacatcaatttaaatgtgggacaaagagttcaaggtaatgaaaatttgatattctgttgac

SEQ ID NO: 22819 - DNA, 551 bp, Zea mays
  Clone ID: cC-zmle1890015b08a1
atcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgctggcacatcgctgctggcgagttgggcagtcgtcgtacgtgggaaacatggcttttggt

SEQ ID NO: 22820 - DNA, 341 bp, Zea mays
  Clone ID: cC-zmle1890015b09a1
ttttaagagcaacacggtccatcaaacaaccattcccacgctataatttttgtacatagggcaggatcctttcaattcatgagaagataggtcaacaaccgttacattacgacagccaccaccatgagcaaccggggctcttgatcggggcagaacgacgacgactgactacaaaccaatcactggggttcttcaatgtttcgacaagcctgacgaaccataaacacaaggaggggcggtgtttttttttcacgctttcttattgtgcccctatcgggcacgacgagcatgcttatgcacactagtcggttgtccagctctgctccacgatctcaggactt

SEQ ID NO: 22821 - DNA, 474 bp, Zea mays
  Clone ID: cC-zmle1890015b09d1
gagagagagacgcagggagcgtaccgtcgggaatttataccgtttctacgggatgaggctccggtcggctgaggtcaagatgttgacgccgcgccaggaagccgctgatgctgaacttgatgcgcctgcaaggggaccccaccgtcgggatcatgggactgctcgcagagaactacatgatgctctggaacgccggcttatcaaggccggatgattcgccgtgctacggcggcacgttaatactgaccttgaagtctacagactatgaccgagactagccagcaactgaaagataagtgtctacgatgcagcatgcatgtatatatgctggtggaagcatatgtgcgggtagtctacacaaccggtggagatctatatatgatgttgctgcacttttgacttatatccaagtcctgctgtgtgatccaaacccaaactcccctgcaaacttagaagcagtcagactggtcagcg

SEQ ID NO: 22822 - DNA, 477 bp, Zea mays
  Clone ID: cC-zmle1890015b11a1
acaggtgagtaaaatgtttatatactcttcagaaagaaaaatcgatccgcaaatgctcaaacaaaccagaaacacttctaacaagaaaaacgctcccaattacagcactgtgacaagattattaccgcatgctgtgccagcggctaatttgctgcttggatgggcaaaaaaacgagacaagtctgatacatacattttattcatcggtgagatgtaacatgcaagaaaaactatggaacaagaggccggaatgaaagtttgtgtaagcgcctcaactcattctaaaacactcttcaaaatttatgtgatgacggtgggggcagagcgtccagtgtactcttgcatcttggagagcttgagcgcaacatcaaccagcggagcagggcgtcctgtgaatccctgccggtctagaggagtccctttcgtactgctcgatgtagacacggatggtggcaccaacagaaccggttccagaga

SEQ ID NO: 22823 - DNA, 549 bp, Zea mays
  Clone ID: cC-zmle1890015b11d1
accaccgcttcctccgcgtcacccatctcgtcgtcgtctcacgtggcgaccagcggcggaccctccggggcgcagccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcaatcgtgaaagagttggtgcagatggatcaaaggctactggtgccttcatcttgacagcgagccataacccaagtggtcctaaagaggacttccggatcaaatacaacatggggaaatgtggggcctgctcctgaatctgttaccgaaagattttctttatac

SEQ ID NO: 22824 - DNA, 336 bp, Zea mays
  Clone ID: cC-zmle1890015b12a1
ggaccccgccccgggggggggggggggcacccagggaaaggcggagggggacccgggggggacaaggggaaaccaagagggggggggaaaaagggggggggggaaaaagggaaaaaaaaaatcaggggggaaaaaaaaaatgccaaaacaagggaaaaaaaaaaaaggggggggagaaaaaaaggggaaagggggggggggcaaagggggggaccggaaaacaaaagggggggggggcaaaagggaaaatccaaaaggggaaaaaaggggggacccggaaaaaaaaaaaaggggaacacccgggggaagagggggacgggaaaagggggacggggg

SEQ ID NO: 22825 - DNA, 293 bp, Zea mays
  Clone ID: cC-zmle1890015b12d1
gttcgacccacccgtccgcggacgcgtgggaaaaaaaacaaccaaaaaaaaaatttaaaaattttaaaaagaaaaaaaaaaaaaagggaaaaggggaacataataatactaaaaaaaactacaactatggttcacgggcggtcccttttgaacataccggtttgttccgcatattcgcccgcatttttcactatggggcaccctaaattcttgtactggtccgacgttttccaccctgtggcggtgcaccccccgctttcccccataataaccacggggccgccccccccctt

SEQ ID NO: 22826 - DNA, 520 bp, Zea mays
  Clone ID: cC-zmle1890015c01d1
catttccaagctcctcctcgcgattccaatccacgcacgccttctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgtggcagttcctcaagttgagcagaagactattgttgtgcagcccatgcttgtagctgaaaccagcgaggctgctgctgtaatccccaaggccaaggaaggcccagaccggtgcgcggcctgcaggaagcgtgttgggctgacgggatttagctgccgatgcgggaacatgtactgttcggtgcaaccgttctccgacaaacatgactgccgttcgacta

SEQ ID NO: 22827 - DNA, 307 bp, Zea mays
  Clone ID: cC-zmle1890015c04a1
gtccatagaccatacataattggcatattgcaaggaattacatgatagatccgaacctatatggacttgtgtgagccatgggaccttctgttacacagaacacagccgatagatcataagcagtttttcacagaacccagtttataatggcattctaatccaccgtaataggccgggtgcatgatgcatgaacatgatggctagcgagcccgatccttgaactaatcaaggttgatttgacttgcatgaacagcctgcaggttcacctgaaagccattgagcccactcttgaatttttggtttgagc

SEQ ID NO: 22828 - DNA, 330 bp, Zea mays
  Clone ID: cC-zmle1890015c04d1
cacccatcacactcagtcatcagttgattcactaggcagtaccattcagtggtttaaacttttgcactgcagaagaagttaggggcgcaggatcctctatatcctatggtccacctcatccacccaggggaacagcttgatgcgttatgtaagctttaaccataatttgccgattgggctaagaggcatgcaggtggaactgtgtgctactgaggcaagagaagataaccctcatgataacaatgatcagcatggatccgcctcaggatcatgcatcatggacacggcctaccactgtggattagaacgccatcatagactggaggctgc

SEQ ID NO: 22829 - DNA, 406 bp, Zea mays
  Clone ID: cC-zmle1890015c05a1
agtagcagtactgacattacattcattacgcgctggcaaaacatgcatatggagaaaagatagtacagtactacacataccaactagtcactcactactatatactaggagtgacggcacatatatcactcactccataacataggtcaaattaaacggcggagacaccagcagaacaagaacaacaatacacaaacacaagtatatatatagtgatgactagctataatagagcatgcgtgcgttttagataaccacaaggaccagcaaacatggcctcttcactgtccatccatctcgcccgatctagcggtggttgctcctggtctcgtcgctgtagagccagtcgtagacggtgggggagttgggctgcggccggtcgaagaggttggcgcccatgcccttg

SEQ ID NO: 22830 - DNA, 367 bp, Zea mays
  Clone ID: cC-zmle1890015c05d1
acgcgtgggcggacgcgtgggtgctagtgacggttgctctttatccgttcatcctggtggttttgtgagggggaaaggggcgagcgtatttagaagatgctggacaagctgtgggacgacgtggtggccgggcctcgcccggagacgggcctcgagaagctccgcaaggtcaccaccgcccgcccgctcgtgatcaacaaagacgcggacggcggctgctactagcgggcgcagtcgatgccgtcgaccccgacgacgccggtgacgccgtcgtcgtcgtcgtcgtcgacgacgccgtgcggcgccggcaccgtgtggcgcaacgtcttccacccggggagcaacctggccaccaagggcatgggcg

SEQ ID NO: 22831 - DNA, 357 bp, Zea mays
  Clone ID: cC-zmle1890015c07a1
acaaacaaacaaacaaacaggaaagaaataaggtgaattacaggacccttatgaggggcggggagggggaaaaaatcaccaacatccatttttattcaggcccaaaaaattaaaacaaaaccccaaattcgaaaaggtggacccaaccctaaactcaaacccattttttgggggggtggggagcccacaaaattggaaaaaaaaaggggggggcacaaaggccggggaaaacaaaaaaaaaatcaacaccccccgttgggccctgaattgccctaggcaccaccgtccattgcaaagaaaaaaaacgggatgcggccccgggggtcaacccgggaattccggacgggtcccgggggg

SEQ ID NO: 22832 - DNA, 376 bp, Zea mays
  Clone ID: cC-zmle1890015c07d1
gccgtctatggcactggcattgtactgtggtgcctagcgcttctcatcgcacaactgtgtgtcttgattttggttctgtttatcacggcattagtgccatgccgttttatgttacagtgttgtgtgctcgcaagcatccgaaaatatgcgtctgagtttagggttgggtcaaacttgtcgaatttggggttctgttataatatgttgagcatgaataaagatggatgctggtgactctgtcgccatcgccgtccatcatgagtgtcctgtaattcaacttatatctatcatgtatgtatgtatgtatgttaaaaaacccaactatactagagtgtaattatgtttattgcaaaggagggaattcgtggtaaatgat

SEQ ID NO: 22833 - DNA, 494 bp, Zea mays
  Clone ID: cC-zmle1890015c08a1
aagggttggggtctttttaagatggtgggggttggggaatgacaaaatgagaggggggagggaaaagaaaaaagagggagaagcggtggggaaaatggggggggcaaaaaaaaaaaaaagggccccgggccccggaagagggaccccccccggggggaaaaacccccgccggggggggaggaacaccccccccccaaagaggggggcccccccggcggggggggggggccccccccacccccgagggacccccccgggaacagggggggggggacaaaaaaaaagggggggcgggggccccccgggggggggggaaaggccccccccccccccccgggggaaaaaaaaggcgccccccgcccgaaaagggcaccccccgcgcattggtaacaaaaacacccccccggggggcccaggggagggcggggaaaaaaaaccccgcccacaaaagggcggggccccgcgggcacaaagggggggcccccccaacaaaa

SEQ ID NO: 22834 - DNA, 300 bp, Zea mays
  Clone ID: cC-zmle1890015c09a1
cgattacaaggacagatttattcaaaaaaggcagtagcatgcaacaactaatcgtatgtgccactgttctggattatttaccggaacccaacagcaaaacagcccatacaggcaagagtgcagcacagattaaaaaaagaaaggcacgtagcacctagtatcacattgtacactggttttgtgaacagcacaagcatacgtgtctaccatctgaaatccatcccataaatacacaaggccaaagttgaaccccaagagtggctgccgcgaacaccccttcaaactaatcgatcttgacat

SEQ ID NO: 22835 - DNA, 439 bp, Zea mays
  Clone ID: cC-zmle1890015c09d1
ccgatcgttctccatcaaggtcggtggccatggcttgctgccttcatcacctcctcctccttcccgggttacttgccttggctgctgctgctgcgcggcaggcgcacagttatggggaagcctgcgccgtgttcatcgttgcctcgtggcaccggtaccttcgggaccagcgagccgaccaccaggacgcttcaatgtcgttaaatgaagcttctgcgggcgattctgacttgcttggacttgcaccgtcaacatacctaccagctatttcttgtccgaagttggacaatgttctacttcctaatgcatttgatagaccgcgtgctgtttgcctcgtgcatattggtgggttcgatgtacctagctgcggatccgaaggcagctgcattttcaagaccaggattgcaggtgcaaacatcgctggttcagggctcacaga

SEQ ID NO: 22836 - DNA, 469 bp, Zea mays
  Clone ID: cC-zmle1890015c10a1
cgattacaatgacagatttattcagaaaaggcagtagcatgcaacaactaatcgtttgtgccactgttctggattatttaccggaacccaacaacaaaacagcccatacaggcaagagtgcagcacagattaaaaaaagaaaggcacgtagcacctagtatcacattgtacactggttttgtgaacagcacaagcatacgtctctaccatctgaaatccatcccataaatacacaaggccaaagttgaaccccaagagtggctgccgcgaacaccccttcaaactaatcgatcttgacattcgagtacaggagggtgtccctggtaagtggcatgtttcataagcaagcaaacccctatgagagttgaaacaagcaggatgatccctgtatccatgccaagctcttccgaacgagtaccacggaggctatatctgtagacctgcttgcttcttctagccggcttgaaat

SEQ ID NO: 22837 - DNA, 336 bp, Zea mays
  Clone ID: cC-zmle1890015c10d1
aaacacccggtcgaacacaaaaaataaattggggacaccatatatctcggccttcatcagatggggtggcataccgaggaaacggtcgtggatgctgctgctgcacgggatgcgcagagttatggggaatactgcgccgtattcatcgatgactcctcacaccgctacctgtgggaccagcagtccgaccacaacgacgggtgaaggtcgataaaggaaccgtctgcggccgttaatggactgattgccttaggaccggcgacatacttaccagctaaatatacacagaagccgaacaaagttcttcttactaatccatttgatacaccgagtgat

SEQ ID NO: 22838 - DNA, 264 bp, Zea mays
  Clone ID: cC-zmle1890015c11d1
tatccaccttactcaccatggggcatctgtatggatgatacaagaaaggtgcaaaaaggagtgtggatacggctagagcgtctctgctgctgatgcatggtcattacatgtgtggcacttgaaagttaattccgttcgttggtacgccattggtcgatcgtacattgctatactgatcggtgcacagcattttcagagcgagagttagaggatttggtaaaccccccctgtgtattggacgtttggaacaatgtacttggtttt

SEQ ID NO: 22839 - DNA, 478 bp, Zea mays
  Clone ID: cC-zmle1890015c12a1
aaccgaacaagcccttaccatttttccattcctcaggggagcatttttccattcctcaggtgaggatctcaaatttcaacatcaaccccgccgcgataaaccacaactgagaaaagaaactgaaggcaggaatagagaacatgatctactatgcgattcatacagcaaacatctaggacagcgagacgaaggtggaggtggatggcaagcgtagcagccgggcaaacgatcggaggatcaggacccatcagtagtcgtcgtcgccgccatagtcgtcgttgccgccatagtcgtcgtaaccacccccgtagccgccgccgccgccgccgtacgactcctccctctccaggttgtcctccacccgctccgacacgcgctccttgaacttgtcctccaggtagctcgccccgccggccagcgccagccctccgagcacgcccgccgccgagcccactggcagccccgtccccatccccat

SEQ ID NO: 22840 - DNA, 553 bp, Zea mays
  Clone ID: cC-zmle1890015d01d1
gaattttcgcgtcgacccacccgtccgcttgggtagtggcacctttggatgcgtgtatgaggccaccatttggcacactggagctctttgtgccatgaaagaggtgaatataattccagatgatgctaaatcagtcgagtctctgaagcaattggaacaggaaattaagtttgttagtcaatttaagcatgaaaatattgtgcagtactatggcagtgaaactatcgaagatagattctacatatacctgcagtatgttcatcctggttcaatccataagtttgttcatcaacactgtggatcgctgacagaagcagtcatccgttacttcacacgtcatattctcaagggtcttgctttttttacatagccaaaagactatgcatagggatattaaaggggcaaatttgttccttgatattaacggtgtactgaaattggctgacttcggaatggcaaagcattggagtactgcagctcctaatctttattgaagggaacaccctcctggatggctcctgaggttgatcgggctacactcgataaaagtgca

SEQ ID NO: 22841 - DNA, 566 bp, Zea mays
  Clone ID: cC-zmle1890015d02d1
ccggaattttcgggtggacccacccgtccgcccaccgttcccgtctctccgtcgcttccttggaagacgaatttaccctcctcctccaccaacccgatccagctgcatccgttgaggcccgtgcgtttcttccctgttctcccatcaatcgacctagccttacgccgaccaggggcttcctctaatcgatctggtgtctgttctgtggtcttggtctgggtgcactccagggccaggagcagctagccgtcttcgatcgatccgttcgcatccccaacgcagttcggtttgtaaggttggaaggagcgtgatggtcaagacaagctcgttcaagctggagcacccccttgagaagaggcaatctgaggctaaccgtttcagagagaagtaccctgacagaattccagtgactgttgagaaggctgagaggagtgatattcctgacatcgacaagaaaaagaacctcgtccctgcagatcttacagtcgggcagttcgtgtttgttgttaggaggagaatcagcctcatgctgagaaggctatctttatatatgtgaaaaacaccct

SEQ ID NO: 22842 - DNA, 585 bp, Zea mays
  Clone ID: cC-zmle1890015d03d1
ggaattttcgggtgcgacccacccgtccgcccacgcgttcgattgagaccaactagcaacatagaaagcacattagtgtaccaacaatggcagccaaaatatggggcttccttatgctccttggtctttctgcaagtgctgctaccgtaaccattttcccacaatgctcacaagctcctatagcttcctttcttcccccatacctttcaccagcggtgtctttagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaaccagcagttttttttcattcaaccaactggctgcattgaactctgctgcttatttgcaacaacaactaccattcagtcagctagctgctgcctacccccagcaatttcttccattcaaccaactggcagcattgaactttgctgcttattacaacatcaa

SEQ ID NO: 22843 - DNA, 498 bp, Zea mays
  Clone ID: cC-zmle1890015d04a1
atataatccttttttacctttttattaaatttttaaatatacaaaaattaaaaaatctaccccccctccaatcttgaaaaaaaaaaacccccccccctctaaacccccccccttaacaaaaaaaacaaaaccccacccccaacaatcccaaccccccaacaaaaaaaaaaccccccaaccaccccctttttaaatcctcccctttaaaccaccccccaaaacccctaaagcccccccccacccccccaaaaaagaaaaaaaaaattgtatccccaacgtccccacaattccccacaatatttttaaaaaccccccccccccaaaaaaattctcaaaaaaaaaaaagcaaaaaaccccccctggtccccccccccctggaacaacctttttactttccccaaacaaggcgcccaaaaatatatcataaaaaaaccccccctaaaccccccccctccggcgtgaccctttaaaataaaaaagccccccccaccccccccc

SEQ ID NO: 22844 - DNA, 480 bp, Zea mays
  Clone ID: cC-zmle1890015d05a1
ttttgataagaccagattaatcccagccaaaaacagcctgaataatcagagtacatacacgcgaaggaaggtaactcttgacattaactttatcgtcacattaaccttagcagcacaatgatatccgcaactcaacaattcagctacagaaatacaacgttgtcttctaataataataacacacactggttcgtcatcgtcgccggcgccttccaccgctggtacagaatgcccatgtgtaccccagcctccgacatcaaatttacaacctagtaacccaccccgcgcaccacccacaactagagcaaaaacgagtaaacatctaaaatcgaaggagcacgaaaccctagattcctgccaagaccaccgctctacttcttcgccttacgggacggcaccttccggacggggtcgcagccttcttggctggggcggccttcttggcaggggccttcttggccgcagcggcgggcttcttgg

SEQ ID NO: 22845 - DNA, 379 bp, Zea mays
  Clone ID: cC-zmle1890015d05d1
ccacgcgtacgcccacgcgtgggcggacgcgtgggcggacgcgtgggccgggattaaagcggtgcccgccaaggccgccaagacgtgagccagggacacgcccgggaagaaagcggcgcccgccaagaagcccgccgctgcggccaagaaggcccctgccaagaaggccgccccagccaagaaggctgcgaccccgtcgcggaaggtgccgtcccgtaaggcgaagaagtagagcggtggtcttggcaggaatctagggtttcgtgctccttcgattttagatgtttactcgtttttgctctaattgtgggtggtgcgcggggtgggttactaggttggaaatttgatgtcggaggctggggtacacatgggcattctg

SEQ ID NO: 22846 - DNA, 222 bp, Zea mays
  Clone ID: cC-zmle1890015d06a1
aaaaaaaaaagacttggtaataaaattacccaggggtcattctgcccatttaaaaatatgccccccccggcccagcagctaaattacaaaatcctggaattaaaagaaaaaaaagttttttaatttggatcccggggggggcgggcggggtccctgaagcgggattactcgaagggggccttgccggggaacttgacctcaaggggggggcccccggggttc

SEQ ID NO: 22847 - DNA, 358 bp, Zea mays
  Clone ID: cC-zmle1890015d07a1
aaactgcacgacaaagatagtacagttccattttatgacaggaaacatgacttcaatatgcactagatgaagagcacatgattatcagaacaagcaaatgaaaagcatggatggagtccagtaatttccattcttatttctcgtacaacaactcgattaaacaggaagtgatttggaactgtggaagttctgccccccgcttgcaggactcttgtttactggtcctccttgccataattggagatgatctcgatcccttgagggggagggggggtttcttgtgaatttagtgccgcctggtgcccatggaacaatgtagggatcggggtgctggaaagtcctgttctgagcctccgca

SEQ ID NO: 22848 - DNA, 549 bp, Zea mays
  Clone ID: cC-zmle1890015d07d1
acccagtcggccacgcgttctaggagcggcggctaggtctatggcgtcgtactttggggttctctgtcgcggcggtcggcgcagagggagcgggtgcgcctgctctaccgcagggcgctcaaggacacgctcaactgggccgtccaccggcaccttttctaccaggacgcgtcggatctccgggacaagttcgaggccaaccgacacgtggataacctggacgtggtcgataggctcattgacgatgcggtggctcagtacaggaacttccagcaccccgatccctacattgttccatgggcaccaggcggcactaaattcacaagaaacccccctccacctcaagggatcgagatcatctacaattatggcaaggaggaccaataaacaagagtcctgcatgcggggggcagaacttccacaggttcaaatcacttcctgtttaatcgagttggtgtacgagaaataagaatggaaaatactggactccatccatgcttctcatttgcttgttctgataatcatgtgctcttcatctcatgcatattg

SEQ ID NO: 22849 - DNA, 440 bp, Zea mays
  unsure at all n locations
  Clone ID: cC-zmle1890015d08a1
acaaatctatatggtatcatatatatgttccttgtaattgaagagcttaaatggaacaatccaattacagatacataatcacaccgacaataacatacatgacaactagccaagaagagttacacgatagggtgctcactacagaagcacaataggatgctgtccaaactctttgagatcatgtcctcattttctcaaagtatgcagcaagaacatttctgttgcaccttattctcctccctacgggcggtagatggttgcctagcagaagaggtaggtgacaacctatcgtcccttaccctgttgaagataccagggtacttttcacctgatgctgcatttgcatcatcccattcaccaaaggggtggtacagccactttttcaggctcataactaccgggcttaatcctgctccttccaggngtatgctggctatgcc

SEQ ID NO: 22850 - DNA, 444 bp, Zea mays
  Clone ID: cC-zmle1890015d08d1
gtgcggccatagccagcatacacctgtaaggagcaggatgaagcccgtttgttattagcctgaagaagtggctgtaccagcctttggtgaatgggatgatgcaaatgcagcatcaggtgaaaagtacactggtatcttcaacagggtaagggacgataggttgtcacctacctcttctgctaggcaaccatctaccgcccgtagggaggagaataaggtgcaacagaaatgttcttgctgcatactttgagaaaatgaggacatgatctcaaagagtttggacagcatcctattgtgcttctgtagtgagcaccctatcgtgtaactcttcttggctagttgtcatgtatgttattgtcggcgtgattatgtatctgtaattggattgttccatttaagctcttcaattacaaggaacatatatatgataccatattgatttgt

SEQ ID NO: 22851 - DNA, 207 bp, Zea mays
  Clone ID: cC-zmle1890015d09a1
aaaccccacattcttcaaccctattttttttcccccaaaccaatccccacgaccaccggccccccccgaacccaaccccccgtcccccgggccccccccaaacattccgtaccacaccctcataacaccccgccaaaaaccccccccaattccccccccgagaaaaattttttacccctcgaaccacccccccaaaatcgaccccca

SEQ ID NO: 22852 - DNA, 362 bp, Zea mays
  Clone ID: cC-zmle1890015d09d1
aaccacccgttcgcaaaaaaaaaataatataacaaccataaaagatttttactttctaacataaaaattaacaaggggggaagggggaattttataaaccatgaaacaacagccttaaaacatgatggctgctcctgtatttgacaccacattggatgagcctcaaggagcatcgccgtgcccactacgatgacttcctaaaggcctatgagcttgccaggactgcaacccttactgcgggagaggccgctgaggctcacacagctaccaccttgttcaaaaacacttgttttccgaaaggatgtctgctcaataacattaagccctcttctctaccaacaagagttcatattgaaggatat

SEQ ID NO: 22853 - DNA, 358 bp, Zea mays
  Clone ID: cC-zmle1890015d10a1
ggaacgcctttttttttttttttgacataaaaaattggaatataaatttatattagttggggggggacacatacggttaccaaaaacattttaccagggacccaaaaccaaaacaaaatctgaaagaggacccccacaaggatgtaaagatgggaagacgacacagggataaaaaaagaaaggggtacaaggggccaaaaaagaaaaaaggaaaaaaggcctgcgggggaacccccaaagtggggggggaagggccccaaaaattgtcggaaaaaaaaaaccacacctttggctacaaaaagggggaaaagggttggaaccacacggggcaaaaaaaaagaaggggacccagcgccca

SEQ ID NO: 22854 - DNA, 389 bp, Zea mays
  Clone ID: cC-zmle1890015d10d1
acccgtacgagaacttcgtccattgaaccaattggccgcactgatccccgctgtttatttgcagcagcaaatacggggaccatggagccagctagctgcagcaaaccgtgcttccttcttgacacagcaacagttgctgcctttctaccagcagtgtgcggctaaccccgcaaccctcttacaactacaacaattgttgccctttgtccaacttgctttgacagacccagcggcctcctaccaacaacacatcattggtggtgccctcttttagatggcttattaggtgtaattcaataataaagttttttggatgatgtatgtggccaaccagaaataagaagttacatttccagatttgaatgtgatattggtctccaagggtgttc

SEQ ID NO: 22855 - DNA, 439 bp, Zea mays
  unsure at all n locations
  Clone ID: cC-zmle1890015d11a1
gtacgggaatggagctctccttagtctttgttctcatgtacagtcgaaggaacacacaagcgtgctcagccaggcctggcctagccaagctttctacgtagtgcgtgcatcccatcccatcgaagaaataaaattacatcatcatgcgacgctgaaggaggaggcggccttctcgactcccttcctggcgcccttgaaccaccttttgtcgccggcctgcgccttgcagatgtagagcttgccgtcggagacgggggccgcgatgagctggtgcttgccgccctcgtcgccgtccgccgtcctggtgagcacggacacggggtagtactgcttgccgtcgatcacgggggtggagctcttcangacgttggcggtggccacggcgccggtctcgaacccgccctcggagtcggtcttgccgccgtaggcctgcctgccg

SEQ ID NO: 22856 - DNA, 434 bp, Zea mays
  Clone ID: cC-zmle1890015d11d1
cacccgtacgcgctaacgcgcccgtgctagcgcgagtggtggcatctcacgcattttcttctgcccccagtccggacgggggaggagccaagctatggcgtccacctcctgctgcctcctccaccagtgaaccgcccgcctcggcgcgtctccgggcctggccgacgccccgccgcgcatcgcccagctgatcgtctgcaaggcccggaagcaggacgccgtcgcggaccagagcgacgtctcgcgccgcgccgcgctcgcgctcctcaccggcgtcacggccgccgccggcgccaaggtgggtcccgccgccgcggtatacggagaagcatccaacgtgttcggcacgcccaaggcgagcacggagtacatcgcgtacatcggagacggcttcaacctgctgatcccgtccaagtggaaccccagcaaggagc

SEQ ID NO: 22857 - DNA, 509 bp, Zea mays
  Clone ID: cC-zmle1890015d12a1
attggatacatcatatattattctatatgacccacattaattaacaatgcacaacactgttatcagaaaggtaaaaggagcctttttcgttgacgaactattccaaaggctcaaaagaacatgcgcagctcaatttgaaatgaaaaactcctgatacaatctactaggaaaaaacatactcatacgacacagaaagaagaaacattagccgccatacaaagactgacacaagaggcttcatagttgctgcttcccacagggttgtcaaaggcagctgcttcctcccttctggattcctcgcccaccgaccgaccgacacccgccttacggtttcgccaccatcttggcagctgatgcacccggtgcctcacgccttttcacaggaggcaacttatcttggagacgcattatcggcgatattagcactctatcaccaactacgtgcctcagctcctttattaggtcgcatcggcttattttcttactcttaaactcttatagcaaccaat

SEQ ID NO: 22858 - DNA, 364 bp, Zea mays
  Clone ID: cC-zmle1890015d12d1
gacccacccgtacgagtgtctcctcaaattatggacatggttattggttgttatgatttgtttaagagtaagaaaataaggggatgcgagctaatataggagctgaggcacgtatttggtgatagagtgctaatatcgacgataatgcgtctccaagataagttgcctcctgtggagaggcgtgaggcaccgggtgcatcatctgccaagatggtggcgaaaccgtgaggccggtgtcggtcggtcggtgtgcgaggaatgcacaagggaggaagcagctgactttgacaaccctgtgggaagcagcaactatgaagcctcttgtgttcagtctttgtatggcaggctgatgctgcttctttat

SEQ ID NO: 22859 - DNA, 442 bp, Zea mays
  Clone ID: cC-zmle1890015e01d1
gataacccctccgaggaatgccaaatgatttatgaggttgcttatgctgagcaagggaaaatagattggtataggatctacacacctacttgtaagaagactttattgcaaaagcgcaaactaattaggggaataatgccctggctgtcgagaggatacgatccttgcaccgagctgaacataacgaaatactgcaacttgcccgaggtgctggacgcctttcatgccaatgttactgtaataccatacgcctgggtgggctgtagggacccaatatatgagtgctggatggattcgccgaggtccatgcttccgatctaccgtgacctcatctcggcatgcctaaggatatggggatttatcggctacaccgactttctcgcgcccctcacggggacgaggttctccattggcgcgctttctctgccaatgatcaccaagt

SEQ ID NO: 22860 - DNA, 51 bp, Zea mays
  Clone ID: cC-zmle1890015e02d1
gtcatgcgctcctatgaggaccattttaaaacacacttagcttatcgcact

SEQ ID NO: 22861 - DNA, 264 bp, Zea mays
  Clone ID: cC-zmle1890015e04d1
gtgatacgccctgccagtctgccagcctctccccgcctcgcgatcccgcaggtactgatgccctatgggtctaagttattatatactggtgaagtttaacacacggagcccactaatacttagaaggtgggtttacaaatgatagcgacagccgagcgactgccgtaataggcgctcagactaaggactcgcactcaaacagaccctatttatagctgacaaaaccttaccatctgccacctgcagccgtatctaaatttggct

SEQ ID NO: 22862 - DNA, 532 bp, Zea mays
  Clone ID: cC-zmle1890015e05a1
ttttaggtattagtattacgaagaagttttattcagggcacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggtgaccatggtggtggtggtggttggcgccggcgcgtgagaccgtgtcgacctcctcgaacttctccttgacgacgtgctgctggacgccgccggcgtggcggccgaagccggccggggccaacgacctcaccttcttcgagcagtagttcaccttctggtagttagccattggtgccgacgcttggtgtgtctgtgcgccacgcccgtgtgacgtctaaatgcttgtgtggat

SEQ ID NO: 22863 - DNA, 112 bp, Zea mays
  Clone ID: cC-zmle1890015e05d1
caggcacttcgaccctacacgggcgctgggcacagtttcaccattttggcggcaccaatggcttactagggccaggtggactactgctcccaggaggcgacgtctgtggccc

SEQ ID NO: 22864 - DNA, 496 bp, Zea mays
  Clone ID: cC-zmle1890015e06a1
acagataaatacactgacatacatttacaaaaaaaaagtacatattaactcgttttgtttacaaaataaagttaaacccaaaggaaatggacaaatgagaagaacccataggtttatcaggcttcagacacagaagaattttgttgttgttgttattgcgtgcagcagctcaaagttcagtgtcacagaacttcaccatcaggtcggaaaccatccttcgtgccaaaggaatgtagctcaaactatacctgaggtgcaaaaatatggagaatacagaagcataataaattggtttgttcagaaaattttgctcctactgtaaaatataccagtaatttgacgcaaacgagcagcacactgcttgctaagatcgagtttcagagtgccacagtaccaccatccagcaagactggcctagtggcctgtgcacattcattcaaaaaatgacaagaaggtatgacagtcacaagccataacctataaattcagttttaca

SEQ ID NO: 22865 - DNA, 383 bp, Zea mays
  Clone ID: cC-zmle1890015e06d1
ttgcgtatggggtatacaacagcctagatggaaggctctatgttttggtgacaaactgacagccccagggacatggacttgtccattaacctgttctctgaccactcatttatgcaagactcttatccatacacacattcggatcagctgttcagacacctgaccagatgcatgaactgctggctgcactgtgcgatatctgctgccaaatctgggccgtagttcgcatacaaatgctgatgcacttgccgttctacttgcaattatgtatgccttaatgtgactgttaatgtgactgttaaacatcatatgggacgtcaccctgaatgataccctatgagacatattaggagccaaataaactggcaattggaccggtacta

SEQ ID NO: 22866 - DNA, 193 bp, Zea mays
  Clone ID: cC-zmle1890015e07a1
tttttttttttttttttttttttttttttttttttttggtttttttttatttttttttttcttttttttttttttttattttttttttgagccccaaaaaatcttaaagaaaaacaccccccttattttcctcccaaaaaaagggggcccccccccggggggtataaataaaaaaacacccccttttttcccc

SEQ ID NO: 22867 - DNA, 388 bp, Zea mays
  Clone ID: cC-zmle1890015e07d1
gagagcagcacacactgctctctgctagctaggagcagcagcagcggaggggggggagtgtctacatgatctccccgtcagctctggcggtggcgcctcagggcctgccgccccttggccgacgcgcctcctccttcgccgtcgtctgctccaagaagaagatcaagaccgacaagccctacgggatagggggtggcctgaccgtcgacgtcgacgccaacgggagaaagggcaagggcaagggcgtgtaccagttcgtcgacaagtacggagcgaacgtcgacggatacagtccaatctacaacgaggatgactggtctcccaccggcgacgtctacgtgggtggaaccactgggctttggatctggggccgcaccctcgctgggat

SEQ ID NO: 22868 - DNA, 256 bp, Zea mays
  Clone ID: cC-zmle1890015e08a1
gagccactgaatatggattgaatgaatctggtcaatataaacagggattagactaaatgccaggcctatccgaacagcactacttgtttacacatcaaagcagcttgtggaacgggcattttgtttcccaaatccattcaatcgttcataacaaaatgggccggaagggccattccaagctgtgtagtacccatgcgaaccgtttttgttatccacccacacggccccgtagatctgaactaaagaaccccctgca

SEQ ID NO: 22869 - DNA, 548 bp, Zea mays
  Clone ID: cC-zmle1890015e08d1
gaggatttacccgtacgagcagagagagagggagccaagggaagctctcttctttcttccttttactcgtactctcgaattccgtctcttgggggtgatctgctcgctcggttcccccggttcttgagaggggaaataggaggcggagccgcggagagggatggggagggacgagaggtctcccagtgtgggaggccgcgctcggcgctggggtcgccgccgccttcgccgctgggctcgtcggggtttacctttccatgccggactccgactacaggtttctcaagctggcacgtgatctccaggaactccaaatcctcactggccatcttgagaactatactatcgactacaccctacaggtgttggtaggctactgcgccgtgtacatcttcatgcagaccttcatgatcccaggaacgatattcatgtcactgcttgctggtgctctgtttgggcatctccggggcgtggccctggtagtcttcgcgcgctctgctggcgcttcttggtgctatttcctggcgaagatgattgggaagccactg

SEQ ID NO: 22870 - DNA, 371 bp, Zea mays
  Clone ID: cC-zmle1890015e09a1
gggtgtggttttttttcataacaacgccggcaggacctgttttcggtgacaatacagttttttaatataaactaaaaaggtcccggcgcaaaaactatttacaaaaatgcctgttaagaaacaacaatgtcggaagagagcgtttctcagctaagaagaaccgaattttcctcgagaaaaaggagaagaaagaactcctaatacacacagccattaaaagcttcgacgactaggcttccgcctccaaaggaggagagcagttcaggtagagatcgaacgcggtgggcttcctcgccgacacagtggacggaggcgaccgcgacaaatccactaccgtctaacagtcggagtctctttgcgcggacgcgtgg

SEQ ID NO: 22871 - DNA, 405 bp, Zea mays
  Clone ID: cC-zmle1890015e09d1
atacggccaaccatttaccatcgactcagcgagcgagagcttttacacttctcatctagctaggagcatcatcggcggcgggggcgatttcagactccatgacctcctcgtcagctctggcggtggcgcctcatggcctgcctgcccttggtcgtcgcgccttctgcttcgccgtcgtctgctccaagaagaagatcaagaccgacaagccctacaggattgggggtggcctgaccgacgacttcgacgccaacgggagaaagggcaagggcgagggcgcgtaccagttcgtcgacaagtacggcgcgaacgtcgacggatacagcccaatctactacgaggatgactgggcgcccaccggcgacttttacgtcagttggaccactgggcgcttgaactggggcg

SEQ ID NO: 22872 - DNA, 470 bp, Zea mays
  Clone ID: cC-zmle1890015e10a1
ggtatcacacatacggcagccaagggggcagatttggttcgcaggcatgtctcaccaggtgaaaccgtcagttcccaaccaaatcacgcttatgcggttacaggcaagccaggcatcctacagctgggttacaaccaaatagcaattgagaacgaacttggtgacgaaactaacagaaatgaaaaggaagttgaggaggatgcaccaactatctatccagtatccagtaacattacataaccacaagaaagcaaaaatgagcttgacaaagaaaatccaattatccccaagaaaacatcgtccatagcagttgcagataataataaacatctaagcaggaagaccatcaaagaacttcatgtagtcattaagcttctctccatgcctgatcttaacgatcgaaccgtccgcttccacccagtattccggtggccttaacttcaggttgtaggtggaaagccatgctcatg

SEQ ID NO: 22873 - DNA, 422 bp, Zea mays
  Clone ID: cC-zmle1890015e11a1
gggggtgggtgtttttaattataatttcttacttttgatttttttgatttatacgatataaaacttacaaaaataaagcatgggcccccaaacggctacaacagaaggggggggggggggaaaaaaaaaacacgaaaagagggccaaaaaaaggaaaaaaaaaaaggagaagaaaacaaaaaaaacaaaaggggggagaaaaaaaaaaaaaaaaaaaagccgggggaaaaaacggggggggaaaaaaaaaaaaggggagcacaaactaaaaaaacaaaaaccaaaaaaaagaggggcgcgggaaaaaaaaaaacccccagaaagagaaacacacaaaaaaaaaaaaggggggggggcccccccgggaaaaaaaaaaagccgaaaaaccacacgaaaaccaccaaaaaaaaacccccccaaaa

SEQ ID NO: 22874 - DNA, 414 bp, Zea mays
  Clone ID: cC-zmle1890015e11d1
gggtcgacccacccgtacggggtttccatctaaactgcgatcgtagactttacttttgccgttttatgcatgctgcgctagtgaacgggacggggccgtggtctattacgcatacgcgcacgcagagctcttttttcaccgggatcctatccttgcgcgctgtcgctggcgccctatagtggagatggacactgtgttcgcgttcctgagtggcacttgctacccttatcctgactacatgggcactttaggccgggaggaccgtaatatgatggtgctatgactacgcggctttggaagattactgtcatggccgtgaatcattatattgcttgacaccggttttttcgccacgggcactgtgatctttctatctggttcgtgtttacccctttcttcttcatccactttgca

SEQ ID NO: 22875 - DNA, 424 bp, Zea mays
  Clone ID: cC-zmle1890015e12a1
gggaggggtaaaatttaaaaagtggtttggtcactttcttttatttcataaaaactttaattagtgaattaaaaccgaaaaagggaaccgaaaaaagggcacaaccaaagaaaaaaagaaaaaaagagggggggggggcggtgaaaggggggggggccaagggcaaaaaaagaaaaagagcgaaaagggaggaggaagaaaacgaaaaaaggaggggggaaccccccaaatggggggggggcaagagggggggggggttggaaaaaaaaagggggaaaaagggagaaaaattggggggtaaaaaaagggggggggggtcacccccccaaagcgggaaaaaggaagaaaccgagggggctgataaaaaaaaaaaaccccctgggagaaaggaagaaaaagaagggggaaaaaaacgggcgggaaa

SEQ ID NO: 22876 - DNA, 595 bp, Zea mays
  Clone ID: cC-zmle1890015e12d1
ggacgcgcccaccggtcggggaatccatgctcaacaatggagcaacattggcgattcatgatttcttccctgcttatgctccttggtgtatctgcatgtgttgctaacgcgacaatttttcctcaatgctgacaagctcctatagcttgccttcttcctccataccttccatcaatgatagctccagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctgtggcaaaccttcctccctactctcagcaacaacaatttgtaccattcaaccaactgtttacattgaaccgtgctgcttatttgcagcaacatctattaccattcacccagcttgctactgcctactctcaacagcaacaactatttgcatttaaccaagtggccgcactgaaccccgctgcttatttgcagcagcaaatactactaccatttatccagctagctgcag

SEQ ID NO: 22877 - DNA, 181 bp, Zea mays
  Clone ID: cC-zmle1890015f01d1
gactaagtgtcgcatcgcatgcttgccgtttatcttatccctatctaagctacctgtgatagcttaattttcactattgttcgaggtttttggcacgttatcggttgtcctgctggccaggctataagtctggtttatctgttatgtttactctttttaacatcttgtcgttattattcgt

SEQ ID NO: 22878 - DNA, 543 bp, Zea mays
  Clone ID: cC-zmle1890015f03d1
gaattttcggggcgacccacccgtccggtttgtccagttcggcctgtccaactcatccctggagctgcctttcatggacgactacctgcagctgcagcaggggtccgtttcctgcagagtgcgtgcgaggcgtggctgcgcgactcacccgcggagcattgccgagagggaaagaaggacgaggatcagcaagaggctgaagaagctgcaagaccttgtgcccaacatggacaagcaaacgaatacgttggacatgttggaccttgctgtggattacatcaaagagctcaaggaccaagtcgaggtacgtacgtatcgcttggtgtgcaaacaaaaataacactatctcttaccatgctaaaaataatactatctcttacctaggcaaaaataatactatctcttaccatgctaaaaaacatggatccttgcagaagctaaaacacgaccaagcaaactgctgttgcctaggcaacaagagctgttgctgatgctggagatgcagacggaggagggtttttaccccgtaactatgtgactgtt

SEQ ID NO: 22879 - DNA, 396 bp, Zea mays
  Clone ID: cC-zmle1890015f04a1
acctaaaatggcatttcactagctggtttgaagggggggtcatgatgcatccaaatcaaagtaaaaaaaaaattaacagttccaagttacatcccaatccatccatgtgcagaggaattgcatgtatccacgatgctcgtcactgctgaaatggcatacctttgcacgcagagaggaggatcggaggcggagctatattatatatatgcatctttatgaatttgtattctacttgaagtagtaggggaggtcgagcacgtagaggaggaagtatgcccagagcacgccggagataccaccgaagaagaaccctccggtgaacttggcccagccgtcggcggtctgcagcttgtcggcctccttctttcggccggtgagcgtgagcgtgggccccct

SEQ ID NO: 22880 - DNA, 323 bp, Zea mays
  Clone ID: cC-zmle1890015f05a1
agcacgcttaatttggtccacgtaaaaatcacaagaattttgacgcaaaacagtaaagaatcggtggacaaccaggggggttccttattttaaggggggaaagcactcgtctgaattctcatgggtggagatatacaggccctcagttggcgcttttgcttggcttggctgacgccgggtacaccgggtcagctgacgggatccactcgttggtagcagggtttcccctgcaagaagcatgtcgctcctttggattgggatcttcaaacagtttgaagggggcgcctttagctttggccattttgaagaaacccgttccgggc

SEQ ID NO: 22881 - DNA, 474 bp, Zea mays
  Clone ID: cC-zmle1890015f05d1
tgcggcaaaggggataagtcgaggccacccaacacgagcgacgtcacttctctccttctaggacgatgcggttctggaggccgaggtgcggtattactaccacgacgcggcgccaaagcgccacaccaagccctcccgcagcgagcactccgccgtgtacgtggacgcgctcgtcccggacgtcggcggcaactcccacccggagctggacaagttccaagagctggaagcacacaccgagaggttggtgtacgagggcgccaatgtgggaaatgagttcgtggagacggagtactacaaggaccttggcggcgtcggcgagcagcaccacacgaccggaacgggcttcatcaagatggacaaagctaaaggcgcccccttcaaactgtctgaagatcccaatgcataggagcgacatgctttctgcaggggaaaccctgctaccaacgaggggatcccgtcagctgacacggt

SEQ ID NO: 22882 - DNA, 402 bp, Zea mays
  Clone ID: cC-zmle1890015f06a1
tttttggtgctgcaaagccacttacttgcttgtgttggttagctattgctatataaaggaaatacacgcagttatacatggttacccaatcccggcataatcgtgctcgatgattgccatcccaatcacctggggtatgccgcaatctgggcagatattcttctaatggcgctaggggccctctgctttctatagttagcagctaggatttattcaaacagtggtcgcaggggcgccgccgtgtaagtgccgaagatggtgggcttgacgacggattccgctcgacgttcccgctcgaggagtttgttgacacacgccacctcctcgacccgcttgacgagatcgggccgccattgctcgaggtcggcggacgcgtgggccgacgcgtgggcggacgcttgg

SEQ ID NO: 22883 - DNA, 391 bp, Zea mays
  Clone ID: cC-zmle1890015f06d1
ccacgcgtgcgtccacgcgtccgccgacctcgagcaatggcttttccgatctcttcaagcgggtcgaggaggtggggtgtgtgaacaaactcctccagcgggaacgtctagcggaatccgtcgtcaagcccaccatcttcggcacttacacggcggcgcccctgcgaccactgtttgaataaatcctagctgctaactatagaaagcagagggcccctatcgccattagaagaatatctgcccagattgcggcataccccaggtgattgggatggcaatcatcgagcacgattatgccgggattgggtaaccatgtataactgcgtgtatttcctttatatagcaatagctaaacaacacaagcaagtatgtggctttgcagcaccaaaaa

SEQ ID NO: 22884 - DNA, 373 bp, Zea mays
  Clone ID: cC-zmle1890015f07a1
accagcagggggcccaccgggcaaaacgggaaccgcacccgggggcgggcaagctttccaaataggggattaatgagggaaatgggagtacgggggaaaaacgggaaaaccggggaacagggggaaaagggtacaaagccccaaaaccacaaagcaggaggccagaaacgaaaaagggggggggctcaggggccgaactaaagaccaaaaacccggttggccaccaggacccatgacccggcaaaaaaacgggaaaaccggcttcccaaatggataaacaaaccggccaatggggggggaagggggattggcaccaagggagggcctttgttttactggttaagcggaaaaaagggaaagcgcttaaaacctc

SEQ ID NO: 22885 - DNA, 263 bp, Zea mays
  Clone ID: cC-zmle1890015f08a1
gatataacggtaacacagcatgacattgttaatctggcagcccaaaagagaagggttaagaacaacaaactaacaaatctacaatttgggtgagacatagctgatatatgtacactaacttatgaggcgatccagcacttcctatgttgctatggccaccgattttgatgacggggctacaagatacatacacaatagagagcctaagactttctacctgcttctttagtcaacaaaaaacttgggcttacggaccctttggc

SEQ ID NO: 22886 - DNA, 401 bp, Zea mays
  Clone ID: cC-zmle1890015f08d1
gtggtcgagggtccaggaggacttcattggagcatattaagatgtaaatccgtacgtatgataaactggaatcagggagcactcataagaatataggcccctccggtccaaaaaacgaccaatgccgtcatgaaggttgcatgcgataatgccggcccccatcagaaagttgtttgctcgaacaagtcgttttcaaaaaaaagggcttacaaacacaccaatgcttttgattggattcaccgttttggggaagcttaaagaatagtatgcaactaaaacatattttcctggaggtggaccacttgccggaaaataatgaacgatttatcttattgggcaaaatatgttgcgtttgggtttagttgccactactgattcttttatgtagaacactgatgatg

SEQ ID NO: 22887 - DNA, 340 bp, Zea mays
  Clone ID: cC-zmle1890015f09a1
aaaaaatcgaacaggttagatccgaatccatccatgtgcagagcagaggaattacatttatacacggggctgatcaccgttggagtgaaatgaaacaaggaccacacgactctacataccatgcagctagagaggaggatcggcaggagctatatatacgcatctttgatgatatctacttgaagaagtaggggaggtcgagcacgtagaggagaaagtaggcccaaagcacgccggagatgccgtcaaaaaagaatcccccggagaacttggcccaaccgtcggaggtctgcagcttgtcggccttctttttcctgtcggtgagcgtgagcgagggcgc

SEQ ID NO: 22888 - DNA, 355 bp, Zea mays
  Clone ID: cC-zmle1890015f10a1
ggggaaagacccatttttttaaaaaagggaccttttcaatggcaggggttggtctaaaggtccctgccccggccaacatgtttttgaccccctttgactaaagggaccaacgggggtgcccacgggtttcccccctttataactatttacctggccccccctttagagactaagttttataccgggggtttccataaacgggctgaccagggggggggctcaacccccagttaaaaaatgacgtatcctggtccgggggtgtttccaaaaaccaggggttttaatataaaataaaatggggaattatttggtggtaggcggggggaccttggttttgcataaaaggattttttac

SEQ ID NO: 22889 - DNA, 300 bp, Zea mays
  Clone ID: cC-zmle1890015f11a1
tttttggtagaaactgaggtagttttgctaatacaggagagatcgagatatatgtatttatgaaaaaggggcagcagaaagtgatgtgtctaccaatatatctactaatctaagtgcagataaactttatacaacggatccgtccattgaacgacaccaagaaatcccttcaaatgccattcataaataggacccggacgagaactagaaaaaactcatagctagattcgtgtcgttgaatcaactttggggatcggcttcactgcttgaagtgatctttctggccaccccacgcgttcg

SEQ ID NO: 22890 - DNA, 484 bp, Zea mays
  Clone ID: cC-zmle1890015f12a1
tttttaagcattccattccttcactccattatcaaacgtcatcaaaagttgcgactatcatacacagcaaagtgacaactctgaaccaaaacaatatccacgtgagttgtcaccaaattcaaatacattccagttgaatgccattccttattcaggaaaagaaaaaagaggatagactcaacacgacatgatcaacacaagatgttgaccgtataaaatagaaatattgttcaccgaatgccaccctgaacagtaacaagaattttatcaaaataacctatagcgctaaagcggtcctactgtttacatgttcacgatatttggttcacctgtcgtgtcatctttacttgccagggtaagcctgtggggggtaggaaccttgtgctgggtacgagccctgtgctgggggatatgaaccttgtgctgggggtgggggatatgaaccttgtgctgggtaggagccctgtgctggggaataggaacc

SEQ ID NO: 22891 - DNA, 403 bp, Zea mays
  Clone ID: cC-zmle1890015f12d1
ggacaggtatgtgcatgggggcatgggcagcacaatgtccccgtggcacccgagggatgtaaagttcatcccagcgcctatggctccgcccatggtgcaacaaatgtaacgcatggatcaacctatgccatctcctgctggatatgcaccagcaccagatgaagggcaatcgtatggtggcgtctccatctccttctgcccaacgttatgacggctcctgcagggcaaggtatatccgtcatgtgtatactcgtagggtggagcataccctacaaccgctcaaggttacccacatggtggtggataacctccacctggccaaggttacccccagggccagggtggtgcatatcctacgcctgattcttacccctcacaaggttactaccccccatgagggggc

SEQ ID NO: 22892 - DNA, 546 bp, Zea mays
  Clone ID: cC-zmle1890015g01d1
gcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctgaataaaacttcttcgtatactaatacctacattaccatgcacat

SEQ ID NO: 22893 - DNA, 550 bp, Zea mays
  Clone ID: cC-zmle1890015g02d1
gaattttcgggtcgacccacccgtccgcccacgcgtccgctatgtcgtccagtatgttgtctcagcacttgtcacatttgtttctgccgaagttcttgaaggcgtcaacctttccctcctatcgagcgtgatgtcgtcccgcctctcccgtggcacgtacaacggtggtctcctctcgacggaggctgggaccctggccagggtggtcgccgactgcaccatcaccgcggcggggtacctgggcgtggggaagctcctcaacgtcaccctgctaccgtcgctggtgatatgtgttgcgtccatcgcctgcaccttcctgacgtacaactcgcttttctgatggagcttcgcgacgtatttgtgtcgtcatgattcgttccaaatcaaggcagctgggagaccgccgttgccattgcccgaaggggctgatgtgttactataaaatatatgtgcgtcgatttgattgctgtaaatcgacaccacgatggcagccactggtcctgccctgcaaaattatgatcgcttatgtccgggaccttgtcaatgctta

SEQ ID NO: 22894 - DNA, 534 bp, Zea mays
  Clone ID: cC-zmle1890015g03d1
ggaattttcgggtggacccacccgtaacgcggacgcgtggggggaaagttcattcccgtctatcttgctcatttcattctccaacatgaccccttcgaggtgggggaccataggggagtgggcgagctggtgaagcttgctacagagaggggccgcaaagctaggcctaacttgaaggtgggcatttgtggagaacacggtggagagcctttctctgtggccttcttcgcgaaggctgggctggattacgtttcttgctcccctttcagggttccgattgctaggctagctgcagctcaggtgcttgtctgaggctgcctcctcattggtaaccggattgcctgctgctggtggatgtggtgatcaacagttttattacagagccatgctatgtgaacattactagtagcagtgctcataaaagctacaatcccatgtgctttttttccccagtcatgtaaaactttcaaactgctccatggttcaaaactctgttcttcatacatcatcattatcgataattacgtggcagtt

SEQ ID NO: 22895 - DNA, 315 bp, Zea mays
  Clone ID: cC-zmle1890015g04a1
acgctatgcaattattgtcgcagcaccaagaagctccattgttcacttacaatgaacctataatgacgcctgacgggggacacccactccattgatccataagacgtggtggttgaagcctgggtatggtggaaccggaggcgaaccccacgatgccttctgagctaaatggaccttgcaatccaaaacacaaatgggcaccggccaactggatatgcacgacaattaaccttctgggctagggataacataccgggatccatcaagataactggggggtgcgggcccgaacgctgagttgctccatgatccgtc

SEQ ID NO: 22896 - DNA, 195 bp, Zea mays
  Clone ID: cC-zmle1890015g05a1
gcaaacaaacggtttttgctagatatagtattcttgctttacatatttcaaaatatgaatacagaccctcccccttgtttgggagaaaataccttttaaacctttgcttttgttccacactctcacccaaatgtgctcaaactatactggatcatatatcacaaacaaagggcctcgtccgctgtttgcctggat

SEQ ID NO: 22897 - DNA, 474 bp, Zea mays
  Clone ID: cC-zmle1890015g05d1
tggtaatatagtcaccgaattattaaggtccaaagtgtatcaacgatgacgctttaatgttgagcctgaaataaagagtatgtggacgaggtgaagtgaacttaaggtgcaggcatcataggtatcttgtgccaaacagactgttacatgcaggctagaggcattaacactggaacttgcagcagatgcccggtcttacgttatttggagcccatgtgataaagcgcataccgtataagctagtttcagagaaggcattagcacagtttaaagagtgggtagcttgatgcagacaaacaacggacgagggcctttgttcgtgataattgtttaaaataggttgacacattatggtgagatgagaaacatactaaaggttaaaagtattttctgccaaacaaggggaggaaactggaatcattatttgaaatgctgttagcgatactactatatcttgcaaatgccgggtgtttg

SEQ ID NO: 22898 - DNA, 425 bp, Zea mays
  Clone ID: cC-zmle1890015g06a1
gcaatacaatataagcatattcgagtggaacaaccagattcagttccttagatttcacgcgcttgtgctttgagccgtaggcaactgcaatcggtttcttgaacagcgaagcatcggaggtctggtaactggccaaaaaataggtatgccggagcaaaactattgggtatgtgtattttgtttagaatggcttccctgcagcttccatcatctcctttgcacggatcagcttctcgatttgcctcacgatttcaaggaccatgtcctcaagcgtcaccaagtcaatgctactgtacccccgctgagaagccacattttgtactgaaacagtaatataagaaccccatagcgctctttcagttcatcataccgctgacggagcttgcttatcgcctgagaaaaagagtctggatctgtagtagctt

SEQ ID NO: 22899 - DNA, 423 bp, Zea mays
  Clone ID: cC-zmle1890015g06d1
gttcgaacggagaggaggcagagctaccaacggcacaggcaccagttttgctttctgctacagcggcggcgacaggggggttctgtgcatccaccgtccctccgaggcgcttctcggtcgttacaccgccggtgtcactctgcaccgcgcgctgcatacagcgtcaccgtctccgcgccttcccaagcttggaaatacctctagaggaactcaacccatccgtcgatctacttaggagaactgcggaggccgttggcgatttcaggaaaacgccaatctatattgttggaacggatttgcacagccaagcgcaacatcgccaaggtgcttgcgaattccataatataccgctacctcagcagtgaggaactgcttgaggatgttcttggtggcaaggacgccctcaagagccttcaaggaatc

SEQ ID NO: 22900 - DNA, 457 bp, Zea mays
  Clone ID: cC-zmle1890015g07a1
ttttaaaatcatcggaagaaaatattgttacttcttagtatgtattggacttcccagctcattatgagccaatggtacataaacgaagtgcttaatatttctcctaaatatcaattggcaaagactaaatatacacattaccagcccaagtgcacaagcgcaacgagcactttggaacatggagacaaactatacacgatctcgattcatcttagaagcctacgttatcgtcgaagaaggccttctatcacttgaagcatcctagtcttcttgcgtgcatgatacggctgcagaatattgagcatcctcgccgttctttctttttcttcctttctcgctgcttcgtcggaggcctgattactaccttgatggcagcatcaaacacagctttcacattctgctgagtttttgagctgcattcgatgtagcaagttgcgccaatgtgcttgcgcagttc

SEQ ID NO: 22901 - DNA, 454 bp, Zea mays
  Clone ID: cC-zmle1890015g07d1
ggaactgcgcaagcacattggcgcaacttgctacatcgaatgcttctcaaaaactcagcagaatgtgaaagctgtgtttgatgctgccatcaaggtagtaatcaggcctccgacgaagcagcgagaaaggaagaaaaagaaagaacggcgaggatgctcaatattctgcagccgtatcatgcacgcaagaagactaggatgcttcaagtgatagaaggccttcttcgacgataacgtaggcttctaagatgaatcgagatcgtgtatagtttgtctccatgttccaaagtgctcgttgcgcttgtgcacttgggctggtaatgtgtatatttagtctttgccaattgatatttaggagaaatattaagcacttcgtttatgtaccattggctcataatgagctgggaagtccaatacatactaagaagtaacaatatttgcttccgatgattgt

SEQ ID NO: 22902 - DNA, 352 bp, Zea mays
  Clone ID: cC-zmle1890015g08a1
ttttactaaacactactttattaagggctagtgggggaacatatttttccaaaaagatttctattttcttaaagaaaattagtttattttctcttggaaaaataaaaatcccgtagaaaaatagagtttccaaactagctctaagacaagattattatatactttagcgctcagagcaatgttcatacagtttttttctacagttttgcagccacatattgtttaagagctcccaagcagcttcttgatatccttctcaatgctcagaggtgaagtggttggagcatatcgatccacaacacgtcccttcttgtcaaccaagaacttggagaagttccacttgatgctgtcg

SEQ ID NO: 22903 - DNA, 397 bp, Zea mays
  Clone ID: cC-zmle1890015g09a1
gtttttatttctataaatcccagtcataatacagggggaaggtatcagagtacatacaccgcgaaggaagggtaactcttgacatttactttatcgtcacattaacccttagcagcacaatgatatccgcaactcaacaattcagctacagaaatacaacgttgtcttctaataataataacacacactggttcgtcatcgtcgccggcgccttccaccgctggtacagaatgcccatgtgtaccccagcctccgacatcaaatttacaacctagtaacccaccccgcgcaccacccacaactagagcaaaaaacgagtaaacatctaaaatcgagggagcacgaaaaccctagattcctgccaagaccaccgctctacttcttcgccttacgggac

SEQ ID NO: 22904 - DNA, 128 bp, Zea mays
  Clone ID: cC-zmle1890015g10a1
gggcccaaaaacgggggggatagggaggacccaacagggggggggcaccaactgttttatgcccaattggcccccgaaaaaattggccaggaaggcccgccttaatgtaaaaaagggggggggggggg

SEQ ID NO: 22905 - DNA, 294 bp, Zea mays
  Clone ID: cC-zmle1890015g10d1
gggtcgatccacgcgtacggatctacattgctttcaatccctcacagggacgaatttttttttgtatgcgaaactggagctccaagtatggagatgctgttgtaagcgatttacgagctgtacacagacttcgttctgaagaatccgttctatgagatggagatgccgattcggcgcgagctgtttgatcacaacctgtctcaggtgatccagatggaccgtgttgcgctcctgggtcggtgaaattggaaagcttttggtcctaaccataccatgtatcttgtacaccccccg

SEQ ID NO: 22906 - DNA, 499 bp, Zea mays
  Clone ID: cC-zmle1890015g11a1
ttttaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggcccaagacgacgtgcttgccgtcgagccaaggggtcgcgaccgtgcctatgaagaactgggaaccgttggtgttgggcccggcgttggccatggaaagcacaccggggcggtgtgcttgcgcacgaactttttgtc

SEQ ID NO: 22907 - DNA, 342 bp, Zea mays
  unsure at all n locations
  Clone ID: cC-zmle1890015g12a1
gccgnaaacaactatatactgtattacatgatcaaagggttactgtatacgtgccgtaattacaatatgggttttagatgtacaatattttgggtgatgataccaacaatgtacacaggccgacaacagctaagttatccctatcgtacaactcagttccttttgtagaactgaaactttatcatttaaatccgttaggggctaggattcaaaatcctgtttcgcatttgcatggatgcaaaaatcacatttgttttgacgtatcttttacgcttttttacgcgttggagtatcgggtatctcccgattgctatacagtacagaggtccctgatgatgggat

SEQ ID NO: 22908 - DNA, 453 bp, Zea mays
  Clone ID: cC-zmle1890015g12d1
ccagccggtctatggacccgatgagggtgctgaacactctctttacgatttatgaggaagtgggaagcaccaggggctggggtaagatcatgtcctccaggcagcatgaatggagacaccaatcaccatcccatcatcagcgacactgtactgtatagcaatcgggagatacacgatactccaacgcgtaaaaaagcgtaaaagatacgacaaaacagatgtgatttttgcatccatgcagatgcgaaacaggattttgaatcctagcacctaacggatttaaatgatgaagcttcagttctacgagaggaactgagttgcacgatcgggataacttagctgttgtccgactgtgtacaattgtggtatcatcacccaaaatattgtacatctagaagccatattgtaattacggcacgtatacagcaacactttgatcatgtcatacaatat

SEQ ID NO: 22909 - DNA, 343 bp, Zea mays
  Clone ID: cC-zmle1890015h01d1
gtttatatacctacacatggggctagtgacatgctttaaatgcttggggagtctgaccctaccatggtgtcatacactgaatttttagagatgttcaatgacccatattgtagatttggtatcctgaccactttgatgaatcttgacgagagtgatcacactcgtcacggcctccacacatgctacatcagcctgtaccctataattgattcacggagtttggaaacaaaacactttttcagcctgtgcaaccggtgctacactgaaggtaaggttccgtcagcgttcaagttggaggagttcagtttcaacgaatacggtaactaatccgatgccctcatcg

SEQ ID NO: 22910 - DNA, 150 bp, Zea mays
  Clone ID: cC-zmle1890015h02d1
ggaatttttgggtcgacccacgcgttcggggacacagtttggagcgcatgaagacatgctgtagtgtttttttttttttaattcataacaaacttgtagtacacatttgtgttcatgataaaacactgaagtagtatgatactacagaac

SEQ ID NO: 22911 - DNA, 344 bp, Zea mays
  Clone ID: cC-zmle1890015h03d1
cccacgcgtccggagatagacaagcagctccagtccaaccaagaacaaacaacaaccgcagcaagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccactcccacgttcaaagcagaggtatgtaggaaagcttaactagttcaagatttgtcctttcggttattcagtctggctggctcacggggttccgaatcggtctgcggtttcagggcagggagcagcatcaggaggaggaggatgag

SEQ ID NO: 22912 - DNA, 432 bp, Zea mays
  Clone ID: cC-zmle1890015h05a1
tttttatatcgagaaagaaaggtgacactatcctaccatagcgacggaaccaaccaatccgtaccacaacaatccgtgactcgtgcaaaaaaaaattcgcttcacccaacccaagtattgaagtgcacacaccacagccttgttttgctacatgcaacgcatagcccgtctctaaacaaacataggttaggcctacttccaccgacactatttagagactgtggcttaccatactttcccatgttacgcatttgttgttgactctattggacctgcgactcactggcccccatgcttcgccttcaagtgatcctgaagtgccgtctcactgatgaatgacttgcttgatgaatggcaaggggccccagattttggcgcagattttggagacttgaccgattcgcagttgttacaatgggcttgccttttgct

SEQ ID NO: 22913 - DNA, 344 bp, Zea mays
  Clone ID: cC-zmle1890015h05d1
acgcccacagcggataaaaccctaattctcacttacatggtcgcttttgctcttatgctgcaaatggaatcctcgggagtcgtggtcaagcctggtacccctgtaaagggtgacccttgatttggctctgtgctccacctttcccagtctgctcttggggaatcgtataggagagattatcccttgatgtatgtgaaaattgatgatctgaaaccggccttgggaaccccctgtgttgacatgaactcacacatacaatttgatctcaatctccagaaaaagtttgagctgtcgctcacatcaaagactaccatcgttttctgcactgtcttccaggtttagct

SEQ ID NO: 22914 - DNA, 324 bp, Zea mays
  Clone ID: cC-zmle1890015h07a1
gggaaacggggtataatcccaaaaaaaaacgaacccgggaatgaaggggagaaaccccgcaccaaagagggaggaaaaaaaagaggccaaaaaaaaggacaaaaaaaaacccggggaaaaaaaggaaaaaaaagaaaaaaaaaaaaaaaaaaagaaccggaaaaaaaaaaaaaaaaacccgggggggaaaaaaaaaaagaaaaccccaaggaaggagaaaaaaaaaaaccgccccaaaaaaaaggggaaaaacacccgggcccattaaaaaaaaaaaaaccccaacccccggggaaaaaaaaaaaaaccccaccaccccgggga

SEQ ID NO: 22915 - DNA, 186 bp, Zea mays
  Clone ID: cC-zmle1890015h08a1
aaaaacccatgttagactagtacatatcaaaacccccattatgagacgcaaggtatatatattttttggtaggggatggtatttccctttggtttccctctattctcctttatttcattttcaaatttggttcacaaatttgggtgccataatccaagaatgggatgaatttttccggacgcgggg

SEQ ID NO: 22916 - DNA, 271 bp, Zea mays
  Clone ID: cC-zmle1890015h08d1
acgcgtccggaaatattcatctcattcttgaattattgcatccatttttgggtttcaagtttgaaaatgaaataggggggaattgagggaaaacaaagggaaataacatacactaacaaaaaatatatataacttgcgtctcatattggggttttgacatgtactagtctaacatgtgcttttaaactgattcaaaattcactatttacaaaatacaagagctggaattcgaattaaacacagtaaggtctactataggcaccaaaggggg

SEQ ID NO: 22917 - DNA, 287 bp, Zea mays
  Clone ID: cC-zmle1890015h09a1
aggcatcttcagaactcatgaattttatatgcgcgacttggagcaagattctgagttgttgccatggcatcacacgctatcgccggcggcccccagatctctcacatcctgctcttcttcacagggccgagctctttggctctggccctcagctcgtgcttcttgatcttccccgtggccgtcttgggcagcggcccgaagatgaccgacttgggcacccagtaccccggcttcctttcccggcagaagcgcatgatgtcgttggccagcgccgccttgtccgaccc

SEQ ID NO: 22918 - DNA, 440 bp, Zea mays
  Clone ID: cC-zmle1890015h09d1
caaccgttcggaacatgaaactctggaggtgccgaaggtgctggtctgcgcacttggcggcgctcgaggtctccgggggcgtcagggccctcgtagcgaggggcgagtcttcttgcgcggtcgtgacgctcaaggacggatcatccatccgacgggactgacgatgcggagctggccaacgacatcatgcgctactgccttgagaggatgccggggtcctgggtgcccaagttggtcatcttcgggccgctgcccaagacgggcactgggaagtatcaagaagcacgagctgagggccagagccaaagagctcgggcctgtgaagaagagcacgatgtgacagatctgggggccgacggcgattgcttgttatgccatggccgcaactcagaagcttgcaccaagtcgcgcgtataaaattcaggagggctgaagatgcc

SEQ ID NO: 22919 - DNA, 497 bp, Zea mays
  Clone ID: cC-zmle1890015h10a1
gtaagcctatataaattgacttgataccgctaaagaaatggcgctaggacaaaaaaaaatcaagagtctgcaagtgacagctctcttgttagttaggtgggggcaccaccagcatcacagtaaactagcacaacaaaacatcatcataaacaacagctagcggcaccgataacatacgtaatctcttcctctcgagtccttgcctgaatgcaaaagtatcgtatggtccttgcatcagtcagcctggacaaatctatgaacattgggcatgatcagatattcagatcagatctgtagttttgtactgggggactcttggatgaagctgatgttcctgggctgccctaaacatagggactcctcatggttgcttgagagggcaatgtctgtgcatgatgacttgtcgttggcgctcccactgccaaacgtgtcactgctctccatcgggctcttggctgatgggtaaggtgcagcaattgtcaccctttcctttcttt

SEQ ID NO: 22920 - DNA, 232 bp, Zea mays
  Clone ID: cC-zmle1890015h12a1
tttttgacacaacacaggtacttaaaatttaaggagatatcattgtcgattacacacgataatttgtctgctaaaaaatataggaaacagtacttgtagatgataaaaaaaaaaagccaaaacttgcagcagtttgacgaaaacagcagctctagtcgttgaagaggctgaagcccattttctcgtccgactcctctttaggcttcgcagccttcttttttttcttgggagc

SEQ ID NO: 22921 - DNA, 511 bp, Zea mays
  Clone ID: cC-zmle1890015h12d1
gtttttggcctatctgcgcaaacttgcaaacgctagacagacactcttgcccttcacgatttttgggtcctcctccatgtatctccactcgggggtgttttgatcacgttcctccacctagggttagcgttcctctgctgcgatggcgatcaaccggactaaggcggaaaagaagatcgcgtaccacaagaagctgtgcagcctgctcgttgagtacaccaaggtgctcatcgtcctggccgacaacgtcagttccaagcagctccaggacatccgccggggcctcaggggcgactcggtggtgctcatggggaagaacactctcatcatgcgttgcatcaaggtgtacgccgagaagaccggtaaccacacctttgacccgttcatggacctcctggccggcaacgtaggcctcatcttcaccatgggagacctcaaggaggtgcgcgaggaggtcgcaattacaaggtgggggcttctgctcgtgaaggcctggtgctccagtagaagt

SEQ ID NO: 22922 - DNA, 463 bp, Zea mays
  Clone ID: cC-zmle189002c10d1
gcccacgcgtccggtggttttgctgtgggtgttgtgaagaagaatttagtctttgatggaaaaagcattgctaagggggatgggcttatatgtcttccttccagtggtgttcattctaacgggttctctcttgttagaagagtactggagaaaagtggactttctttggatgatcagctcccaagaaatgatggcttaacaactacggtcggtgaagctctaatggcaccaaccttcatctatgttaagcaggtgcttgagattattagcaaaggtggtgtgaaaggactagcccacatcactggtggtggctttactgacaatatcccaagagtattccccttcggatgcggggcataaatttttactgggtcatgggaaatacctccaatctttagttgccttcaacaggctggtaacattgatgactcagagatgcggcgaacattcaatatgggcattg

SEQ ID NO: 22923 - DNA, 293 bp, Zea mays
  Clone ID: cC-zmle189002c12d1
tcttggattaattgactacgatctctatgagcctggggatgtttcattttgtcgagcgtggtctcgtttcggggggagggggatagtataggatgatcaagactccatccctttcgttaatggacgatcttcgctatattagtgtatagcttacctcttggtactttgctgggttttgtaataatatgatccatctcattgatgaatcaatgcatttactttgcgttctccctctctaaatcattattcacttttaattttctatacgataattcataataattaaaataacg

SEQ ID NO: 22924 - DNA, 548 bp, Zea mays
  Clone ID: cC-zmle189002d10d1
caatccgaggaggatgaaggtttctcacgcagctgctgtctcagttttcgcgtccagtccgggtgctgctcggaccgggcctttcgtggacaagctcctaccaagcgtgacgtcttcgcgttcagctacaccacccaagtcgtggtgttcatcctgctgtcgtgctcgatcgcggtgtgcgtaaacttcagcacgttcctggtgatcggcacgacgtcgcccgtgacgtaccaggtgctgggccacctcaagacgtgtttggtgctctccttcggctacatcatcctcaaagaccccttcagcgcgcgcaacgtggtgggcatcctcatcgccatcttcggcatgggcctctactcctactactccgtcgtcgagagcaggaagaagaccgaggacgctagctcgctgccggtcgccgcgcagatgagcgagaaggactcggcgccactcctcggcgccaagagctcgccgcggacagagaacaaggcccaggaaaccttcgactaccatgccgaggacggccaagagcgcgttcacggcccgtgagc

SEQ ID NO: 22925 - DNA, 505 bp, Zea mays
  Clone ID: cC-zmle189002d11d1
cgccgggccgatcccaaattgaatggggagcctggcgtccgagaggttgttggtttggtgggccgccagggacgccacgggacaggtgtccctctactactacaccctcaggaacacaggccctgaagatgtggtggtgaaagtgctctactggggtatctgccacacggacattcaccaggccaagaaccacctctgggcttgaaagcattctatggtccctgggcacgaggtggtctgcgaggcggtggaggacggccccgaggtggccaagtactgcgatagcgacgtggtaggcgtcggggtgatcgatgggtgctgccgcgagtgcagcctctgcaaggacaacgctgagcagtactggaacaagaagatctggtcatacaacgacgtctacactgatggacggaccacgcagggtggattcctctacacatggtcgtccaccagagtttgtggtgaagatcccggcgggtctggctacagagcaagcggtgccgctgct

SEQ ID NO: 22926 - DNA, 389 bp, Zea mays
  Clone ID: cC-zmle189002d12d1
gcgttcggaacagggcatgatcaaattctcaatcaatctttttgattatattgacggctactgcccaaagggcaagggggtgatttcagaacagaaggcccttcattaatttgacaatgtttgatggcccaacatatcacaatgatagacaaccactgtctgtataacctaccgcgcagccagctggtgtctctgcttaagattgcaacatattctgatcgtgcctattatgacttctcgccatgccctgggttcagaatcgttgatctggatgcttatgacttcacatgtcttggctgtccccatgatcaccctgtgactatagcatcaaagaacctcctggatgagaagaatccatacactgataataacagtccatgatggtatgg

SEQ ID NO: 22927 - DNA, 557 bp, Zea mays
  Clone ID: cC-zmle189002e10d1
gggcaaagtcatccccgccgtgggcttcggcaccttcgttttgcgttttcaaccctggccagacctacacaggcgccggggcagcgctgaagaccggctaccgccacctcgactgcgcctggttctaccagaacgagggcgaggtcggcgaggcggtgcgcgacttcctcaaggagacgcccagcgtcaagcgcgaggacctgttcatctgcaccaaggtgtggaaccacatgcacgagccggacgaggtcaagtggtcgctcaacaactcgctggagaagttcgggctggactacgtggacctgttcctggtgcactggccgatcgcggccgagaaggacggcaacaacatgcccaagctgaacgcaaagggccagtacgtgatcaaggaggagctcaccaagaaccacaagccgacgtggggcgccatggaggagctgtacaaggagggcaaggccaaggccatcggcgtcttcaactggacgatcccgcacctcaaggacctgctctcgtggtgcagcgtcaagccgaccggcaaccagatcgaaattcacccc

SEQ ID NO: 22928 - DNA, 618 bp, Zea mays
  Clone ID: cC-zmle189002e11d1
cacccgtccgcgatactggaactcagagcataggggggaaagtcgatttatggttttaatcaaatacgcagtatttacaggaaagggtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcatgggaaccgcagacaggcaagtgaaatccaatccacgaaataaattgatccatggacggcaccgttgtggtaaaggtcgtaatgcccgaagaatcattaccgcaaggcatagagggggaggtcataagcgcctataccggaaaatcgattttcgacggaaataaaagacatatttggtgaaacattaccatagaatacgaccctaatcgaaatgcatacatttgtc

SEQ ID NO: 22929 - DNA, 608 bp, Zea mays
  Clone ID: cC-zmle189002e12d1
gtccgaacttgctcttcaaaagggtgacgaggatcttgctcgttaagcttttaagcggcgtaaatcatatgctggcaatgggggctccttaagatcccagcttgatcagcagaagggtgtagttgaaaatctgatttcaaatacccggcttcttgagagcaagatatcagaggccaagcagaaaaaggataccctaaaagctcgtgctcaatcagcaaagactgctacaaaagtgagtgaaatgttgggcaacgtgaatacaagtagcgccctttctgcatttgagaaaatggaggaaaaagttatggcgatggaatcccaagcagaggcactcggccagttagcaactgatgatttagaaggaaagtttgcactgcttgagacttcatctgttgatgatgatctttcacaactgaaaaaggaattgtctggaagctctttgaaggagagcttccttcaggcagaacagcagtcagcaactcatgtgctgggcgccctttccccgacctagagattgaaagcgagctaaacgagctgcggatgaaagccaaggaatataagctcattcttgtcgattaacaggcctgacggaatctcacttccaagaa

SEQ ID NO: 22930 - DNA, 544 bp, Zea mays
  Clone ID: cC-zmle189002f10d1
gtccgctattttcgactccaacgtcagtggaagaccttttgattttagattatgtgttgggcaggttatcagtgggtggggggttggcgtcaatggtatgcgggttggggacaaaaggagactcaccattccaccttccatggggtatgggagcaaaagagtggggcagataccacagaactcaactctcatcttcgatgtggagctggtgaacgtaaaatgaagtgagaagatccacgagaaactgcggcagtttcacaaattttgctacgcatcattttccttgggcaatgctgtttcgtaggcataggggcatgttaagtggattcatctttgtcgctatcatactttcgaactgagtttcagaaggaaaaaactgtggactgttgccatctgggataattcctgggctgcagcattcgccatccttctcccggttccttcagggtcattttgacattcttgtgataccctcagaaccttttgaactgatgaaatggttaaggtggagtacgtgtacgacttcacgccgattggttttaat

SEQ ID NO: 22931 - DNA, 417 bp, Zea mays
  Clone ID: cC-zmle189002f11d1
gtgcgggacccgctcctcaacaaggtctgcgccgcgccggttttcgttttctgcgccaagacgaccgccggcgggaagggggccggcggcgacgacagcggcagcggcggggggttcaacctcggcggcctcggcgggctcttcgccaagaaaagcagctgaacgtgccaagtgtggcgtggtttatggattgtcgaactcaaagctggatttggcttttgagggggaaatggttgcgcatatatatttgtggacgtgtggtggtgtgaccagtgatctttgatgtcataatgtgatatactctacttccaaaataatataataaaatctataactatatattatgtcccgagatttaaaacttacaatttaaatttggggcggccgttcttgaggacccatgctttcttccccgtg

SEQ ID NO: 22932 - DNA, 58 bp, Zea mays
  Clone ID: cC-zmle189002f12d1
acccggccgaaaaaaaaaaaaaaaaaaaaaaaaaaaaaaaaaaaaatttttaattttt

SEQ ID NO: 22933 - DNA, 346 bp, Zea mays
  Clone ID: cC-zmle189002g10d1
acccgtccgccgacttctagctaatgccttacacacttataggctctttgttttgttcagcccacatatcgccctatggggagggggcgcatttcagctccggagagagctctacttcttgtggtctgtaacaactcaactactacagctggcggtttataatggcctgcgaagtgcgattcagtgccattgtacaggggcgtgcagaagcatgtgtggggacggttcgcggagaatattcggtacctgaccaagcgcgcactcgtttgactcggcaccttcgactcgaacgatgtcgctgagctcgcctatgacgtggaccaacgtgacctgttcggtccgtttg

SEQ ID NO: 22934 - DNA, 544 bp, Zea mays
  Clone ID: cC-zmle189002g11d1
ccgtgcgcccacgcgtatcgcccagcgcgtctcggacacatcagtacctgtatggtttttaacgtcatggaggccaaggtcggggtggggtcctgcggccacgacgggcccttcagcgccaccggtgtcaagaggctccaggacatcggcatgatcagcgccgtgccggggatgaaggcgctcgacatgaacaccgacgaggacgagatcgtgcgcctcacgcgcgaggatcgtcccggcatgatcgtcaccggaatggaggtcgtccgagattgacggcgcccccaggatgggcccgacgtttggcgccatgatgatctccggccagaatgttgttcacctggcgctcaaggccctgggcaggcccaacgccgtggtcgggaccatgtcgccgccgttgcgcgaggagttgatgattgcgttcaaggacgactaggtcgtggacgcctgtgtgcggcaagcatagaggaggatcgaccccagtcagcgcttattttaattgccctgttgttaatgatgaattgacgaattcccttgggtttgc

SEQ ID NO: 22935 - DNA, 610 bp, Zea mays
  Clone ID: cC-zmle189002g12d1
gacgctagaagagttcatgagggaccgggcaaagaggcttatgatttcaccacgggagcctgaacctgagggtgttggggaagaacctgagccggatatgaacagcatcaaagcgcttccagcaccagaagattataaggagcctgaacctgtgaaggtggaggaagaggtgaagccggagccacccccacagccacagggtgacttggtggatctcagagaagatactgttagtgcagatgagcaaggtaataggcttgctctagcactcttccagggaccgcccgctgctggtggaaacaatggttcatgggaggctttcccttcaaatggtggcaacgaggtgacttcggcatggcagaatcctgcagctgaacctgggaaggctgattgggagcttgccctcgtagagacagcaagcaacttgtccatgcagaagccagcaatgtcaggtggtatggacccgctgctgctgaatggtatgtatgaccagggttgtgtgcggtagcacgttagtgcacaggtgaccactcggagtgccagcagcgttcgcctgcctgctcttgacagaagactaaaatgctgctctgcccgaccggatggtcaatgc

SEQ ID NO: 22936 - DNA, 611 bp, Zea mays
  Clone ID: cC-zmle189002h10d1
gtccgggaggaggaggtggaatcgatggagtcagatacttcttttgtcgtttagagttctggagcttctgctctgatgcgggagagtttacagcctacctatccgatgattgttccagcttatttctcgccgttcttgcaattctcagttccttttctgtccaaatcaggaagatggaggcgatcttccccaagaaacacacgagattgtcaagcctgttgcagttcattcccagaatccaattaatgttgatgaactcgtgggcatgtcaaagctaagcatatgggagcatggtcaggagacagtgtctacttctctgtcgctaaatctgctagggggtcaaaataggcagtcggcttttcatgcaaaccctcaaacaagagctcaagcctgatcatcccctaccagcacagaaactgtattttagatggaatcctgggcaaaataagctttgctcttttttttcttcttctaaatttaagatcaccgagtcacaaggtcactggttggaagtagcttctcctatttgcggtgaaagcctgcccgggttttttccatcatcagagcctcaatattgcctttttttatatttaaattgccggctttgagct

SEQ ID NO: 22937 - DNA, 456 bp, Zea mays
  Clone ID: cC-zmle189002h11d1
caggaccgggaaaagagttttttaaaaacacagctaacagctaaccctcttcctctaagcaaagaaggtaggcaactaaacccacaacggggacgaacctgaccacactcacaagcccagcagcatccgccttcacgttcccaagattgtccccgaacagccacggttggaatacggagtacaaaaacatatcccatagaaacccataagcaagccgctccgagaataggatgctctgaaaatactgccaccgttccccaatgccttcgaaaccagaatctccggggccagagaacgcccaaactatcgaaagaacgcagacaaggccctctaccgcccccacagccggcgcgcctttgaccattactgaacccacctgtgatctttgtggtggaaaccggtccgtgtcccgaccgtcaatcggatcgccatgtaaggtatcaaaaaagtgtttgt

SEQ ID NO: 22938 - DNA, 547 bp, Zea mays
  Clone ID: cC-zmle189002h12d1
cgtcccgcattcgtattttcttctgattctcgccgccgccgcttccccggcgcggggagccaatatgaatgttgaaaagctcaataagatggcaggtgctgtgcgcactggggggaagggtagcatgcgcatgatgaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgtaagatctgctttcatcgattatcaaccagcttggccctgacaacctatacaacctgcggaggcttgcggagcaattccagaagcaggcccctggtgcttcaagtgcataggctggcgccagcgctggtgctgctcaagacgatgacgatgacgtttctgactcgtccctggaaagaacattgagaggctgccgaagagaaaaa

SEQ ID NO: 22939 - DNA, 415 bp, Zea mays
  Clone ID: cC-zmle189003a02d1
gaagatggcaatgcataggcagaagaagttgaggatgtcaagtttacttttgctgacacgggaagtacagaggggaaagagtgaggaaccaaaggacctgaagccacccgtccattgattaaggttttatatttccttggcccggttattccgatggaccccattaaatcccggtggccaggccaccgcccccacctttattttttgcttgctggtgatattcctttaattccttttcccttgtttattaggggtgaagggattccctttgggttaatgggtcctttgggtccatccttaattggccaatggtaagtattttttgtaaaaatacctgtgtgaataaaaaacctaaaattggtttgatccaaccggttgtaattttacccccttaaataattggatattaattttt

SEQ ID NO: 22940 - DNA, 637 bp, Zea mays
  Clone ID: cC-zmle189003a03d1
cgcggacgcgtgggtgctcagctcccgcctcctcccatccccggactttggactctccggccatgggcgcctgcttctgggccgcctgcgccgcccccgccggcgccgccgtcgacgagcgccgcccttccaaggagggcgacggcaagaagaggcgccgcgcggccggggcatcgccggatgccgcggcgcccgtgcgcgtggagttcggctacgagagggacttcgaggcgcgctacgaggtcggccgcctgctcggccacggccagttcggctacaccttcgccgccaccgaccgcggctctggggaccgcgtcgccgtcaagcgcatcgacaaggccaagatgacccgccctgttgctgtggaggatgtgaaaagagaagtgaagattcttaaagcacttaaaggacatcagaatattgttcacttctacaatgcatttgaggatgattcatacgtgtacattgtgatggagctatgtgagggcggtgaactattagatcggattttggcaaaaaagaatagccgctatagtgagaaagatgctgcagtggtaagtccgcaaatgctcaaagtagctgctgaatgccatctgcgggggtaagtcaccgagatatgaagcctgagaactttctt

SEQ ID NO: 22941 - DNA, 535 bp, Zea mays
  unsure at all n locations
  Clone ID: cC-zmle189003a05d1
cagcagccgcaccacgcacccagcgcaaagcgatggcgtctttcacttttanggcgaccttcgccgccgggggggagggggagccctcacgccgcggcaccttcgccgtggtcaggtccgccaaggtcgaccgctgccaggagcccgtcacgctagcagcaaccgaggccaggcccgccgacgacggacgccgcgccgtcatgctcgcggatgctgcggcggccgtggcagccatcggcggcgccggcgccgccatggcgggccccaagaacgggacccccgaggcgaagaagaagtacgcggacatctgcgtcaccatgcccaccgccaaggtctgccacaactgagcacgcccgcgttgcaactgcagggtcggggggtggtatataattaatgtacctgccacggtgttgttgcccctattgatggttcgagctttagatgcatgcctgacgagaggccggttaaatgctttctgacggcctcggagctgtaagaaaataaagtgcaactgcaaatctgaaattcggttgat

SEQ ID NO: 22942 - DNA, 462 bp, Zea mays
  Clone ID: cC-zmle189003a06d1
cgcctcactggaagctgtggaacaccgctggaccatggcgtcacctttgtcttttaccgcacagagaacggcaaggggggctggatcgtgaagaactcatggtgcagtcagctggggcgagacctgctacttgaggatggcgcgtaacactgaggtgtccagccgatagtgcggtatcccggttgatccgtcataacccggtgaaggagggcgccaacccgtcgaaccctgtgcccagcccgccgtccccgaccccggcgcccggcgtgtgcgacaactactacttgtgccctgacagaaccacctggtgctgcgtctacgagtaccgtacgcactgctttgcctggggctgctgcccgcttgatggctccacctgccgcgacgagcactaccgctgcagtctccatgactaccggatctgcaacttcaggcagggaacctgactcatgggcaaggacagcc

SEQ ID NO: 22943 - DNA, 512 bp, Zea mays
  Clone ID: cC-zmle189003b01d1
ccacgcgtgcgcccacgcgtccgcccacgcatacgcccacgcgtttgggttgtggaccgacaacgagccggccggggccagggccggcctcgtgtggggccgcaccggctgctccttcaacggcaacagcgggagctgccacactgactactgcggtggagcgctggcctgcacgctgtctgggcagccgacgttgacgctggccgagttcaccatcggcggcagccaggacttctacgacatctcgggcatcgacggctacaacctagccatggccttctcctgcagcaccggcgtgcggatggagtgcacggaccctggatgccccgactcgtaccacaaccccgccgacatgaagacccatgcctgtggcggcatcagcaactaccaagtcaccttctgcccgtgaacggccggaataggctttgcatgcatgggctagtgatttggattacgcatgaataactctgattaggatttgcacactactatatatataagcgtggattaca

SEQ ID NO: 22944 - DNA, 482 bp, Zea mays
  Clone ID: cC-zmle189003b03d1
ttttaattttatggcacatactacacaattgaggggtcatgaatatatatacatatctaccaaaaaaagggttacacctgcagagttgctgcagctaattgtacaatttacataaactgaatcgatggaaggacgaatcagctctccaaggtctctagggctgctatctggagttgtcctttgaagcatctggtgtggaggtgctatcagaattccttgcctctgacttttcgtttgagtacgtcgacaatattgtgacccatacaagctccacacagtcgacccataaaagtctttgctcaacaggaaccacaccatatgtaattaagtgtgcaaaaggtcacaactttcatccagcggtaagcatgggccaaaatgttgacttgagttcactgtaaatagtggtaggtgattccaaccgaaggaaacctattaccacgaagtaaatactgttccagattgcagaccaaacggtttgatct

SEQ ID NO: 22945 - DNA, 89 bp, Zea mays
  Clone ID: cC-zmle189003b04d1
aaccgatacgcgcttccctacagtggcgcagcctgaggggcaacaggaacgcgccctgaagcagcacattaaccagcgcttgctagcgc

SEQ ID NO: 22946 - DNA, 107 bp, Zea mays
  Clone ID: cC-zmle189003b05d1
gccgacgcgtgggaaaaaaaaaaaaaaaaaaaaaaaaaaaaaaaattttaaaatttaaaaaaaaaaaacaaaaaaaagggggaaagggaaaaaaaaaaaaacaaaaa

SEQ ID NO: 22947 - DNA, 541 bp, Zea mays
  Clone ID: cC-zmle189003b06d1
cgggcaagcccaaggtggcggcgtccggcagcccctggttttgccttttccgcgtcaagtacctcggccccggctccggggagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggtctggccgacgaccccgaggccttccgcgagctcaaggtgaaggagctcaagaacgg

SEQ ID NO: 22948 - DNA, 277 bp, Zea mays
  Clone ID: cC-zmle189003c02d1
atccgcactagttctaaattgttcagctgcccttcgttccatcgcagcgtttgatttttagtttcgagatataataataaggggggggatgttagtttcgagatattagttggatgttgttattgttgtctcaaattataaaaaatcaagtgcaagtaaccaagacagctgaaaaaaatagttttgatgagatgctgcttcgtttttcttttctaaaaaaaaaaaaaaattaaaaaacaatatacccaaaaaataaaaaaaaaaattaaaaaataaa

SEQ ID NO: 22949 - DNA, 628 bp, Zea mays
  Clone ID: cC-zmle189003c03d1
gagcgagagcagcacacactgcacgcatctagctaggagcatttgtcatttgcggcgatggcggcctccatgatggcctggtgagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcttacattattttggtgctatatttatttacaacaacatctttcttctacttatctcctttcttttc

SEQ ID NO: 22950 - DNA, 517 bp, Zea mays
  unsure at all n locations
  Clone ID: cC-zmle189003c04d1
ccacgcgtccggtcatcgcgccaggcggttgggatganctgggttttacatttttcaacaagagcatgacggcgttgggcggggggtacaggaactggggccccggcgtcgacgccgtgcacggcgtctcctgggcgcgagagctcgactacttcgccgcccgccctttcctcggcaagagcttcgtcaacggataccactggctcacacctgatgtctgaaaaacacacaaacacacgcgcgagagtcaggagacacatcgattacagcaaaccagattaatttattcgtacagcataaagacagaataagacaccatttacaagccactgaatatgtatagtgatccactggcgcagaagtcagattcaagattcatttcgtctataaaaaatagtttccaaaacttcgtcatgtgcagtgtaaactagacagtgagcagtgagtctgttatgtctctgcataagagaccttggatgtgcaattcaggctggtccattatgtttgaatctgccct

SEQ ID NO: 22951 - DNA, 510 bp, Zea mays
  Clone ID: cC-zmle189003c05d1
ccacgcgtccggtcatcgcgccaggcggctgggatgactgggttttcattttcaacaagagcatgacggcgttcggcggggggtacaggaactggggccccggcgtcgacgccgtgcacggcgtctcctgggcgcgagagctcgactacttcgccgcccgccctttcctcggcaagagcttcgtcaacggataccactggctcacacctgatgtctgaaaaacacacaaacacacgcgcgagagtcaggagacacatcgattacagcaaaccagattaatttattcgtacagcataaagacagaataagacaccatttacaagccactgaatatgtatagtgatccactggcgcagaagtcagattcaagattcatttcgtctataaaaaatagtttccaaaacttcgtcatgtgcagtgtaaactagacagtgagcagtgagtctgttatgtctctgcataggagaccttggatgtgcaattcaagttgttccattatgtttgaatctg

SEQ ID NO: 22952 - DNA, 84 bp, Zea mays
  Clone ID: cC-zmle189003d02d1
ccacgcgtccgcggacgcatgggcggacccgcgggcaaaaaaatttaattataaacaccaaaaaaaaccacaagggggcggggg

SEQ ID NO: 22953 - DNA, 96 bp, Zea mays
  Clone ID: cC-zmle189003d03d1
cgtttgattgaaaaaaaaaaaaaaaaaaaaaaaaacaaaatttttaattttaacaaacaaacacatacatacggggtcggggcaataatatataga

SEQ ID NO: 22954 - DNA, 645 bp, Zea mays
  Clone ID: cC-zmle189003d04d1
ggaacgatgattgagattcccagggcagctctagtggctgacgtgatcttttgagcaggctgaattcttctcctggggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtatttaatggcagcgctcataaaagctacagttccatctattttcttagctatgaaaaacttccaaactgtccatgcttaaaactgagggttctcgtggtgtgagatgtgcctgtctttgttgaggccattgctgacatttcacctattgaggccctccta

SEQ ID NO: 22955 - DNA, 590 bp, Zea mays
  Clone ID: cC-zmle189003d05d1
gatgcctatgtctccaccaccgtcgctcagccgcttgcctttttgttttttcgccggatctactatccgacgcgccacgggttgcgctgtgcttaaggtcctactcaccggtcttctcgtcgacagcgccagtcgtgtctcccgccacaccgacactttttctccatcgctcgactccgtgctcagcgctctcaccatcaccgcgtctctcctcgccggtgttcgccgggcatacgctcaacctcgccaccgtgggacttacctcgcctccaaaccgtgttcgccgcagcccagccatcgtctacctctacgcttagcacgaaacagctcgccctacagcctcgtcgcgtcaccgtcctgcaggcactgagctccacccacctcggcgaaggccaccgtccccttcttcactgtgcactcggcatcagcttcctggtgcacaccgacacaacactctggttgcgcgccctccatcgcacgctcagacacttgcccctgtttgtcacctcaggacttcaccgtcatccgtacttcgctggttgtaacttcgctggctgtgttcgacctccagccacgtcaccatcgtgccc

SEQ ID NO: 22956 - DNA, 444 bp, Zea mays
  Clone ID: cC-zmle189003d06d1
cagaagcggccgactccgacactgggcacccccacaaaacacttttcagtttcaaccaacagccgcccacccttgggcacggggttcaagagcacggatggtctggatgggtcagagaaggcgcttctgcatgagctgcatgctctggatgaacatgctaaagctcatggcccctacataaatggggcgaacgcgtcagcgactgatcttagcctggggccaaagctgttccacctacagagcgcactggaccatctcaaaggctggaagatcccagagaactctaaccaatgtccatgcctacaccaaggctctgttcagccgtgactctttagacaagactaagccatccggggagcacgtgattgcagcatgggcgcccatggtgaatgcataaaaccctcgtgctttggtgctacctgcaggactgcatacatgtatctt

SEQ ID NO: 22957 - DNA, 430 bp, Zea mays
  Clone ID: cC-zmle189003e01d1
acccgtgcgagcatatactcttaggccgaaaaggggggacaccatcttttgtgttccactgaaacacaggcgatgctggggagggggcatagctcttggaacttggaaacacggagcttggggagctgctaagttgctacaaattccccagggatgagatctcaatcatccataggtcagcgcagctttgtttgctagggaacgtggactagataggaacagaatgcaaattttgaaattaatggacgcagttgatgagtacatccctgaacctgagaggcatcttgggagcctttttgagccacagaatatgtgctcctattacggtcgtggaactgttgttactgggcgtgaagaacaaggaacagtcaaaacttgtcaacatgttgagagcaaaaacctggcacatactgatcccttgaagactaca

SEQ ID NO: 22958 - DNA, 572 bp, Zea mays
  Clone ID: cC-zmle189003e02d1
acccgtgcgcaagatgcctatgtctccaccaccgtcgctcagccgcttttctttttgttggctcgccggatctactatgggacgggccactgtttgcgctgtgcttaaggtcctactcaccggtcttctcgttcgacagcgccagtcgtgtttaccggcacaccgacactttttctccatcgctcgactccgtgctcagcgctctcaccatcaccgcgtctctcctcgccggtgttcgccgggcatacgctcaacctcgccaccgtgggacttacctcgccttcaaaccgtgttcgccgcagcccagccatcgtctacctctacgcttagcacgaaacagctcgccctacagcctggtcgcgtcaccgatctgcaggcactgagctccacccacctcggcgaaggccaccgtccccttcttcactgtgcactcggtattagcttcctggtgcacaccgacacaacactctggttgcgcgcccttcattgtacgctcagacacttgcccctgtttgtcacctcaagactttaccgtatacgtacttgctggttgtaacttagctgctgtgttc

SEQ ID NO: 22959 - DNA, 481 bp, Zea mays
  Clone ID: cC-zmle189003e03d1
gcgggttcgtggcgctgtatcacggacaagggcgccggctgtttttttttccggtactcggcgcgggagcaggggctgggggaggtgcgcaagctggtggatctgtaccacgggcggggcgagcaggtgagcgtgacggtcacggtccacatcctgggcagcgcgctggcgatgctgtgcgccttcgacatcgcggagacgcgcgcgaacgtgtcgccgggcgacagggtggcgccggtgtgcgtgttctccttcgccggcccgcgcgttgggaacgtttccttccggaggcggttcgagcgggagctgggcgtgcgggcgctgcgcgttgtgaacgtgcacgacagcgtgcccaaggtgcccggcgtgttctttaactagtcggcgtttcctgagctcgtcctgcggtcggtgtgacaggctgggccttggctgtgttgacacgcacctgggcgtgctgctgcaactggaccacaaggtg

SEQ ID NO: 22960 - DNA, 573 bp, Zea mays
  Clone ID: cC-zmle189003e04d1
gtccgcggacgcgtgggcggacgcgtgggcggacgcgtgggctttacgctttgggtactgcgtctgctttgatcccctcgagggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgcttgacgagaagaacccaaacggaaagctccctatcctgtacgaagttttcccatgtc

SEQ ID NO: 22961 - DNA, 361 bp, Zea mays
  Clone ID: cC-zmle189003e05d1
cgtccgcccacgcgtccgggaattgttgtggttcctggatctggttttgttttaagttcctggaacatggcacgtcggatgcgggatcctgccgcaggaagacaaaatccccgcggtgatcacccgcttcaaggctttccatgaggcgttcatggctgagtaccgtgactgaactgttacagtggctgagtaccatcgtgtagaccgaaacaaaataaagctccactctctctctctctgtctctgtgcgtgtgtgtgaactgatctctgaatggaagaacaatgtactctgttggcgcctttaatggcaattgaggaaaattttgatcaatataaaaaaaaaaaaaaaaatgaaataagg

SEQ ID NO: 22962 - DNA, 495 bp, Zea mays
  Clone ID: cC-zmle189003e06d1
gtccgagcaccaagagatcgacggcctgtgacaacaagctcattttcctttttccttgccaagaaatacaaatggggcgccggcaggcaggccgtcgaacgcagtactgccaccgcctccatggactgacgcgccttcgtctacgccgatgaactcgtgaagaccgcaaaaactatcgcatgcgcggggcggtgcatcctggacatggacgatgccaacacgacatgctgaaagcggctggcgaacatatgtctggataacacagatgccaaccgggctgcgtaccacacgctgctgggcactgtgtctgacctgggccataacatatacggcgccaacctctataaggagacgctgtaccaggactgcgaatactgccggaagatcgtgggcatactgccggagcatggcatcgcgccggggatcaaggtggacaagggcctggtcccgcttgtcgggtacaacaactagccttggcgccagtgccaggacaga

SEQ ID NO: 22963 - DNA, 370 bp, Zea mays
  Clone ID: cC-zmle189003f02d1
gtccggtataacactgccatatatataataaagaagcacattttgcactttctagggatcactctggctaatgggcccgggggacactttctttgagaaccatcgtcgtgacatgccgtaccacgccacgctagcagagcacaccgctcatggtacctgggttagcatacggaggcactctgtaccaagactctggtgttgacttaaaacactgccacacgagtactaaattcaaccgaagacaacatgttctgctcaggaaaaagcttatgtccttttaggctccatggccgaggccattcccttcaagcgcgactcgggggcctcgactgtaaaggacccaggcacacggcacgggggacaccactgt

SEQ ID NO: 22964 - DNA, 565 bp, Zea mays
  Clone ID: cC-zmle189003f05d1
gtccgcggacgcgtgggccggcaagcggaagaagaagctcgttttccttttaaccggaagcagaaagaggctgggatgaggaaggcgctggataacaacatgggggatgtcgacatgatctcagttgaagggtcttcagaagctgcatagggcaagtcccaagtgaagttcagtgtgaagaaaaactcaagaatacagataaagagattaaagggcaaaggcaggaagaaagccaaaaatgcaaaaccacctgccaaggagagagttgatgccatggtagaatgacagttgatgccatggtaccatgacggacaagactacatacatccctttgtatgttttctcagagtttgcagcatggaccgacctcaccgaacactggcgcgtgtctcttgcatcttctgcctgaatgttaaatagaagctacttaggcctggtgttaatgtacttcaaacatgaatctacctttaatagtggactatgcgaatttattcatgttcttattgcgtttatggggatgcttcattgtgaatgtcggcttctatagtaagcaacttgcataatc

SEQ ID NO: 22965 - DNA, 53 bp, Zea mays
  Clone ID: cC-zmle189003f06d1
cgtccgaaaaaaaaaaaaaaaaaaaaaaaataaaaaaaaaaaattttcggttt

SEQ ID NO: 22966 - DNA, 397 bp, Zea mays
  Clone ID: cC-zmle189003g01d1
tggatcggagcttgtttagacacaacagaggggaggcgcctacaaaaacactgcagggcataactgggatcatccaaaccatctaagaaggatctgaaggtcactcttgagcgagaagcaaaaggagtcaacaggtatgcgcatcgttacccagctggatatctctacaagcttgaaagtggcttgaagtgaaaccgacgtgggtgctgggcggaggttatgagaaagaggcctccacttccgatggcaacatcgaccaaactccatgtggaagtgggaaaagggcgctcacccgtcgaaggtgactggcccgtcatgctcactgtggatgacatgcctgatgagctcaatgagacctgagagagggcactctcttgaaactcaacaagggatgatc

SEQ ID NO: 22967 - DNA, 477 bp, Zea mays
  Clone ID: cC-zmle189003g02d1
cgtccgcccacgcgtccgcaaacgcgtattggagcttggatgtttatagttttctccctggcatacatgcggctctggaggggggcgatgacctgacttcattaaccaagtatttcaaatgccgtaggtgtcttacggtgcattgatctatacacaaatgtgaaaatgtgaatctttttcaaggattcaccagaaggaacatgaacatgttctattgttggcttatttgctggtgattggagtgaaacggataagctactactatgcggggatgctgagcaagacaaaacagtcaatggtgatacagaaggtaaaatgtgtaatggttatgatataatcctgatggctgaaactgtatacgcggtatatagacattcaaatctctacaagctcatcaagaagtgcttgcgctaccctgggggtgtggttaacatggcatggaagaagcaatactttgttataggcggcggcacaagg

SEQ ID NO: 22968 - DNA, 555 bp, Zea mays
  Clone ID: cC-zmle189003g03d1
cgtccgcccacgcgtccgcaaacgcgtattggagcttggatgtttatcattttttccctggcatttttgcgggtctgaggggggctgacctgattcatttccaagatttcaatgccgaggtgcttaggtgcttgactataccaaatgtaaaagtcaatcttttcaaggattcaccagaaggaacatgtacatgtccgattgttggtttctttgctggtgattggagtgaaatggataagctactactttgcggggatgctgagcaagacaaaacagccagtggtgatacagaaggtaaaatgtgtaatggttatgatatcatcctgatggctgagactgtttacgcggtatcttgacttccaaatctctacaggctcatcaagaagtgcttgcgctaccctgggggtgtggtttacatggcagggaagaagcattactttggagtaggtggtggccaaggcacattctgcgcttggttgaaaaagacggtgccatgcattctgagcggcttaatgatgttgctgaaggatcatccaatgtttgggagggttggaa

SEQ ID NO: 22969 - DNA, 340 bp, Zea mays
  Clone ID: cC-zmle189003g04d1
gtccgagagaggtctgctgctcaagttcctgctgctgggcggtttctctttttctggcctacgtcagcgcgtcggggtcacgggacctcctgccgatcaagaagggacctcaggagccgccgcagccgggcccgcgcggcaagatctaagctcagcttcttcatttgcatggtctagtagcttgctttgtactgctagcgccggtcgatccgtcgcaatcgtcatggatcatctctctatcttgttgttacgctgttcataatttggtatatttgccattccgctattgtgtactctttggcatacatacaataattaaaatggcgttgcgtggctctca

SEQ ID NO: 22970 - DNA, 413 bp, Zea mays
  Clone ID: cC-zmle189003g05d1
gagagaggtctgctgctcaagttcctgctgctgggcggtttctcttttctggcctacgtcagcgcgtcggggtcacgggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatggatcatctctctatcttgttgttacgctgttcataatttggtatatttgccattccgctattgtgtactctttggcatacatacaataattaaaatggcgttgcgtggctctcatatcaagtaaaggaaatctctttcaaacacttaactctcaaatgttattggaaaagggcccattaacgggcggccctt

SEQ ID NO: 22971 - DNA, 383 bp, Zea mays
  Clone ID: cC-zmle189003g06d1
gagggggcagacaggcggacagccagcaagcgacaacacttacgatttcctgacaagaagcaagcggcccggaccggggggagacaaacagcaaaagaaccccaggaacgacgtcctcaacgaacaaacagtaccacacctgacggacagcgcgctgagagatgggaagacacctgccggacccaaacttgacagacgggaccaaagaacacagggacccatgaccgggcacgagcaaagcgaaatcacaaaacgacaacatgagcccctggcccgagcagcacagggagagaacgcaaggccacccccgcagtacaaaaaggcccaacaggaacgtaagcaataataaagcggcgccgcggaaaaaagctccgggccgaaca

SEQ ID NO: 22972 - DNA, 282 bp, Zea mays
  Clone ID: cC-zmle189003h01d1
gcaggaggaccgccggggctcggcaacacgggtgattggcaaccgagggcagccgacacaggagcggggccatacaacgtgcagcaggcaacacgggacaacggacgaccacgcaccagcacaagcgccatcatggaacgggcactaaggaacggaaggcacaaaaaaaccgccgagaaggaagacgcagagagggccggagcgaacagcagcgagcccacagaccacgaaggacacactgacggaacgaccgacaacgcaacaacgggacagagcacacac

SEQ ID NO: 22973 - DNA, 161 bp, Zea mays
  unsure at all n locations
  Clone ID: cC-zmle189003h02d1
cacccgtccggccacgcgtacgattccttggaatatgaacactataccttgatcttttgacctataaaaangaactgataagtgcttgggcctgcttaaaaaaaaacaaaaaaaaaaaacactaacaaacacataaaaaacaaaaccacacgcaggccaca

SEQ ID NO: 22974 - DNA, 569 bp, Zea mays
  Clone ID: cC-zmle189003h03d1
ccgttcgcccacgcgtccgtgggttggcttctcctccccctccgtttcgtttacgggttcgtgaggttctccggggggcgggggcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggcttcagtggcggcggcggctactgtggtgggggcggccgctactgctgtggcaaccgtggcggcggctactgcaactccgacgggaactggaggaact

SEQ ID NO: 22975 - DNA, 568 bp, Zea mays
  Clone ID: cC-zmle189003h04d1
acccgtgcgcccacgcgtccgcacagcaatccacacaagcacttcgatttcattctggcgctgcgcacagacacaccaagcgtgggcaccaatggcttactaccaggaggtggactactgctcggaggaggtgaggtcggtggccccggtcggctttggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtactaggctatcgtacgtgcacgcactcagcttctgttcgaattacgacaataggctcgtgacctgaataaaacttcttcgtaatactaaaaaaaaaacaaaagggc

SEQ ID NO: 22976 - DNA, 375 bp, Zea mays
  Clone ID: cC-zmle189003h06d1
cccgtccggggacgcgtggcctggctcaaatgttaccgggagactttatcattttggacccagagacgcaaatcccggggacggggaggttgtaacatgtggaaagcttcaaggacgtggaaccttcaatgtgatccctgattcctgaactatgggtggtacaatactagccttgctgaaggagagtgggaggacaacgaagcagcggatcgaaaaggtgagtgtgactcaagctatcgtgcacagctgcagcactatcacggactcgctcagacaggaccgcacttgcttgccaccgaccatgaacagccccgagctacacacacttattcctgaacctgggctgggagacgggcccacccaggaacgtcaggg

SEQ ID NO: 22977 - DNA, 671 bp, Zea mays
  Clone ID: cC-zmle189006a07d1
cgcctacgcccacgcgtccgggaggacccctccgagccctgccacggccacatctcctcccttgcggtgctccgctcccaccgcaagggcgggctggccaccaagctcatgtccgccgcgcaggcagccatggaccaggtcttcggcgccgagtacgtctccctccacgtccgccgatcccaccgtgccgccttcaacctctacacctccactctcgggtaccagatccacgacatcgaggccaagtactacgccgatggagaggacgcgttcgacatgcgcaagcctctccggcagccgcaacctaagaagcaccaccatcaccaccaccacggccccggtgggtgctgctcccacgacgcacctacggcgacgactggttcttctcctcagtcttttagttcgccggataagaaggctaacacttgacggatgaagcatatctacagagaggagtcaccaagcccattggacttccgatacgcagctttttctaatagaatgggaaacgaattgtacctgaattgtttgtgtactttactttggctcaatcgtccgaccgtatctttgtaatcagtgagaatggcaagccaatgtccttgacatctattgtaattgtaaaacatgtggtataacgctgatcttagataccattgatattcgagctgagc

SEQ ID NO: 22978 - DNA, 528 bp, Zea mays
  Clone ID: cC-zmle189006a08d1
gcgtgcgggtcacctcttaacaccaggccgccgccattgcatctcccttttttcgtttctcggcaccctcgatggggagcggggttaacccacgcatcgaccggcgaacgccaccgtctcccatcgagatctctcccatctagaatacctccgtgctcagcgtcatggaccggcttctccaaaacgatcggcggcagtggccctaacgttccggcgggatcccaccccgcgggcgggagccatgcggcggcagggggaggcgcgacgcagcggacgcagtatccgtatgtgactggtacttcagtcattgccttgaaatacaaggatggtgtgatcatggcatgcgacactggagcatcctatggatcaactttgagatacaagagtgtggaacgcattaaggcctgttggcaagcatatcatcattggagcaagcggagagttcatcgatttccaagaaatcctgcgctatctggatgaactaactctttctgatcatatgtgggatgatggaaattctctgggccc

SEQ ID NO: 22979 - DNA, 337 bp, Zea mays
  Clone ID: cC-zmle189006a09d1
gcctggagagaacaccatgaccaaccgggaggacaagcacgcagtttttctattttctgagggcggaccccggaggggcaggggctattcaactggagggggcatactgcaccgctatggcacctccaggccttccaaagagtgacattttgactaactcttaggttggtaactgcaaactgagttcacgatgcttcgatccccgttgtcaagatgcgtaagacggggggctgggggaaggacactatgatgggaaatgacttcttctcggcccgcccgatctttgatcaccagggtccactctactatgccttcctattgagaaccggggaaaacc

SEQ ID NO: 22980 - DNA, 517 bp, Zea mays
  Clone ID: cC-zmle189006a10d1
cggccttcagaaacacacctagcgaatcgcactatcaacgacctaactttaatgtttttcaagacattatccctccttggggttcttggcctttttgtgagtgcaacaaatgcgttcattattccacaatgctcacttgctccgagtgccattattccacagttcctcccttcagttactttaatgggcttcgaacacccagctgtgcaagcctataggctacaacaagcgcttgcggtgagcgttttataacaaccaattgcccaattacaacaacaatccttggcacatctaaccatacaaaccatcgcaacgcagcagcaacaagcactgagccacctagccgtggtgaaccctatcggctacttgcaacaacagctgcttgcatccaacccacttgctttggcaaacgtagctgtataccaacaacaacaacagttgcaacagtttctaccagcgctcagtcaactagccatggtgaaccctatcgcctacctacaacagcaacaactttttt

SEQ ID NO: 22981 - DNA, 430 bp, Zea mays
  Clone ID: cC-zmle189006a11d1
attagccatctatcatatcagactttttatcttttttccaatcttgagcccatgaagggcctacgggtatcgttggaaaacttatgtaaagacgtataaatgttccacggcctatccatactgctgccaaaagaaagccaccaaacataccaggagcgatagcctatctcccactgagcccaaatttatgaaggcgtctaccaaaggctatgtacctaaaaaggccaacacaaccgataacatgggacacgccaagaaattactggagaacaagaaagatgagatgaccatacatgggcaccatctgaaatttaagagaaggctctttaccatgatggataacgtgcgcactgcctatgacagtgtgaccgacgttgccaacaagcaagcaaacgcccccaacggcaggtgcaaaagcagcaaatctaac

SEQ ID NO: 22982 - DNA, 148 bp, Zea mays
  Clone ID: cC-zmle189006b11d1
gaaaccacaaccaccaaacactcataacgacacaaccaaacggcgaccacaccacccaaaaacagcaaaaggccaaacacccagccccacgcccggcgcgccacggcaaacacaacaggcacacacctgcccccagacgcaaacccac

SEQ ID NO: 22983 - DNA, 493 bp, Zea mays
  unsure at all n locations
  Clone ID: cC-zmle189006b12d1
gattgtcgctgcaaattgatggtgtgtgattcgagtttacttatactcgctttcctggctgnaagcggcccatggggggtcgggtggtacactctgatggatcctgctcagttatctgtcgcacatgcatagtcgtctgaggtcttggagacaagggcaggtgcatgtggtcccaataacttgtaaggttctgccacagggactatagatgtgtgcggcgatggagagtccctacatgtcgtgtgtccaggttcatgtttcaaggttaaaactcgattggaatcgtctacctctcgcagataatgagactacttgttccactgtacttcattgattaataagtggataactagggtcttgcaaaagatgtagcttgatcaattgtagataccatgtgtggatagcctggtcctcatcttgtttaacgtattcattctaaaacctgaatagctcacatttgacttacattcagctagttgtttttggcaatcca

SEQ ID NO: 22984 - DNA, 485 bp, Zea mays
  Clone ID: cC-zmle189006c11d1
aacgaccacgcgtacgcccacgcgtccgccgccatctcgcccttcgcggttatcgctttaacgtcggggaacaagcaccgggggtccgggccgcgtggcacgccgatacctcccccatactcgtttggggatagcaactcccatgactacaatgggattagcttctctgttcccggtttgtttccggatggttccaacggcgaggatacgttttaccttgagcaataaagcgggcagctgggcaatcatgaaggcgctgctcttgtagcatatagcaaattccatgttgtggtgcaggagcagcctgaggccgtggttactctccctaatgggaacaacggaattggcactgagattgagtgcggagtgtaaaacggtggtgccgtgcatcaacgatcaccgaatggcaaatgctgttctagatgtgtttgaggaatgcctgaaggaggcaaagagctacgggattatcaatggtggcaatgtgg

SEQ ID NO: 22985 - DNA, 562 bp, Zea mays
  unsure at all n locations
  Clone ID: cC-zmle189006c12d1
aacgaccacgcgtgcgcatttgtatcatttatgttttctgatcactcatttgtagatttcngctcccaacaactgcaggatggggttagggagctggatgtgcaaaccaaattgtgcatcatggatggtttataccgattggcacgaagtgcgcaacatatacaagttttttcaaatacgatgaacagcaatggtggtagcgaggacggaaaggaactggagaacgcagaaacttcgtgcaagttcatggacccttggagcatcgagacgcagacaaacccgatcgatcggtctatagctctgctactttttcgcgagtcatctggcggccatgttccatgtggcttgttgcagctcgacgatgccttgttactgaaatcccctgctggtgtatgacttcctgcctgccacatctctatttcagggccctgctgctaacccaggatgtttctaagcatgtatgtaaaaaaaaaaacaagcgtatttgtgtagccattatgttgtactctgaatcacattaattttgtcatgtcttgatcctactgctaaacagcccatgtgc

SEQ ID NO: 22986 - DNA, 429 bp, Zea mays
  Clone ID: cC-zmle189006d10d1
gccagggcgcctaggctaacgaagtaatgttcttcaacaactacttttcctattttaacgcccggccatcacccgggggaccgtggcccctcctagagatacctgtgtactgatcatggttaagcacgtactccgatccattcccataccattaagccatgataatgatgatattgctccatggaccatgcatggtgctctggtcgatgccgaacgtgtgtacctgatacaatactattttaggactgaagctattcattatatatatcgaccgagctcgccactgacaagtccgagatcatgcatgtatgcttgactgcgagatcttaggaaaaatcatatctatatacgcaggttgggagatggctctcccttaattaatcaatacataccgcgtgttactagcctaaaaaaaaaaaaaaagggcgg

SEQ ID NO: 22987 - DNA, 465 bp, Zea mays
  Clone ID: cC-zmle189006d11d1
tgcaggatggcactcctccttggcttgctgctgcttttagtattttcgcccgcgaacgctgatgacgggggcggggggtactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagagacgggatgcagcaacaaagttccttacgaccctaacctgattaccggcatccaaggcctgaatcagcactggagcaacattaggtgccccaccaacaactggcagagcaactggaagaacgcctggaagaaggtcggctcctgctccggcctcagcgagaaagactacttcgagactgccctctcctttcctagccggatcaacccactcgttcgcctcaaagcccacaggtattgagcc

SEQ ID NO: 22988 - DNA, 399 bp, Zea mays
  Clone ID: cC-zmle189006e10d1
gcccttcgcgctcattcgacccgctccgcaacacgctttttgcacttttcaggcgaggcgcgctcggcgcgcggaggcctgggtcaccatcctaaacgactgcctcaccatgtacagcgatcgtctccttcaacgagggcgacccgttcacggagcccacactcacgctacaccggtcagaagaaggaggcctacaagctgtataccgccgacagccgggccaagatcaccggagggttctacttcaagtggtatctccagcgtgcactgggcatacttcctcctacacatgctcgaccacccctaccacttcaagtagaatacaaactcataaagatgcatacatataattaagctgcggcggcgatcactctattagcgtgcaaaggaatgccatat

SEQ ID NO: 22989 - DNA, 393 bp, Zea mays
  Clone ID: cC-zmle189006e12d1
cagtcccttggccccttttattttgcagcgccctctcggcggcgagggcaggggggcgcgcgctccgcggtcaccgcgcgcgctctaagcgcctatatctatggaccagcggccccccttctacatggcgcggagactgccgttgtggacagcaatgctccttccccttcctcctcaccggcgttggtaccgtcgtcgctgcatccccgccccacgatgagtgcccggcgcctacttatcgtggaatccgctcttagttcttcagacgcgtgctcgacgctggaactctgttaacccggacggtgctatggagggggataagttcaccttagcaacggcagttaaattttctcatgcaaacaaggatgactatattgccgaacttcttaatgc

SEQ ID NO: 22990 - DNA, 112 bp, Zea mays
  unsure at all n locations
  Clone ID: cC-zmle189006f11d1
gctcatgccatttcattttttgctctaggctctcgagcttcatgcattactgacatgnggagcccgtgcatgggccaggagactcaaaaaaaaaaaaaacaacaaccacacc

SEQ ID NO: 22991 - DNA, 353 bp, Zea mays
  Clone ID: cC-zmle189006f12d1
gggggagcaagcatccaattcgactgtttccattcctgtttatgctttttcggcgaaagaagcgcccgctcgggcacgggagctaattatcgattcgtcgctcacaagtgaagaaagggagctgatgcggaatcaagcccgcttcagagccacgttcgtgcttgacctgatgctttctactctattcggcgactgatgacgaaccagagcgagcctgtgattattactggaaggtgcacagttgatgtgggcgtgatgtatctttctaagctattgtatgccggtctttgtcttcacatctgacgatctgtgtgttggtactcaccacgcacgcaagtcttggttgtgcgtgt

SEQ ID NO: 22992 - DNA, 326 bp, Zea mays
  Clone ID: cC-zmle189006g09d1
ccgcccacgcgtccggtggttcgtcttctactacccctacttttcaggttttgaaacgcgaggagctccggagggcagaggggtgcgttaaccgatcgataaggccgtgtcccaagtagagtaccgctgctcctacagcggctctcgcctgggccacagacgacccattcctccacaacgccttcaatacctacggcgaggtcctctagtccaagatcatcctcgatcgggagacgctaaggtcccgcgacatcagcttcagcaccttttctcacggaggatgcgacgcggaacgccaacgagggcatgaaccgcaaggacctgga

SEQ ID NO: 22993 - DNA, 332 bp, Zea mays
  Clone ID: cC-zmle189006g10d1
cggggagaggcagggaacagcaccgacaccgccgagaaccttaacctttacggaaccaaaggggcccgcgcggggaacgggggcaaccaaaaggaccaggacgacgcacccccacgggcgcggaggccctgcgaaacggacaacggggccagcaccaagcccgtccaccaaaggcaaggcaagaaggagacctcccagaccgggagggagaaaacaaaggccaaccgccacaacggccagcgaaagacccccagcggtccaaaaagcacgagagacacgggccgaaccggccccaccgacagcacaacaagaagcggacagaccgaaaaaca

SEQ ID NO: 22994 - DNA, 456 bp, Zea mays
  Clone ID: cC-zmle189006g11d1
ggtaccctaaaggtgcatttggcttccaatgctccttggttagagctatacaagagctaaagaactacagtgatttcggatccaccaactattattgtcatatggtgatgtgggcacaaagggcgctctaaaggatgagcatgtttttgcatcggtacaatgtcaggccttaggggagcttttaccttctctggcaaatgatggtcacagagtactcatatttagtcagtggaccacaatgcttgacatccttgaatgggcattggaaattataggagttacatatagacgccttgatggagggaccgctgtgacagaaaggcagactatagtggacacgttcaacaacgatctttctatatttgcatgtttactttctacaagagctggaggccatggtctgaaccttgtttgagctgacccagtcattatacatgatttggattttaaccccca

SEQ ID NO: 22995 - DNA, 342 bp, Zea mays
  Clone ID: cC-zmle189006g12d1
gaagacgggggggaacaggaccggccacaacgaacgcgtttcaacgttgaacacccagaacgacaaggcggggggcgggggaaaaaacaagaacgacgacgcgccccaccccaaggccgacacggagcccgccgagacgcgcaagccacacgagggcgggagacacaggacaccccgaagagggacaggagaacgggaccgacaactacccacagcaagaggacaacgacatgcccgacagcaaacaaggccgaatacaaccagctgcggcacaatcgaggaggagcacggggatgccgcggcccacgccgcaacaaaaaaaatgacacaattgcagcccaa

SEQ ID NO: 22996 - DNA, 539 bp, Zea mays
  Clone ID: cC-zmle189006h07d1
ccgcccacgcgtccggagtcgagtcaggatcttggaggctctttaacgtgttctccagatgcagcaatcggtgttctcatgggcatcctaaagaacgctccaggcctcagggaaaggctactgacaggccctagcgccccggttcctcaagaaccttcttcactccagagggtaatgaccgaggaacatggcagcggcgcatcaagctctgcaggggtgccttcttctcttctgaggtcaaggacagcggcggacacgctggaggagctgaacaagtacaaggagattagagaatcaatactgaaccgcgacaaagggcattcctgcagcaccaagctgctggaggagaaacccgctgatggagatcggtagcaatatacgaaagcctgctgtacataagtagtagaagctagctgaccgtccttaagttgctggtgtctgctgagatgattttggaaactaggtagctgttaggagtgaccaataactcttatatattttacatgatactatatatataaggtatggaagacatatat

SEQ ID NO: 22997 - DNA, 87 bp, Zea mays
  Clone ID: cC-zmle189006h08d1
gggcgaaccacgcgtccggggacaccaacggccgggcaaccaacacgacgggccccctcccgttgacgaaccaaaacgcccccaccc

SEQ ID NO: 22998 - DNA, 474 bp, Zea mays
  Clone ID: cC-zmle189006h10d1
ggccgagattcgcatcttcgggactggcggcatcttccatcggaattttctgaacaagccatggcttcgggattggggcttcaagcaattggatttgcttggcttttcttcttgctatttcaagaatggcgcagccggaaaagaggcaacttgatgcattccacccctcttttatctggagatgagaatgttggcagcatgtctaccaaggcgtaacggcaaatgttgcgtgaagggatcggattttctctcatcaagggaataaagattaaagaatgaatacttgctctccaaattgcaggccttcaattcggtcgtttaatttcaagccagctgaaatgttcattgttttcacacattcttatgttttcattggaatttcattcccacttgtcctgttcctagcttgaaatgtacatgtgaatacacaaaaaaaaaccaaaacttgccacgattgggcagtcggcactgaaa

SEQ ID NO: 22999 - DNA, 510 bp, Zea mays
  Clone ID: cC-zmle189006h11d1
ccgcccacgcgtccgattggatgcttgttggcgatgtaccattggagttctcgctgactcttgccgcaggctcaggatcaggaaaggatcagatgcaattggacttgctccaagggcagctgataagtccaagaatcgcaactagaatggttgcttcttacagtccagagcaagagggagatatccagtgactgtagggatctttgtggaagccggaaaacgtctaacagtttcaagaagaattctgccttatggtctgtaccacatgtttttgctgctacgcaagtaaagaactccacgtctgtcaatgttagttttacaacatcgtctacggacaaaaaaaaaaaccccccgctatttgattgttgctaagccttcgtacgacgtgtaaatggtttggtacaatgagtgctgcgactacgattgagcacccctctacctagtttgcataaaaacagtgtcccatggactgtctgttgcccctctatataaatgtccaatgaagcttgc

SEQ ID NO: 23000 - DNA, 446 bp, Zea mays
  Clone ID: cC-zmle189006h12d1
cacgcgttcgggcttattgctacagccattggcccttttggcttttatagggactacctgttctcaatggagaagggattatccatcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgttgtggactcgagatagcgagagccttggacgttggacctctactcggaatctactttcagctcttgcatgtttgtggccatcatgtactgattttcccttttcaacagttgtcgtgaggctgtatcttctggagttaaaaaaaatgctaaaagccggcactaataatgatattaactcgcacattcatattctaccctcaataaaag

SEQ ID NO: 23001 - DNA, 394 bp, Zea mays
  Clone ID: cC-zmle189007a01d1
agacatccactacatatggatggtcacttttgcctttctgctgcgagcacgacggaaaagggatgcggggggacattcccatcaggaaagaagcacatacacatcatgaggagtaaaaaaaaaacttactagcgataatgtgagtacagtattgttcgttctatctatatggcgcttgcgactattatcacggagattcacgctaaatcggctcgcatgtcttgtgcccaaacaaggctaaggaccagttcgcgtaaaaaaatgtatgtttggaacttagctaagaattggagcccgaggaaacccctccatcctgagcaaactaatttgtggaaccctgcttctctgttatcgcgactcatgaatgacaatctcatgtccattttctgtgccc

SEQ ID NO: 23002 - DNA, 456 bp, Zea mays
  Clone ID: cC-zmle189007a02d1
gccgctgggccacctcaagcacccgctcttcggcgcgctgcttttggattttgagcgcgagtacggcttccgggggcagggggccctctccatcccctgccgcgtcgaccgcttcgtccagctcgagcgcctcatcggccgggacctccacggcgcctgcgctcaccacctcgtcgacctcgacggcgccgccgtcgccgccgcgcagcaccagcaccagcaccacctccacctgccgcgcttcgttggctgcttccgcgcctgacgacacggtacggcccgtccgtcgaggcggccgctgctgcttgtttcactactcgattaaccagcctttggtgtggctcgtcctccctctgcggatctctcctgtctctgagggctgatcgatcggcatgaagctctgtggcgagagagacctgggggtgggaggacgatgcatctagctgttgacgatga

SEQ ID NO: 23003 - DNA, 502 bp, Zea mays
  Clone ID: cC-zmle189007b01d1
ataggcgctgaaatgcgaccgttggctcgactcaagttttagattttttgaggtcgaagcataaaatccgggccccgggattattactcagaatgcactgctacctgctataagttaaacctgaacaagcggagcacataggtgatgaccgtacgaacgactcatagggagcgagggatccatgctgcaaggcctggctgtggagcattgaccgtcactccttcaaggagattacggacaggatcgcatttgaggtgtagcaggttgctagaccttgatctgcgccacttagacccgggcagtgtgtacatatctccaagagaactaacagaagtccatcagtttattctgtgtgcgagtgagccaggcccattgaagcaaacaccggacgggatttccacgctctcgtgtatcaaatactgaacgtgcaggagctctgtccggattgcattcacagagaaaagggttccataaaggaccactgatatggatgcccagaaac

SEQ ID NO: 23004 - DNA, 309 bp, Zea mays
  Clone ID: cC-zmle189007b02d1
ccgcgcggagcctgcacggaggaggagcacgcccggccgttcgcctttgacggggacgacgaccacggcgggggggcgggggcggggagggccgcggcggacacggccgcgccggaggcggggcagcgcggacagccgccagagccacgcggcgaagcggccgcagcccgggcccggggagaacccggccgcgcacgaagccgcggaccagccggcgctcgcggggcgcgacccggccggagccggcaccgccgccggcgcgctgcccgcggcgaccgcccggggccagcaaccgggcggccccgaccg

SEQ ID NO: 23005 - DNA, 564 bp, Zea mays
  Clone ID: cC-zmle189007b03d1
tacgcgcacgcgtgggccatgcgcagcaccctggcaacaagagcgttgttttcgtgttcaaggcagcaggggaaaagtggcggtctatgtgagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggataacgacgacgacgagtaaatagtatttccgctgttgtgaggtagcaaatcgattgttaggtccccaattagctcactggtttgctatctttaatgttaagttgtttggaacaggtgtttatgaaggggatctattagtttcgtgaggatgttagtttagtgcattagcaaagaaaaagccgaatgctgctagctattatgttgcttttctttggctaatcacttgtgtcacaactttctgtacctggtttcactgactaatctagtgactagtcaggtatgggtttaatggttaaacaaac

SEQ ID NO: 23006 - DNA, 94 bp, Zea mays
  unsure at all n locations
  Clone ID: cC-zmle189007c01d1
aaaaaaaagagaaanagagaaaaaaaaaaaaaaaagaaaaagaaaaagaaaaaaaaaaaaagggaagaaaaaaaaaaaaaaaaagagagaacgg

SEQ ID NO: 23007 - DNA, 462 bp, Zea mays
  Clone ID: cC-zmle189007c02d1
cgctcacccacctagctagtcatcactagtcacgttcgtccaccagatacaacatttgccatggagacgtgcttcagagggtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaggactacgccggcaagatcacgtgctgcaaggtgaacacggacgacagccccaacgtggcgtttacctactgcatccgcagcattcccaacgtgctc

SEQ ID NO: 23008 - DNA, 221 bp, Zea mays
  Clone ID: cC-zmle189007c03d1
tacggccggatgcaaacaagcctgacgaggagcattagtagccaaacattttcatctttcatgccatgccatgccatgcttggacaaggaccattttcgtgtgtcctttccttcaatcgtcgacctttcgttttgttgttatactgctattgtggaaccctgttactgttactgttagtgtatcctattggcaataatcaaatgtggtatggttgactact

SEQ ID NO: 23009 - DNA, 401 bp, Zea mays
  Clone ID: cC-zmle189007d01d1
gcgtgcgggcgagacacacacgccacagccagagaccgagtacaactttccgcccccggagcaggacacgagggcggcggggcaggacccggcgaggacgacgaccgcccccaaggaggagcaggcagacggccgcagcgccaagagcggcacccacgacgcggcacccaactacgacgacacccagggcaagaacagcggacccgacacgccgccgccgcccggggaggacccccacaccccgctctgcgcgacccccaggggcaaggggaaccagcccgccggagccgccgggatgggacagtcccgagccgaggccaggaaggaaccccggaacacgagacgaagacgggggcgaacaccgccaaaacaggcaaagacgcgaacccgaccccgacccc

SEQ ID NO: 23010 - DNA, 514 bp, Zea mays
  Clone ID: cC-zmle189007d02d1
cggccgaagcgagggcgttgaggatctgctgataacaagctccggattacactgtttctaccaaaggcaggtactgtggggtgtggggataacactgtaaccaataacctgtacaccatttctgagaagggaataaaaggtcgtcttaacaggcttcccttcttcctgtgatggtgacatggctatggccaccgcgaagaatggatagcctgaccttagaaagaaggcgatgccacgctgctattgtgaggcaccgcaagccacggcgccgaaaggatggtgtcacatgtactttgaagacaatgctggagtgattgcgaacccaaacggagagaagaaatgttctgccatcactggaccgattggaaaggaatgcacggatctctggcccatgattgctagcgcggtaaatgctattgactaaaggcaccagcttgtcaaagcttcacttcaaatggggacttgacaagggagcttctaacttatgcgagcttccaaattgccccccatatgt

SEQ ID NO: 23011 - DNA, 573 bp, Zea mays
  Clone ID: cC-zmle189007d03d1
acggcagacagctggtgatgcccgaggacgggtacgagtgttttgaagttttgccagaagttcatcaagaacatgcagaaagggaggagctacttccggtgccggcacaggctgtgcggcgccaagaagaaggtggagtggcacccgcgcgaccccggcggcgacctccgcatcgtctacgacggcgcgcaccagcacgggcccccgccgctggcggctcctcccggcggccacggccagatgcagggcggcggcgcctccgactccaacagatacgagctgtgcacccagtacttcggcggggcccggtcgcgctgacgacctggcgggccagctagctagcgtcgggggtggcatggcagctgacaagaaaggccggccggcgggcggcggcgtggcgtcccgtcgcgtcacgctcacgcccgcattaccttctgcccctgctggctgctggcctgctgcagcaccgatcgctttcgctgcgcaccggaaggcagcggcagcggcagcgggtggctggtgctgccggtggcggttgacttgacgccttgcgccggcgcaaccgacgttgat

SEQ ID NO: 23012 - DNA, 113 bp, Zea mays
  Clone ID: cC-zmle189007e02d1
gaaaaaaaaaaaaaaataaaaaatcaaaaataaaaaatttacatttttacacaacaaaaaaaaaaaaaggggcacagggaaaaaacaaaaaaaaaaaaaacaacccccccccc

SEQ ID NO: 23013 - DNA, 95 bp, Zea mays
  Clone ID: cC-zmle189007e03d1
gaaaaaaaaaaaaaaaaatgaaaaaaaaaaaaccaaaaatttttcaattttcaaaaaacaaaacaaaaaacaggaacaaaagaaaaaaaaagacg

SEQ ID NO: 23014 - DNA, 491 bp, Zea mays
  Clone ID: cC-zmle189007f02d1
ccgaccacgcgttcggattgtgcccaataaatctattgagtttcggacttttagatcgccagatcataagctctgggcactggggtatttttcaacacatgcattttattcattcattatatatcgatgatgattgacatgtatatcgatcaggtagcatcacggatggatgcatgcattttgaacgcctcaatatggacagcagcacttccatgggtctatattcggtcatgtcatgctctatagtgtgttagccaatttcatagtagattaccagccagcaacaccactcacaaaggtgactgtgtgaccgatgcttccggggcagggacgactatcttctcaagattatagctttgagtatgctgtaaaattctacagattttgtgcttgtccttcaacactttaccataatccaacacgagagaaaattataccgtctttgtcccaactacagttctccttaacacttgctatatggtggatttaac

SEQ ID NO: 23015 - DNA, 452 bp, Zea mays
  unsure at all n locations
  Clone ID: cC-zmle189007g01d1
ccgagtgagaccaactagcaacatagaaagcacaatagngttccaacatttgcagccaaaacattctgcctccggatgcgggttggtctttctgcaagtgctgctacggcgaccattttcccacaatgctcacaagctcctatagctccccttcttcccccgaccctctcaccaagcggcgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaactggtgctaacaaaccttgctgcctactctcagcaacaacagattcttccattcaaccaactagctgcattgaaccctgcttcttatttgcaacaacaac

SEQ ID NO: 23016 - DNA, 503 bp, Zea mays
  Clone ID: cC-zmle189007g03d1
ccggagtgtccatgctcatttggggcgcactggtagtaggtttgatgttttagagccactggcatacacccttattttcgtgataagaggaagattaccttggcaaggctaccagggagataccaagagtttccttgtttgcaagaagaaaatggctacttctacggagatgctttgttgatattgtccagctccattcaaacagtttcttgagattgtcacaaatatgaaatttgacgaatagccaaattatgccaagcttatctctctttttgatggtttgattgaagcgcctgcttcgagacaaatcagaattgatggggctctcaaggttggacagaaacgtggaagattggttgcagatctagaagaagatgaacaacctacaaagaaggttagattagggagcccagcggctcaatggatttcagtttataatgctaggcggcccatgaagcagaggtaccattacaatgtggctgactcgaggcctagccaacata

SEQ ID NO: 23017 - DNA, 431 bp, Zea mays
  Clone ID: cC-zmle189007h01d1
gtccgagtgaagagatatcacagggacctcttcaggcttcaagttagattcttagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagcttcccgttgcagtcctgcgtgatcgagttcttgagcggcgacatctggtgcatgctcttgacgactgatggcgttcttgggttttataaaaaataaccat

SEQ ID NO: 23018 - DNA, 365 bp, Zea mays
  Clone ID: cC-zmle189007h03d1
gcggacgcgtgggcgcgcccccagacccagacacgcaccttacagttttcacgcgtacacctcccgcagccatggcatggggaggcttcggcacggacgcgccggccgtggcatcatcgccggcggccaggacgacgagcgtgggccgcccctccgcggtgcacgtccctgcggcgacgaccaaggtcgtcgcagcggctgcggtggcggggaagcgggaggagaatggcctgttcgacaccatctttggcgcgctgtacaaggaggagcacactgctggagacggaccccgtcctgaataaggtggggagcaagggcaaggccgccgccgtcctgcgcctcaaaaagccgctgaagagggctgt

SEQ ID NO: 23019 - DNA, 110 bp, Zea mays
  Clone ID: cC-zmle189018a01a1
catatttgtttttgtgatgacctatcatgcggaggctatcaatcacctaatttaggggcatggtccactacacaacgaaacaatgtacgatatggatcattaacacgccc

SEQ ID NO: 23020 - DNA, 426 bp, Zea mays
  Clone ID: cC-zmle189018a01d1
gcaagggggtggatgcctttgaaccatcctcatcaaggaagagacccttcagcgacgtcaaccgaaaaggtgcaggtgctttacctaatggcagtgctacagatcagcatgatgagtccgaggatagtgaccagaagatgtgatgctctgctctctgctctaatttttagctcaggctgaagtagctttgctgcttgaatgataacaagtcaattgtgatccctgcatattctatggttgtatggtatattggcaagttagactttttctgtttatacaagttctgtgaccaactgctataggatatttgagttttcaaatctgctgctgtgagtttcttcttaatataggataaatttgttgactattactcttgacagttttgtggtatgtttaacttgtaatcattcaagaagtgttgtaaaa

SEQ ID NO: 23021 - DNA, 226 bp, Zea mays
  Clone ID: cC-zmle189018a02a1
aaagacaatgaacacaatttttccttgtcgattgaacaatagtttacatcatggtacaaaccgaaaaccagcgtgcgctcacatgcatccggacacctaaaggtcaccgggggggcctcccttacttgccggggacaaagttggtggcgtatgcccaagcgttgttgttgacggggtcggcaattgtggcagagaggttcttgagcgggcccttcccggtgaccat

SEQ ID NO: 23022 - DNA, 408 bp, Zea mays
  Clone ID: cC-zmle189018a02d1
gaaaaaaaaaataaaaaaaaaaaacaataaaaaaaaaaaaaaaaaatagaaaaaaaaaccataaacgtgggcggggggacttaaccaggggggccgtgaacgtgccgtcgtcgtccgccttcagcgaggcccgcgtgacgatgcgcatgacggcggcgaaggtcaatccggcggcggggtccgggagcccgtggtacgggcccgacacgatgctgtacctgggcccactgtccggcgagccgccgagctacctgacgggcgatgttccctgacgactacggctgggacaccgcggggctgtcggcggacccggagacattcgccaagaaccgggagctggatgtgatccactcccgctgggccatgctgggcgcgctcggctgcgttttaccggaacttttcgcccgc

SEQ ID NO: 23023 - DNA, 501 bp, Zea mays
  Clone ID: cC-zmle189018a03a1
ttttgtgatggcatatcatatcgtatctatcattaacctagctaagtagcatattacattacattacgttatgttatatgatatctatcattaacccagccaagtagcatgtaaagctgactcttattctccgcgcaccgcgctttatcaactatggttcaaagattttcccttgagatcaaaccaaacccagcatgcatcagcctgcgatcaaatcaccgcccgtcgtcgatgactccagtcatcgccggcgacggggtgagaggcgcagtcgtctccctctgcacgctgaactccccggtcgtgtcgccagagtagccgctggtaacatagctgctgttcccacccctgcgctgccactcagtgatgtagcttggcttggtcaccacctcaggcacctcgatgtcttcggtgagcatcttcactacacgcgacatcggtggccgctggtgaggcgaaccctgcgtgcagaggagcgcaacattgatgactctgatgact

SEQ ID NO: 23024 - DNA, 445 bp, Zea mays
  Clone ID: cC-zmle189018a03d1
cgagatcattttaggtattgcaagaggcctaacctatcttcatgaggagtccagcgtgcgcatcgtgcatagggacatcaaggccagcaatgttctacttgacaccgacctcacgcccaagatttccgatttcaggcttgccaagctctttgatgagaagaagactcatgtcagcactaaaatcgcaggcacgtttggctacctggcgcctgagtatgcaatgagaggccatctgactgaaaaggccgacgtcttcgccttcggggtattggcaatggagactgtcgcaggtcgaccaaacactgacaattccttggaggaacacaggatctatctctttgagtgggcctgggagctgtacgagagggaccaagcactttgcatcctggacccaagatcgaagaatcgacggtgaagacgcagtcatcagagtcatcaaatgtgc

SEQ ID NO: 23025 - DNA, 420 bp, Zea mays
  Clone ID: cC-zmle189018a04a1
ttttagcagaatggatgcttttgacattttattagtcgtagtagcaaaatcatgcccagctggaaaaaaaatagttgcaaaactatgcatctgatctctactgtgattctggaactgcctgtttacagttacaaccttcaaaatgaaaagtgttatgcttgagctaaaactgttatacaaatgaacaaacctgacttgtattatcttggcatatacaacttgcttgacacaacaccggaatttgaatctctcttctgtagtctgtacacttaatatacacaactaaaaatcactcttcagcaagtaagaccagatgtgtgctgaatcctgtgctcaatttatgcttcaacccttgagatatttgtgggagcagatgcctgtgtggtcatcttgccttttagctcttcaaaagctttcatg

SEQ ID NO: 23026 - DNA, 535 bp, Zea mays
  Clone ID: cC-zmle189018a04d1
ttcctgggtctacccacgcgtccggaccgtctcacgctacaaggagtacgggatcccatttgactggctgtcatattctggagtagttggcaagatcaaagtggcatctgttcagcttgcaaacaagtatatgaagagggttgcctcacaacttgatgcattagaaggcactgagaaagagcccaatagagagtttctgcttctccagggtgtgaggttcgctttccgggttcatcagtttgctgggggctttgatgcataaagcatgaaagcttttgaagagctaagaagcgcgatgaccacacacgcatctgctccaccaatatctcaaggctgaagcataaattgagcacaggattcatcacacatctggtcttacttgctggagagtgatttttagttgtgtatattaagcgtacagactacagaagagagattcaaattccggtgttgtgtcagcaagttgtatatgccaagatatacaagtcaggcctgttcatttgttaacagttttagctcaagctaacacttttca

SEQ ID NO: 23027 - DNA, 523 bp, Zea mays
  Clone ID: cC-zmle189018a05d1
atttttaggtccacccaggcgtacggagaccaacttgaaacatttaaagcacaattgtgttccaactattggctcttcaaatatttccgcctgggtatggggcgttggtctttttgcaaatgctggtacggcgaccatttttccacaaagctcacaagctcctatagcttacctttttcccccgtacctataaccaacagcggtctcggggttgtgaaaaccacaattttttaaccctacaggatccaacaggcaatcggagctgggattttacctttttaacccttgttcctccaacaattataagcccttatacagcagttacctttggtgcatttattggcacaaaacattagggcacatcaactacaacaacttgtgcttgcaaaccttgttgcctacttttaaaacaggagtttttttcattaaacccaacacctgcattgaactttgttttttattgaacaacaacaactaccattaagccgcttattgttgcctcccccagcattttttcctttaa

SEQ ID NO: 23028 - DNA, 424 bp, Zea mays
  unsure at all n locations
  Clone ID: cC-zmle189018a06a1
ggaaacaaatactttgggatcaaattttcaaatacagagagatcaccatgtgtgcgccattattaacaactaatgaagatgcagcgcacaccatgcgtgtaataatctataagattttacagtacagtacagggatcgatcatttttggaacaaaatatatatatgcgcagtcctagattatatatggtattatcattgncattgacattgagcacgcatgcatgcatccatgcacgagctgactatccccgatcgaccgggggtgtatcaggcgattgattttgcctcatctacaagcgcgacgggatggcgctgagcttgtcggactcggtgatgatgtgcttgcgggtgatttcggcgagggaggtgcagccgctgagcgccatggtgagcttgaacttgtcccgaaaaatgcgcaggacg

SEQ ID NO: 23029 - DNA, 447 bp, Zea mays
  Clone ID: cC-zmle189018a06d1
cccacccgtccggctggcgttctccctcgcggcggcggacgaagccagcgtgttcaacgttctgcgcatgctgcgggactagagggagctcgccatggcgctcaccggatggaccaatcactcctatatatctcgcaagcacaagctgaccgacgtccacatgcttagagtcatcctcgccatcttggagatgaggcgaaaatcaaatcggctgctactcagtcggtcgatcggcgattatcacagtcgtgcatggatgcatgcatgcacgctcaatgtcaattacgatcatgattccatacataattcatgacagagggtccgtgcaatttgtctcagaaatgatcgaccactgtactgtactgtaaaatctcataaaccattacacgcacggagtgcgctgcatcttattaattgagaataatggtgcacacatcgagaactctc

SEQ ID NO: 23030 - DNA, 528 bp, Zea mays
  unsure at all n locations
  Clone ID: cC-zmle189018a07a1
ggaaaacaaacagtagcacgagcttcaacgcagaagtctacaattcagaaaccacggataaaccacgaacatatcagagggttatgttgggctactgataattcgactatagcttgcaatacatcttttagcaaaggcaaactctgacccacatttgctggccccccagttacacgtaactgtctatcagagacttcctcatgtcctccacaatcgcagtgggctgcccttctctcagcttgaagacgctttcgatgactgagagctcggtggctgtcgtgtccgagccacaaaaggcagtccagtcgttcactgtcatgcctgcagcaatgacctcgcttcctctgttcacagttcctgcgacaagaggaacttggaggagcgtggagagctcgtcaaggtcttcaacggatgtatggggatgaaccaaaccacccctgttagagaaggcgcagtaactccccacaaggatatttccagcaatagtttgcctaaacacctcgaccccaagcacatntgcaatgaact

SEQ ID NO: 23031 - DNA, 535 bp, Zea mays
  unsure at all n locations
  Clone ID: cC-zmle189018a07d1
cccacgcgtccgcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtgngtggttcagcgcattgatgagaggttatctgcccttggcaattgcatagcctgcaatgaccatgttgcacttacgcaccctgaccttgacaaggagactgaggagttcattgcagatgt

SEQ ID NO: 23032 - DNA, 452 bp, Zea mays
  Clone ID: cC-zmle189018a08a1
aggttaaatgaacccaaggtaggtcagccttgttgtaaaacttgtcaaggaacttcagtaggccagtgtttcgagagaaaattacaaacatctttttcacgtgggagaaaaaaaatacgggcatgccagtgttctaagtacacaaaataaatagaggaacaagtgttccattaaactttacataaaataaatacaagtccctcggatgcgcttcataaattgctggcagcaatattaacttggacgatatggtcttctggttcccgtggcctcagaaagctcctggttaattaattacgttgtaatacaccttcgattaagctgaaatgcaaggtcaagtattgctgcttggctgtatgagaacttgagccaaggagacccattgtttgacttatctttccgagcatctgtctgaatctgggacccaacaataaaactccagctgggaaact

SEQ ID NO: 23033 - DNA, 567 bp, Zea mays
  Clone ID: cC-zmle189018a08d1
cccacgcgtccgtgcctctgaagaaagtcaacaggtgcctgttatcctgtttgtgaaggatgttgagaaaatatgtggaaataattacacctaccatggtctaaagaataagcttgaaagtttcccagctggagttttattgttgggtcccagattcagacagatgctcggaaagataagtcaaacaatgggtctccttggctcaagttctcatacagccaagcagcaatacttgaccttgcatttcagcttaatcgaaggtgtattacaacgtaattaattaaccaggagctttctgaggccacgggaaccagaagaccatatcgtccaagttaatattgctgccagcaatttatgaagcgcatccgagggacttgtatttattttatgtaaagtttaatggaatacttgttcctctatttattttgtgtacttagtacactggcatgcccgtattttttttctcccacgtgaaaaagatgtttgtaattttctctcgaaacactggcctacttgagttccttgacaagttttacaccagggtgactaccttgggttcattacctt

SEQ ID NO: 23034 - DNA, 528 bp, Zea mays
  Clone ID: cC-zmle189018a09a1
caaaaatcatgatgctccaatgcaaaagatttacagctttacatcgcgttactccgatttttttttcagatgaattttactcaccagtcgccagcatgtacaaagcagtaagtaggatagtgttttatactatcaccaattcaccagtgctaataggtgacgtttcatacagaaggggacgatgttcatgtgcgcctgcggccggcctactcctccctgggtatccaccggctccaccagatgcttttgcgctggctgttgagcttgtccatgctctccttgaacgttctcatgatctttctctgcaggcgcagaacggaggcaagcgcgttccgctgggggctgcttttctttggttatattcccctaagcttttgaaactgtgcttttgtaaagcctcccacatctttagttcctgaccttgccatgagggcggtaacccaccgcgctgcttcactggagtccttctggggtgcgcggaacagtggcacccgttcgttttgcatgacgggaaggccaaggagccct

SEQ ID NO: 23035 - DNA, 57 bp, Zea mays
  Clone ID: cC-zmle189018a09d1
taaagataccttctgatctcaattgccacaacataagttttcttcttatccagaatt

SEQ ID NO: 23036 - DNA, 387 bp, Zea mays
  Clone ID: cC-zmle189018a10d1
gcgttcgcccacgcctccggacgactactaggtggagatggtcatttactttatgcacgaattcttcgtcaaatgcggaggcccggccgaaagtatctcccaaggtggtgtctggaaggttctggtagaactgcctgatgcatacccttacaaatccccgtccatcggcttcatcaacaagatttatcacccgaatgtccatgagatgtctggctctgtctgtttggatgtcataaaccatacatggagcccaatgtttgatctattgaatgtttttgaagtattccttccacaggtgttgctgtacccaaatacttctgatccatttaatggggaggctgcagcactgatgatgcctgatctgccttgttttgaacagaaagtgat

SEQ ID NO: 23037 - DNA, 290 bp, Zea mays
  Clone ID: cC-zmle189018a11a1
gaagctgaaccaatttattggttgtgtttaggaaacacatgccggagtgagggaaccgttctggagggcctttaatatgtcatttaaaaggacgcaccctcaacatggggttgctgcctcaacaacacaggtgtctgaaaaaagaaccactcgcatggcagatattgttggtgcagacagaaggccccgaccaaggggttggcctctgtcaatggattaagttactgctgacgcttgtgtgggttcggcccaaagtctctcattgatagtgggcataattgaagcctgtg

SEQ ID NO: 23038 - DNA, 491 bp, Zea mays
  Clone ID: cC-zmle189018a11d1
caacaactgcaacagtttctgccagcgcttagtcaactagccatggtgaaccctgccgcctacctacaacagcaacaactgctttcatctagcctgctcgctgtggccaatgcacctacatacctgcaacaagaattgttgcaacagattgtaccagctctaactcagctagctgtggcaaaccctgttgcctacttgcaacagctgcttccattcaaccaactaactatgtcgaactctgttgcgtacctacaacagcgacaacagttacttaatccattggcagtggctaacccattggtcgctgccttcctacagcagcaacaattgctgccatacaaccggttctctttgatgaatcctgtcttgtcgaggcagcaacccatcgttggaggtgccatcttttagattacatatgagatgtactcgataatggtgccctcataccggcatgtgtttcctagaaataatcaatatattggttgagattt

SEQ ID NO: 23039 - DNA, 249 bp, Zea mays
  Clone ID: cC-zmle189018a12a1
ggggtgggttttttttttttttttttttttttaaacccccaaccaccgtttttttttttttgggggaaacccttaattcacacaaaaagaatggcttggccccacaaataatcaaggggggggggttcgggggcccaagcccccacctttttttgccttaaaaaaaaaccactggttcgtgtggtttcagtttctcaaaaagggctccccccccctttgggggggccccttttctctctgggggtaaaa

SEQ ID NO: 23040 - DNA, 488 bp, Zea mays
  unsure at all n locations
  Clone ID: cC-zmle189018a12d1
cggacgcgtgggcggacgcgtgggctcacaaccttctccacctcttctactacccacttcttgatatcatgtctgacctcggccgtgagagcttgaccgacaaggccaccgccgcccttaagcccgactctgagaagtcgaccaccgagcacctcggtgacaagttcaagggcaacgccgactctgctgcctcgactcttcagccccagagcgagaagtcgaccacccagaaggtcggtgacaccttctcgagcaactcgaaccacaacgaccagtcgctccttgacaaggccaagaacgctgtcggcctcggcacctcgaaccccacccactgatcaattgtcggcccaatgcaatcatcatgtgtacaactagcattcaaccaataatatactatcagttgtctacgatttanaaaaaaaaaaacactaaaacaataaagaaaaaaaatggaaggattaaaaaaaaaagaaaactataaaaaatat

SEQ ID NO: 23041 - DNA, 412 bp, Zea mays
  Clone ID: cC-zmle189018b01d1
gcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcacaacaacgcttgggcctacgccaccaacttcgtcccc

SEQ ID NO: 23042 - DNA, 269 bp, Zea mays
  Clone ID: cC-zmle189018b02d1
acccgtacgagtcacaggtattgcacgaagcctaacttatcttcatgtggagttcatccaccaccatcgtgcataggggcatcggggacagcaatgttctacttgacacctacctcacgcccaagactctcgatatacaggtttgacgaggtccttgctgagaaaaatactcacgccagcgctaaaatcaacaggacgatttggttcctcgggcccgaccatgcaacgagagtcgactgtatccttcacagcaccttccgtttttatcc

SEQ ID NO: 23043 - DNA, 357 bp, Zea mays
  Clone ID: cC-zmle189018b03d1
aatttttgggtcgacccacccgtacggggactcgtgggattcacgggttctattggacctgtttatgcttgttccctatattgtgtgcctccacatatgggggagcttgaagcatcgacagtcactattctttgcttacttatattagaacataaggaggatttgctattgtcaagtgtgccttggttgactcaagttgagctttacaatccttattattttgcacggacatcccacccgtcttggctggacgggttacttcccacttaataaaagttcactccgtgtggccttgagtctgacccggagagcctgcggtggaacgtgcaaagcggggccgttctataggatccaagc

SEQ ID NO: 23044 - DNA, 234 bp, Zea mays
  Clone ID: cC-zmle189018b04a1
attttagaaccttttaaagtcttggaaatatttttttgggcgatgtagtgcaaattaatcggtatcatattcgcccgggtctgagaactacaatttggcgagcacccgactgaacacggcatatatggcctatatacaatggaagaaaacgacgcgggcccctggatggatggacctaatccatccatgcctttattccaaggagcaaaggagggggagggggaaggagaattt

SEQ ID NO: 23045 - DNA, 522 bp, Zea mays
  Clone ID: cC-zmle189018b04d1
cggacgcgtggggtcgttggcgtgcgtgttgctctgctttcggagcccgtgcgcgagcggaaccaaagtaccagaccatggagggcctgctgccgttcctgtaccgggccatcctccacctcgccagcggcgggcagtcgcccatcggcaaccccttcttccgcgacgactcgccgccggagtcgccgctggcggcgcactactacgtccgcctcgccgccggcgccgacgtgccggccttcctctcctccgcggcgcgcggctactacgaccgcgggtgagagcccggccggaccaggaacgacgctgggcctgggcgtgcgagcaggaagaatcctcgtgtgctccttcagatgcgtgttcagagtgctgggtctcctaccctcttcttgtggcttcttggagattctactcccgctccccctcctttgctccttggaataaaggcatggatggatgaggtccagccatccagggggccgcgtcgttgtcttccattgtatataagccatatatgacgtg

SEQ ID NO: 23046 - DNA, 370 bp, Zea mays
  Clone ID: cC-zmle189018b05a1
attatatcttatcttttatttttgggtgttgggtttttttctttttttataattaggacccgggggtaatcccggaatttccggaccgtgccctggggggataccatctttccttaatgggagtattataaaaggttggggaaaactatggcaaatcttgtttctgtggaaaaattgttatcccctaaaaatttcacaaaaaaaaaaatccgtaaaaaaaaaattaaaagcccggggtgccaaattgagggaacctaatcaatttaattggggtggcctaaattccctttttcaaaaaagaaaaaactgcgtgccattttataaaaaaaattccccaaccccggggaagaggcttttttttttttggccc

SEQ ID NO: 23047 - DNA, 87 bp, Zea mays
  Clone ID: cC-zmle189018b05d1
aaaaaaaaaaaaaaaaaaaaaaaaaaaaaaaaaaaaaaaaaattaaaacataaaaaaaaaaaaaaattaaaaagggaaaagtaaagg

SEQ ID NO: 23048 - DNA, 294 bp, Zea mays
  Clone ID: cC-zmle189018b06a1
aaaggacaatgaacacatttattccttgtggattgaacaatattttacattatggtacaaaccgaaaaccagttcgcgcttcacatgcattcggacacctaaaggtcaccggcggggcctcccttacttgccggggacaaatttggtggtgtaggcccaagtgttgtttgtgtctgggccctgttatgtggtcagcgagtgttttgagcgggcccttatcgggaccatggcctggaccaataatccttacatggataaacatggtaggcggtcgtttttgaccttcttgacctt

SEQ ID NO: 23049 - DNA, 303 bp, Zea mays
  Clone ID: cC-zmle189018b06d1
atttttgggtccacccacgcgtccggcagtaagcagtggcatgtctagtctatacatcatttcatttttcttggcatcgtcctcagtacaatgcatcgggatggcagctcgccatatattgatgaatcattattatatatatattctgaatgagctgtcacaacgtacgcatgcatggactttgctcgatcatattgggtaagtcggatcatcgatcgaatccaccttactttttttgcttggcacttattttgaagatcatttggggggtggactaccgttatgggcatttcaattcttata

SEQ ID NO: 23050 - DNA, 436 bp, Zea mays
  Clone ID: cC-zmle189018b07d1
tgctcgcgtccatcagctctgaattcacctctacatcaacggaaggaacggggcacgtttgctgtctagcttctcaagcacaagcagaggggcggggtccgcctagtcatgcgccaggctaaaacgcttaagatctgcgcgaaccacctcgtggcctccaccacgaagatgcaggagcatgcgggcagcgacaagtcgtgtgtttggcacgctgctgactttgccgatggcgaacttaaggaggagatgtttgccatcaggtttggttcggtagaaaactgcaagaagttcaaggagttggttgaggagatagctgagtcgcttacaaagaacgaaggcaaggaaggtgaagatggtggttccacgggtggatttgtggcgaagctcactgtgagcgagggcaaatttgatggaagtgggaagtctgagtccactg

SEQ ID NO: 23051 - DNA, 452 bp, Zea mays
  Clone ID: cC-zmle189018b08a1
ctctacaaataagataggggaatctgctggagcaatctttttagcaagaaacatgaactcgttaccataaatccatggcgatacagaaaacagtacttacaacagtttataacagcttcacccacggatggaatataaataaggggcgagcaaggcaaacacctaagtggtcagcaaccacagttttacaccttgcggatgaacagaaagagcctctgatcaatcttaaagctagcgtgagtggaagggtcacccctgagcagaataagaagcccgccgaacgatgcatacatcttcactttaccgttttggctggatgatgtgtcttttgagaatttgaaaagcttcccttgcatgacgtactcataattggctgccaaagtttttctgccagcctgagttttatagcccagttttggggtgccatccaaattcagagtaggcgctataac

SEQ ID NO: 23052 - DNA, 515 bp, Zea mays
  Clone ID: cC-zmle189018b08d1
gtcgccgccacctgccctaggccgcaggagggagcgttcgccgccccgccctccgtctcccgtcgcctcgccgcgcgctccgtctgccgcccctctccgtttattgactgccaagtcagctgcgggtttatctactttttatctaggagaaatgtctgagcatctctttgaggacaccttcgtcgtcactagactcgaccctgatggcaaaaagtttgatagagtttctcgtgttgaagctcgcagtgagcagttagatatgtatatgcagctagatgttgccacagatgtttatcctatgcatgctggcgagaaatttaacatggttatagcgcctactctgaatttggatggcaccccagatactggctactatactcaggctggcagaaaaactctggcagacaattatgagtacgtcatgcaagggaagctttacaaaatctcagaagacacatcatccagccaaaacgctaagtggagatgtatgcatcgttcggcggcttcttatgctg

SEQ ID NO: 23053 - DNA, 432 bp, Zea mays
  Clone ID: cC-zmle189018b09a1
ttttgttcaactgagatgaatctggtccatatagcttcatccaaagccagaaaattatggtacatgagcactccagacagcatcctaaactcagcattctacttgacggaagttatacaagtacagggtcattttttactggactctccaatcgcttgctgccgtctgagcaacttttgagaagttaatcaaaaggtataggatggcgccagaccccctgggtgccaatcgattttcaatcaattaaagggcatgtttccgagaccacctaatcgcggaaatcaggaggcacggttttttttttgaagtattccttcctcacagtctcggcatcacaaaatcttaccagggaggcatatgatttcaatagaggttaaacaacctgcccccacgcgtccgaggacgcgtgggttgacccgggaattacggacc

SEQ ID NO: 23054 - DNA, 399 bp, Zea mays
  Clone ID: cC-zmle189018b09d1
cggacgcgtgggggcaggttgttaaacctctattgaaatcatatgcctccctggtaagattttgtgatgccgagactgtgaggaaggaatacttcaaagaagaaaccgtgcctcctgatttccgcgattaggtggtctcggaaacatgacctttaattgattgaaaatcgattggcacccaggggggctggcgccttcctataccttttgattaacttctcaaaagttgctcagacggcagcaagcgattggagagtccagtaaaaaatgaccctgtacttgtataacttccgtgaagtagaatgctgagtttaggatgctgtctggagtgctcatgtaccatatttttctggttttggatgaagctatatggaccaaattcatctctgttgaacaaaa

SEQ ID NO: 23055 - DNA, 405 bp, Zea mays
  Clone ID: cC-zmle189018b10a1
ttttatttttgatttcaggaacttagttcattttttatgggtttcccgtatataaaaatttgcttcctactggaccgattacagatgaggctcccgggccccaacctttttttagttcaccgctattgcggtcttgccacaacaagctttttagtttttacaaaaaaaagatgatggcatattagcctgttacatcattacaacacgggcaccctattgtcccaatcaacctgtgttttcaacgatcttaacatccttcccagcctttgccattttaatcttaacagaaggtcctgcccaatcggcattggtaatacattcgttcttgctagcagatgcaggctccttcaagcccttttacatattgaccttctgagcccagcccatacccccctggttcacatg

SEQ ID NO: 23056 - DNA, 576 bp, Zea mays
  unsure at all n locations
  Clone ID: cC-zmle189018b10d1
gacgcgtgggcggaggacgtgcatccctgaacgctggacattccacatgctgccatgcgagaagccagatgagaaggccggtgaggccgccaccatggagcattttgtagggacgcttggcaggatcggtaggcgtctgttgcaggaaggcactgctggggctgagcaatgccagaagaagggaaaagttccacttttgtcccttgaagccatacatcagctgcacattttcatatttgttctggcaatcacacatgttattttcagcgtcacaactatgcttttaggaggtgcacagatacaccaatggaaacagtgggagaatggaattaaaaaagatgctcctggaaatgggcctaaggtaaccaatgtacatcatcatgaatttatcaagaaacgttttaagggtattggcaaagattctataatattgagttggctgcattcttttggtaagcagttttatagatcagtatctaaatcagattacaccacaatgcgtcttggttntatcatgactcactgccctggaaatccaaaatttgatttccatagatacatggtaagggttttaga

SEQ ID NO: 23057 - DNA, 508 bp, Zea mays
  Clone ID: cC-zmle189018b11d1
gtccgcttccccagccagctagggtttgcagatgacaaccgtttcgctccccacctgggcgccggccaaggggggcggggagcaggggggcacccgcatcttcggcccctcccagaagttctcctaccgcgacctggccgcgcacacctccctcaagccaagaaaagacggtcaacagacccaagaggagttacagaagaggaatctcacggaggaactcgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgctgactccgatgtggagcctaaaagcgatgactagagcgatgactatgatgatgacgaccacacttgaacccctaacgcgagagcttgttaggattaagaaagaaagagccgaggagaagcttagaaaggagcggcaacaagc

SEQ ID NO: 23058 - DNA, 416 bp, Zea mays
  Clone ID: cC-zmle189018b12a1
ttttaacttaattttctgcgtacatgtttagggaatccggcgggggaacaatttttcagccatttgccagtttaaatgtcttaattttcatctggcggacacaggttaactgagataatgcacgttggtgagcatctaacaacactgttccacaactgtcaagcgagcttatttacatcaacaactgctgcatcctccagcagctgccatcaactatctttctacccatcagcggtatagaagggaagtgacttgagtggcatcaccttctcctcagggttctccacatgttctgaggggaaatgaagcccaatggaacaaatttcaagcactttcagtctcctcagccatgcttttgtgagcttctattgctttcatttgaagcgaacatcttttataagaaatgcttggctttt

SEQ ID NO: 23059 - DNA, 616 bp, Zea mays
  unsure at all n locations
  Clone ID: cC-zmle189018b12d1
gctttaaaccatggaactgatggtcctgttgttattcctggtgtattgctaaaggatgttgtttcagatttgcctgtgcatcttttgggctatgggaatatttcatacaggatctgtgaagctagcaagaactgcaggaagataagcaagatctggtgtgcttgggtaggacaaggctcccatggttttgagagttgtaacacttatgagcaatctggatttgccatagtcaacttctcttatacctatgatttaggcaggaagtggtcttctgaggaacaagacctgtctgtctctgctggatctttctttgtaattgatgatgctggacaccgtggaaagcgaatgagaaaatcattctctgatcaagaagcatcttcagaagagtcaaacggtcagaacagctctttacagggcagtaggcaagctattgtgacttgttcaccggtaggtacctcaaatgatcttcaagttggtctcttatcaagcaaggcagcaaggagagagttgaggaagcagaagcgaatagcagctgagaaagtgtgtgatctttgcggcagaccaatgctctctggaaagatgttgcaccttgctgaactgaatacangaaactagc

SEQ ID NO: 23060 - DNA, 282 bp, Zea mays
  Clone ID: cC-zmle189018c01a1
aggtttatttgatcatttagcgaaaaaaggaggagaatcaattgaaaaagggtgaaggacttatatacagagaaacaaaggcacctaagggaaaaaaatacgccagcagtacggacactaactaatgaaggaaagacaaaagcagtagaggtgatgactgaaacatggtgaacaaaagggcaggattgttagagagtaggaagtattttaggtaaaggggagaggggttaatgcctaagtggtgagcgtccgggatcaatgaaaaggcttaggcctggagaa

SEQ ID NO: 23061 - DNA, 466 bp, Zea mays
  Clone ID: cC-zmle189018c02a1
ccgatcacggtttttcatatttatataagtactcaaactgtgggtgattgatacaacaatcctcggtgtcgtccctagcagtagatcagaattggacggacgaaacgtgacgctgaagaggctgtccccggttgtcctacaactacaaccaatccaatcacaccatatattattcaaacaaggccaaggttttcacataattgaaaaacacaccacctgtgttatataagataataaggtctgcgagttgcagggcaccagttttgcaggttgatccttgtcacatgtcaatttatgcaaggtttgtaattgtcattggcagtttgccacacaaccatattccgactacatagctcactcaagttgctatatggatgccaagctgttagctaaagacgctgtgactggaagccgcacccatgactttagaaattcggattaaccttacatcagggcacggttgggg

SEQ ID NO: 23062 - DNA, 531 bp, Zea mays
  unsure at all n locations
  Clone ID: cC-zmle189018c02d1
cgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcacagcgtctttagctaacaagctcgcatacatataggcaacttgagtgagctatgtagtacggatatgggttgtgtggcaaactgccaatgactattgacatccttgcatatattgacatgtgacaaggatcaacctgcaaactggtgccctgctactcgcagaccttattatcttaatacacngtggtgtgtttttcaattatgtgaaaaccttggccttgttggataatta

SEQ ID NO: 23063 - DNA, 533 bp, Zea mays
  Clone ID: cC-zmle189018c03a1
tttttcttttttttattacaaaaatcatgatgcttcaatgcaaaatgtttacagttttacatcgcgttactccgatttttttttcagatgaattttactcaccagtcgtcagcatgtacaaagcagtaagtgggattgtgttttatactatcaccaattcaccagtgctaataggtgacgttttatacaaaagtggacgaagtacatgtgcgcctgcggccggcctactcctcccttgggtatccaccggctccaccagatgcttttgcgctggttgttgagctcgtccatgctctccttgatcggctctatgatcttcctttgcaggcgcagcacggaggcaagcgcgttccgttgggtgctgcttttctttggttttattcccctaagctcttggaaactgtgcttttgaaaagccccccacatttttcagttccctgcccttgccatgaggcccataaccccaccgggctgttttactggagtccttttggggtgcgcggaacaattgcagccgtcctttttgtatgacg

SEQ ID NO: 23064 - DNA, 593 bp, Zea mays
  Clone ID: cC-zmle189018c03d1
cccacgcgtccgcggacgcgtgggcggacgcgtgggatcggatgggaactcctcacctcgatggtccggtacaaagcacggcagaggaccagtgctaaggccgcattggcacacccgtacttcaaccgtgaagggctccttggcctctccgtcatgcaaaacgtacggctgcaactgttccgcgcaacccagaaggactacagtgaagcagcgcggtgggttatcggcctcatggcaaggtcaggaactgaagatgtgggaggctttacagaagcacagtttcaagagcttagggaaataaaaccaaagaaaagcagcacccagcggaacgcgcttgcctccgtgctgcgcctgcagaggaagatcatgagaacgatcaaggagagcatggacgagctcaacagccagcgcaaaagcatctggtggagccggtggatacccagggaggagtaggccggccgcaggcgcacatgtacatcgtccacttctgtatgaaacgtcacctattagcactggtggaatggtgatagtataatacactatcctacttactggcttgtacatgctgacgactggtgaggtaaattcatctg

SEQ ID NO: 23065 - DNA, 359 bp, Zea mays
  Clone ID: cC-zmle189018c04a1
ccgtatcgagataaatctcaatcaatatattgattatttctaggaaacacatgtcggtatgagggcaccattgtcgagtacatcttatttgtaatctaaaagatggcccctccaacgatgggttgctgcaaggtagggttcattcaaaaagaactggttgtttggcaacaatttttgtttctgctgcatgaaggtacctaccaatgggttaccccctgccaatggattaagtaactgttgttcctgttgtaggcacccagcaaagtttgaccacaaccagttggttgaatggaagcaactgttgtaagtaggccgtagggtttgccacagttagttgaatcagaactggttcaatttgt

SEQ ID NO: 23066 - DNA, 283 bp, Zea mays
  Clone ID: cC-zmle189018c04d1
aacaccaatggctaccaagatattagccctccttgcgcttcttgcccttttagtgagcgcaacaaatgcgttgattattccacagtgctcacttgctcctagtgccagtattccacagttcctcccaccagttacttcaatgggctttgaacatccagccgtgcaagcctacaggctacaactagcgcttgcggggagcgccttacaacaaccaattggccaattggaacaacaatccttggcacattttacccttcaaaccattggaacgcaaccaccacca

SEQ ID NO: 23067 - DNA, 436 bp, Zea mays
  Clone ID: cC-zmle189018c05a1
aggaagaacaagctttggcatcatatacattacttctccaaagttacaaaactcggttccgtataaatatagagcaacatgacatccaatccatggtgtaatgatatacagtttaaatacaccccctgcttatgacccgtaaacagaagaggtttgggcctcagttgtgttttcctttaacatgtacacagccaaatctgttcagttgatgtcacacgggactcacatagcggggcctggacttgtttttacactaatatctggtgcgtgatcataacaatccgggcaagttctggggtttaggctgaagaaaggcttttgaggacttgtgatccaacgcgaacggatttacttccacagacttggattgaaattgaaaaattttttttttggaggaactttttaatattctccatttatgaaggggcatttttgg

SEQ ID NO: 23068 - DNA, 366 bp, Zea mays
  Clone ID: cC-zmle189018c05d1
cccacgcgtccgggagctcaagctatgttcatcatcagtcttgtgctctggtgtactacaagctttgccttggatgatgctgctgctacaaggattccaattgtgggcacattacctctgtcaatgaaagaaaatccgcaattatgccaactttgtgaggagtttgcatcagaggccctcttctatttaaatgaaaatgagacccagactgaaatcattgatacactacaccaagcttgtgcaaaggttggctcttttaagctggagtgcacgaagttggtggattattatgtccctcttttcttcacaaaaattgctgcattaagccctgaagaatattgtgcatcagcaagtctttgtggggag

SEQ ID NO: 23069 - DNA, 371 bp, Zea mays
  Clone ID: cC-zmle189018c06a1
tttttatccatttttaatttaatcagaactaaattgtggctttaggatattggaaggacaaggtctgattatgaatcatgccggatttgatgccacctaaccatgcctttgtttcttatttggggtggggaggtaatgactttatattgtgtggggtagcttatacttgatatattattttttatatggtgactagtggctttccaacatttattaatttacaggatcaaatccgtgtaaacagaagttgtcggtggtggcgtcagcttatggaacctcttgtttgaaaaattctcttgttgttgacccctgttagggaagccatccccgaagaggcttggcttgactaaaatatttaaaacctggttctt

SEQ ID NO: 23070 - DNA, 338 bp, Zea mays
  Clone ID: cC-zmle189018c06d1
ggcttccgccagcgcccagctggaggtatcgctgttgccttctcgatacgccctcccaaagcggatcaaaccgtatatctcgtcttgtcggcccgttcctccgatcccatcctatccgatcctcatggattccatgctatccagcctcagtcagcagtccgagttcgactacctgttcaagctactccttatcggcgactccggcgtatgaaagagcaggctactgctccgcttcaccgccaaatccttcgatgacctctcccctaccataggtgctgacttcaaggcgaagacggtctgcattggtggcacaaaactcacacttgccatctgggaca

SEQ ID NO: 23071 - DNA, 141 bp, Zea mays
  Clone ID: cC-zmle189018c08a1
ttatttttttttattaaaataaaaagtggggccttggccattgaaattatagatttatggggattaactatggggccaggacgcacgagggcgagaacggtatacaatttaacagtaccgatacaaagataaggggagggg

SEQ ID NO: 23072 - DNA, 208 bp, Zea mays
  Clone ID: cC-zmle189018c08d1
tcctgggtcgtcccacgcgtccggtgaccacgcccctgtacgcgcaccccgtctccagggtgttccacgccatcagggacgccgagctgatcgtggcggcgtcggacgtggcggtggcggacgaagccgtcacgcacacgctcgtgctgcggtcgcccggccccgagcagctcaccgcggagacggtactcgccgccatgtcacgggg

SEQ ID NO: 23073 - DNA, 281 bp, Zea mays
  Clone ID: cC-zmle189044f06d1
cggaattcccggatcgactccacgcgtctcgtaaaaaaaaaacaaaaaaatcacgaagaataaataaaagctaatctttagaaaaatgccaaaaaaaaaaacagatcaaagggggggccgttttaaaggatccaagtatacttccccgggctcccaagcgtggaggttgttttttggggaacttataatcaatatgggtgggcgcggtttttcaacgttgggacagggaaaaccctttcgttccccaatttaatatcttcgaaggacatcgcccttttggc

SEQ ID NO: 23074 - DNA, 256 bp, Zea mays
  Clone ID: cC-zmle189044f07a1
actataggcactgacaaaacacaagacccactagttgagaaagaggtacttacagaagctgtcctgctgctgcacaatacacaacctcggaggcatatagaactaagagtacaagaacgtaaattcgaagaaatgctctctgcatgctagcttgaagcggacccgtttatgcagtttaaaaactttcttagaggcctcgaaggccttttcgatgtcctgggaggtgggcgccaagctggggaacccccccccgacc

SEQ ID NO: 23075 - DNA, 554 bp, Zea mays
  Clone ID: cC-zmle189044f08a1
gcaagcacgcgtacgcaagctaggaccctccagagcggccgcccccccccccccctcctccccccccccccccccccccccccccccccccccccccccccccccccctcccccccccccccccccctccccccccgcccccccctctccccccggcccttggggcggggcggcccaaaccaaaaaacccgggcccccccccccccccgggggaaaaaaaaaaggggccccccccaaaaaaaccccccggccgaccccccgaagccccccccaaaagggcggggctccccccccccccgcggggggccccccccccaaaaaaaggggcccggagaaaacaccccaccccccccaaatccccccccccacaccctcttggggccccccccaccaaactctgggccccccccccaagggggcccagagggcccccccccaaaaccccccccggggggggcgcccccaggggggcccccccagcaccctttcccccccccctgcaaaacccccccaccaaaggacccccctgggcaatggtgcaggggccccccccc

SEQ ID NO: 23076 - DNA, 460 bp, Zea mays
  unsure at all n locations
  Clone ID: cC-zmle189044f09a1
aaagaatctgaatcatcaaaagcactggattggaggaatctgtacaaagtagcaaaactggcactctctccatacgagcatatagacagacatatagtagcaaaagcttcatgtttcgtcgctggacttgagatctttacggacaagaaatgtatacggaaacttgctgtaggcaaaaccagtcgcatgcagttggccatttgcatgaaagggtaggaatgatcaaaaatcaaattccttggcccccctacccttacccgaaaagagaaaattacggcaaaaagaaacacgccgatgagcccttctcccaggaagtcgnagaaccattaccatcaaggccaccaatcctttcaaacttgccgctggctgagccctttcagcacgacctgagcgctagtaccgcttcccaagaaacacgccgattaagacagacagcagggcaactcccaggatgaacttg

SEQ ID NO: 23077 - DNA, 333 bp, Zea mays
  Clone ID: cC-zmle189044f09d1
aggcgtggagttcttcctagaagggcgaagtgagaggaatgctcacaactctatagcagtagccgggaatagcttgtctcggaaaagtgagaggacaaattttgccgtgtatggactaaccgagatacacagtcttcacatagcacattaatgccagccgattcacatagtgtgggatgcaccagcaatcccaaccttcaagagatggcaaaaacctcccgcaatgatgagcagccacattattctgtgagtagcgctgacctctagccgactaacaaaatatttcgggaagcgtgcctaccccactagtgaggcggtctgggttcagcctgt

SEQ ID NO: 23078 - DNA, 310 bp, Zea mays
  Clone ID: cC-zmle189044f10a1
ttttgtttgtttttaatctgccagatgggcaactttttaagccagggattgttcctaggggccagatacaaacccacacaggcggctccctgcaagctgagtgaacagcacagccggagatttgactgtccatagggagagtgaaagcattggtctgaactacaagctcacacatgagagtgggaaagagcaaatgattgctgtttgggacaggcagacagcctgattgataacaggacctgacgctcccatgacagtacggagcttatctttttgtttgctgactaatcaagacctgacctgtttttcg

SEQ ID NO: 23079 - DNA, 264 bp, Zea mays
  Clone ID: cC-zmle189044f11a1
ttttacaggcccttcaccttccgcgtaattttcatttcaacttgtaaaagttacgaacaattgggttgcggaaaaactgtatacttgtataaataaatgcacaaactgtactctataaagatacaccagtgctattcagtcttggagcggagctcaacatgggaagcataagctccgccgctgatgcgcatgaaggcttcatgccttcctctctccacaatcttgccttccctgagcacagcaatcacgtcggcccccttgatc

SEQ ID NO: 23080 - DNA, 542 bp, Zea mays
  Clone ID: cC-zmle189044f12d1
gcacaatggcacatacatacggtgatactgctgcaatatacatgaacaccctttgtctcgcttctgctttatctatgcaactgctggcatgcatgcaaaagacgcctcgggagataagacccctgttattctgctagtacgtatgcatgcatgtgcacgatcgatgggcgcgatggtcctattattcgttggttcagtagtagggctggatctttcagcgctggttgtcgccctcgcaccacttccagagcacgacgtcggtgccgacacggacgcctgcgtgccacttgtcgccgtggagggcgtcgaagttgaggtagatgttgttgaccatgcggacgcagcggaagccgttgccgacgttgtggctctccgtccacagcaccgactcgtccaaaaagtccgggttgtttggcaccaggcgcaccgggtgggactgccccagcgagtgcttgatggccttcccggttgccttgttcaccagcgcgaacgccgggtaaccattctcgtgcatgatgctcgggctccaccgaatgtccttg

SEQ ID NO: 23081 - DNA, 187 bp, Zea mays
  Clone ID: cC-zmle189044g01a1
ggtctcttggttttttgagtgattattttggtccgtttcctgtagggggtccatcttttcatagagcgagcccggttacacctcggcgtcaacaacagataaaggcggcgacaggggcaaacagccaccgggggagaaactcgaaactgacacaaaccggaaagatcagctgctcaacctggggggc

SEQ ID NO: 23082 - DNA, 288 bp, Zea mays
  Clone ID: cC-zmle189044g02a1
aagccaaacccaccccggcccaggtaaaaaattccccccccccaaaaaaacaacggggggggggtcccgggccaacggggcccccccccccccaaaaagggaaaaaaaaaaacccccggggcggttccccgagggggggaaggaaattttttaaccccccaggggggccaatatcccaaaagaaggggagggggggcccccccatgaggggggaaaggcgggggtttaggccccccgaaggccaaaaaccggaaactttggggggtccccgggggaccccaccccccc

SEQ ID NO: 23083 - DNA, 406 bp, Zea mays
  Clone ID: cC-zmle189044g02d1
acccacgcgtccggtctcttccagaccatcattggactgaagattagagacctctatgatctgattgtagctgagagaggctggtgtaccagcggatgcagcaaaagtttaacgatctatgcattcagatgtcctaaaactacagctctccgaactcaatgggagtaacaaccttcgcatctgtagggatatatggcgagctaagaagtatagaaaagtcattgcagaactcaagaaaacgtgcaatggaatttcttgaaatccctcttgaagagtgagagaactcgatagatcatgaatcaccacacgttgtattaatcgcatggtataatattcatacatgtacaggatgagctatgcctttaatatatttttatcaatttaaaattcgaaaataaatttatat

SEQ ID NO: 23084 - DNA, 300 bp, Zea mays
  Clone ID: cC-zmle189044g03a1
aggcgccctgtctttttttttggtcgtttttgaattagactgttgttaggctaaagggcgaggcgccagagccttaagccaacgtcgggttatagtaagaaaatctggtggagctgaccaagccggctggcccgccggcaaatgtgttcaggctgaaggccgtttaaaaagccagagggaccagagggtcgggcaaggccaccaactcagatgatttcctttcgcacttcatggtcaacaaagcgttgaacttcgacatcagagagggccgccaattaaggcgattttgctcgcccctac

SEQ ID NO: 23085 - DNA, 377 bp, Zea mays
  unsure at all n locations
  Clone ID: cC-zmle189044g03d1
gacccacgcctncgtatccaagaaccaaaggtagctagcttgccgcgactcgttttttagtctattcaagcagcagcgcaagaaggtaggcgccggtggcgatagcgtctgccgggctgggcatgctggccggcgaggcgatggcctaccggcccctcgggaacgggctcccggcggcctccatgagggacgcgcgcccgcgctgcgccacgtgcggaggctccggccgcgtggagtgcatctgcaaccgctggtccgacggcgactccggctgccggacctgcgctgggtcggggaggaagccctgccgcagctgcggcggctccggcacgggccgaccgctccctgcacggctcaccgtccagcaccagaagccg

SEQ ID NO: 23086 - DNA, 248 bp, Zea mays
  Clone ID: cC-zmle189044g04d1
acccacgcctccgaccacgcgttcgggtttatgtgtccaaactgtggtgaatttggccatatgaaagcaagctataaatgtcctttcaatggaacaagtaaaaaaaaaaggagaccaaggaaaaatgtgactaaaggttggtttccaaaagatttcgaagctttcgtcgacactttgttctgaaggagaacgaagtgcatgcactagctactataactacctgccagaaaactaacgcgagggtgagg

SEQ ID NO: 23087 - DNA, 232 bp, Zea mays
  Clone ID: cC-zmle189044g05a1
caaaggaacccatgctgcgagggattgatttttctagttgcctgaactctctgacgttaaaacatctcaacccgaaacatcctaagagctaggggaaaatacctaccgggcgctcagatctttaggtgctgttgggctcctcaaccccggggatggatcccttaaaggggacattgaagctttttcaccatgaatgaacttttgccactggggcctccttctgttctgggat

SEQ ID NO: 23088 - DNA, 309 bp, Zea mays
  Clone ID: cC-zmle189044g06a1
cacagcctcaattcaactttgttttctcggtcttcgcgcgctttggatttgcaacaggtcaacaggtccacaacttggcgacaaatgcacagcacaagaggaactgagaatctgctttactagctatgttccatgaactgcacataaactcccgactagagtaacaggaatcattaaccaatgcaaaaggatggtcagcttctgtgcagactccagtagcgtatataggtgtgcatccactatcaaaagctggcactcaaaagaccatgatgccaggggattggctgacagctcacacaggcatcggct

SEQ ID NO: 23089 - DNA, 298 bp, Zea mays
  Clone ID: cC-zmle189044g07a1
ttttaatcgataattgatgatgtattgaagtacagagttttgaaccatggagcagtttggaagttttacatgactggaaaaaaaagggagatgggattgtagcttttatgagcactgctactagtaatgttcacatagcatggcctctgaaataatactggagatcaccacatccaccagcagcaggcaatccggttgccaacgaggaggcagcctcagacaagcacctgagctgcagctagcctagcaatcggaaccctgaaaggggagcaagaaacgtaatccagcccagccttcg

SEQ ID NO: 23090 - DNA, 306 bp, Zea mays
  unsure at all n locations
  Clone ID: cC-zmle189044g08a1
ttttaaactgagttgacgttcgagcctgttttttttgcaagtgagttcttgttcggatgttgagatgattgaaactgaatgagctcaatttcacatgaagattttatttccctgcagtttggacatatctagggtcgacatgacaggtgatgatctcctccattcccatcagacgctgctgctagctgcttcacctcttccagataacgttggtgccgcacttgaacttctccttcccctcgcactcaatctcgatgtcgncgctgatgaaagggactttcttctgctaggcgaggtcctggcacc

SEQ ID NO: 23091 - DNA, 73 bp, Zea mays
  Clone ID: cC-zmle189044g08d1
ggttaaaccccccaaataggcctaactcaagttataacctttattaatgatccgctatagtgctcgggtaaaa

SEQ ID NO: 23092 - DNA, 361 bp, Zea mays
  Clone ID: cC-zmle189044g09a1
cgcaaagttgctatagcttcaggcgtacgtaggctccaaacattattaacaggagaggatggatcttagatgcaattagccttgtctaaatttacaccgatgaccaccaccatgtttacattcagatcattaacaggagaggagggggatctagagcgagaggccaccggactcctagtcctcatcgaggtcagaggcgtagatggtgtcgtgggaccagatgaggccaaagacccccaggaggatccaccccagcaagtagttgctgagcccaaggctcagcccgaagccctccgaggacatgcgctcatccacgagcgccagcgagggcccctccaacgagggcaccgcgcccggtgcg

SEQ ID NO: 23093 - DNA, 599 bp, Zea mays
  Clone ID: cC-zmle189044g11d1
acccacgcgtccgaccccgtgtttgcgtggaggagaaggcaagtcgttcaacgctcgtctatgtcatagcgatgcacaaatcggaatcaccgtcgttcttgcaaacgctgattgggtttgtttatggaccgtgagatgatgattgagccagtgatgtggtgccacccacaatatgcctatggtggacgtactgaaggatggtggacttaaccagtggatactcgccgagcgagtaccctcccccagcaaacactatctaagtgtcaaattaaagagaacgatccggtcgaagagcccgaggaactagcaggagaagcccctgagcagcagtcggttggtggaggttgtcagcattgcaaccactgctcaggcgaagatgaagctgtggaaggagactttcaggagttccaagactacgacgagttctaggcgtgggttagcggcaacccccagtcggctgcctgtgaaggccgcggttatctacgtttcttttccgcactttgatgtattgtaaggactttgtggacgtctcagaacgtatgatgtaatcgactattatttcccttttaatactattttgagccctgtgtgatgatgtc

SEQ ID NO: 23094 - DNA, 109 bp, Zea mays
  Clone ID: cC-zmle189044g12a1
gaaatctataccgtgcttctttctttagctgtggttcctgggaggcagggcacatgggctgatagcacaaccctcaacagacatgggcgggagcttccacgctttggac

SEQ ID NO: 23095 - DNA, 620 bp, Zea mays
  Clone ID: cC-zmle189044g12d1
cggacttcccgggtcgacccaccgtccgggctacaccgaggacacgcggctgggcaactggaagctggggatcggagccgccgtgattgctgtcgccctcctcgctcagttttaccccaagaagttcccgcagaaccgcgatttcctccttggctgcatcgccctgtatgtggtgctgaatgtggtgctgctgatccttagctacaccaaggagaaggatgccatcctattcacgcaccctcctatgggttctttcagcagcactggcctcactatttcttctaaattaccaagattctcggacatgtacactctcacaatagcaagtgcggatccacagtctatctctgcaaacaagccagttcatttcactaagagcgtaacaaagtggtttacaaaggaaggagttcttgtggagggcctgttctggaaggatgtcgagaagctgattgatgactacaacagtgagcgcaagagtaaatgaattggtagctcgtgtctctggccatctggggagacatcgctgtctagagaaatccgtcaaagtttagcttaatcttgacaggcatttttgtatactgtaccggttgaccagtgaatgaatgatgttctagacatta

SEQ ID NO: 23096 - DNA, 406 bp, Zea mays
  unsure at all n locations
  Clone ID: cC-zmle189044h01a1
ttttagccctgaaacttattttgagcttttgtagggggttttaactccactgtagctttagaactaagctgacttaattgttgctgctaaagcagatgagaacgacaatatacagcggagtcaaatatatttgactggcacaacccgattctaatttcagcatgttcggagcatcagaacctacaaggaatgctctccaacttcaccattagtttacagctggagaattttacaagagtccagattataagtcagncacctcatgagaactacaaaattcacaatggacagaaaggtttgattagacctacagcccactttantttggttgtactgatagctcatcctcaagaagttgnactcgaatgagaagtcattcttgattctttggcaccatcctgagcca

SEQ ID NO: 23097 - DNA, 460 bp, Zea mays
  Clone ID: cC-zmle189044h01d1
gacccacgcgtccgcccacgcgtccgcacaaagattccatattcgaatccttcagcacctgctgcagaaagcaatcagctgcctaaggatactgaggcatcacctggagcagcccttgcaacctggaatgtcatcatctggtgtgggcgttaccgtccaaaaatgtttttgtgatctcggtgcactcggagatatcctttctggtacttcggccagatctgcgcatgatcagctttataacctgcaaatgctataagctgcattcgacacactcccacatccacaaagacccgagcgagctaaaacttacatccggaggcaccctgcaaataccccagctagctatccccaagttcagacatgaatagtatctcatgcctccctctgagaaagacctgagagcaacacattagcttccgacatgctattctgtgcgttctatgaccagcagaacacatat

SEQ ID NO: 23098 - DNA, 237 bp, Zea mays
  Clone ID: cC-zmle189044h02a1
gttttgcaatttactaacattgagggggatggctcaacctagacctatccatttgggcgtcatatcagagacgctacggactacaaaggtcgcggtcccttctgccgcactagatctagctcatccaggactggcccctaggcactactgattctatgctcgagggcgacctccttaccctgactggcgaacaatgcctgaataacactaatacgccacaatgcccttttgacttcc

SEQ ID NO: 23099 - DNA, 296 bp, Zea mays
  unsure at all n locations
  Clone ID: cC-zmle189044h03a1
atctcaaggtgcgcgggcctcggttgccccgtgcagaggtattagaaatctacagggggtcccaggaaaatccttggntttctgaattgcctctaaagatattgaactgtgttcgtgttttagctcgcccccactcacaatgcttcacggtctacattctattcagcttttgcggcagtacttttgatggccttgaaagcacatgccttaatgcttttgtctggttgagcacacttgtgcgggtccttcggattggtcttgtgacactcaaggcagcctggcccggacgcgtgggg

SEQ ID NO: 23100 - DNA, 324 bp, Zea mays
  Clone ID: cC-zmle189044h03d1
gacccacgcgtccggggcaggctgccttgagagttacatgaccaatacaaaggacccgctcttgtgtgctgaagcagtcaagagatttgaggcgtgtgctctcatggccatcaaaagtactgccgcaaaagctgatttgtatgtagtccgagatgctttgagagttggggcgagctgatacgcggactctgttttttatcttttgaggcaattcaaataaccaaggattttcatgggacccactgtagatttcttatgcctctgcactgggctacctgatgcagcgcaccttgagcttagcgatattgcatatgtttggtaaaa

SEQ ID NO: 23101 - DNA, 295 bp, Zea mays
  Clone ID: cC-zmle189044h04d1
cggacgcgtgggaaaaacaacaaaaatagaaaaagaaaaatttatgatttaggatcgaggaaaaaacgcacaatagggcgagtcaagtcgtgaattgcaggaaccagtgaaccctccgttttcttaccccgaatagagccccaaatccttctttcgaagggcacgtaagcccgggcgggtcaccatgggacactacaaacaccccacggcggggcgcgggacaagcagtgtggccgtcttccatgatttcctccctaaagagaaaggtcaacaaggatctggccggtcggacgat

SEQ ID NO: 23102 - DNA, 325 bp, Zea mays
  Clone ID: cC-zmle189044h05a1
tgactgcacatgcccgcatactgtaagctcggatactgtagagcgcgtcgcccctttttttttttttttttttttttttacctgaaacttcgagattaagaactgaaaatcgagctattagctcaattttccttctcaggttcgtcgtcgtcgtctggggacatcattatttatttcaactagctacacaagccacgctagcaacttagcatggtccatgacagacgggctcacgcatgacaagcacttggcatcctagccctccatcaggattcaagagatgtggcctcggctctagaggttctcgacgggatccctgatgatc

SEQ ID NO: 23103 - DNA, 583 bp, Zea mays
  Clone ID: cC-zmle189044h05d1
ctcccgcatcgctagccgccctcatccccacacgctcgccaaaccctagctatcaacatcctaccgctccctcctggagctcgcccagcagcgcgacatccttgtctatgacttcgtctccaacggcacgctcagtgtcgccgtaccgctgctccccaggcgaacccacatcgcgatggtcgcccagatcgcggcggcgctctagaacctccactttggcatgaacccgccgtcgtgcaccgcgacatcaccttgttcaacatcttcgtggaggccgacatacgggcatgcctcggtgacttcggcctctccctcctcctcgcaccgtcggacatgtgcgcaacggagggcactcgtgacctcgcgtgctgcacctcgcctggctggggcccgtggacgttggcaaggagcggcgggacatggcgctggcggtctgggtggcgcccaagatccaggtcggtgagcacaaggtggtcgtcgacccaccggtgctgcccaagatccagtgtggttgtgtaggggcgatatcacaagctcttcatggataggtgaccatggaacgggttcaggtgctctcggcatt

SEQ ID NO: 23104 - DNA, 248 bp, Zea mays
  Clone ID: cC-zmle189044h06a1
gctgttggttgttttgttttttacattgtgacatcaaagatcactgggcccaccaccggacgtccacaaatatatgtgcgcaaccattcccccctcaaaagccaaatccagctttgagttcgacaatccataaaccacgccgcacttggcacgttcagctgcttttcttggcgaagagcccgccgagggcgccgaggttgaaccccccgccgatgccgattgtgggaccgccgggagccttcttgccg

SEQ ID NO: 23105 - DNA, 93 bp, Zea mays
  Clone ID: cC-zmle189044h07d1
aaaaaaaaaaacaaaaaaaaaagaaaaagaaaaaaagaaaagaaaaagcaaaaataaaaaaaaaaagataaaaaaaaaaaaaaaagaaaaagg

SEQ ID NO: 23106 - DNA, 313 bp, Zea mays
  Clone ID: cC-zmle189044h08a1
gaagagcaaaactagtccagttcgttccttctgggagagcacaagaatttttgcattcgttcatggttcagatcacgacagaaacgagtagggttcaacacaatgtcctggcccgccggggccccggaagctagcttaagaccctggtgcgaacttggaggcgtaaacccaggcgttgttggcgacggggtcgtcgaggaggtcgagcaggttctcgaggggccccttgccggtgacgatggcctggacgaagatgccgaacatggagaacatggcgaggcggccgttcttgatctccttgaccttgagctcg

SEQ ID NO: 23107 - DNA, 278 bp, Zea mays
  Clone ID: cC-zmle189044h08d1
tcgacccacgcctccgagccctccgtcttgtgaaggcaaagcacgcgcaaagccaccacagctttttcgtcttggtctccagtccaagcaagcgaggagcacccctcgagatctctccctccccgcgccgacatggacgcagttgactcggtagtccacccgctccgggagttcgccaatgacagcatccgccttgtgaagcgctgtcacaagccggaccgcaaggagttcaccaaggtcggcgcgcggactgcgatcggcttcgtagacatgggatt

SEQ ID NO: 23108 - DNA, 87 bp, Zea mays
  Clone ID: cC-zmle189044h09a1
ttttgttttttttttttttttttttttttttttttttttttttttttttttgtttgttttttttttttttgaggacgggagggccac

SEQ ID NO: 23109 - DNA, 328 bp, Zea mays
  Clone ID: cC-zmle189044h09d1
cccacgcgtccgtggacgcgtgggtgcctatcgcagctattgtgaatatgatcccagttggatctacgtagtgaattagagctaatttcgtccagaaactgaagttggacatggctacagtctgatcatggcaatggagttttctgggttgccattctatgtacaaaaaaagatgtgtgctatgcttctattctggtcaatctatgcctcttttatcctgtagtatcttatcagccaaggctgtggactctattgttagaaaatgccttgggctcttgcagctgctctttgctttatatattattttggtgcttttgctaggatcatt

SEQ ID NO: 23110 - DNA, 287 bp, Zea mays
  Clone ID: cC-zmle189044h10a1
agggaataatagactctaaattttaaactataaaacataaagatcgggtttggatcagaccctattcctattcattttttaactaaaaataatctatgaccctaataatttgagaagaaacatttggatcacgatccaatatcaccccccaatttcacacctatctgcaaccgaacagggccttaaatgagaaggaacacagctttaggaacaggggcctatttctttcgccagaacagcccgagatcaggcctcaaggaagggccccagggcaactgattttccga

SEQ ID NO: 23111 - DNA, 659 bp, Zea mays
  unsure at all n locations
  Clone ID: cC-zmle189044h10d1
cataaataaaatgttccatgttattatcgataaatgcattacatacaataaagaataccattgcatatttttttttatttacattctttattttctataaccctggttgtacctcacatgctactgaattctcttatatatatgatacatataagaggaagtatttaaatgagcccaaaaggctaaggagagagctgcaactgaagctagttatgataaggggacaaggtctctaagggaatcttcagcaactactctaatgactacaccaatatcatctccccctactattcccacacagacagaatagttctagaattcttggtggtaataaagagttgttgctgaagtaaatgcagttctttctgcagccaaaaaaactttagttggctttcacatgatatgtggcgatgaaaatatgttttcgtatgaatggcatcgtgaggaagaacttttgcatctagagtgtttgggtatatgtaatatgttgtatgccaaatgcaacttcaaaaaccttggtaacaatatagaattagtgtcttgaattatgctatttactaatatttataacttagaatggggaattaattgcagaagctncagaggagaattctgaaagaatggtttaatcctagaaaaaatgaattaatgttcttttt

SEQ ID NO: 23112 - DNA, 366 bp, Zea mays
  unsure at all n locations
  Clone ID: cC-zmle189044h11a1
gtatttttgacaaatttatttcaaacgaattcttctcaaacaagtcttacagaatacaaatatggagcatgcaagcataagctaagcaataattttatccaatatacaggagataataaatactgaaaagtagcggntctctattaacgagtatccaatacagnaaacactaaacaggcttaacagagaagatgataccgtgtagataactaccgttcgacaacataaagttcaagcatctgcaagacaccttcgacccacgggaagagtactctacatctcacaagcaaaccaacaaaaaactcagatgatctacgactccgatatgaaactcaacgggaagcagacagctgatcatgatacgca

SEQ ID NO: 23113 - DNA, 327 bp, Zea mays
  Clone ID: cC-zmle189044h12a1
agaaaaggttttaggacttaagcaaaaaggaaagaggacgccctatacccaagaccacaggccaaggcgccgagggtttggagcgggccgacaggaagacgaaaaaaaaaaagggggggcgccccccccgtcccaaaaaaagggccccccgggccgccgggggtacaccctgggaagaacagacacccgagcccacccgggcgaaccaggaaaaagggagggaccaacgtaaaaaccggcccgctgaccccccccccggggcaccgataaaagaaaacccgggggggggacctgcccgccccacggggaaaaggaggagcccggggg

SEQ ID NO: 23114 - DNA, 602 bp, Zea mays
  Clone ID: cC-zmle189044h12d1
aatacacagcgccgtaaagcgaaggcctttgtgattcggacaatgcgcggtgaagggcataatgacgaatatcaagacgaatggagcgagagcgatggtgaatacccttttgcgaggcagcttacaattacaaaggccaagaagctcatacgaaggaagttccgtccaagggtgcaaaagaacccaggtctgtcgatgcaagattcactcccatctagtccgcgggaaacaactccatatcaaagtgactcctccaggtcatcttacgaggacttccatgagcagtaaaacaatctggtgatgctgctttcagcttctacatttggtcgataagatgcagccatttatattggttatagtagggtgtatgtatatagtaggatgtaccatcaaaatccaatgtatcatgtatagtggttaggcaatactccgtaattatgtgcttgtaagttaataagaggccagctcgtactcctagaaaacaaaacccgtgatctatggcatggggcattcttattcccttgtacttcaggactagtatggattgtaaattcaacggtgaaggtgttgcaacatttattcagtaaagtatccttgttgag

SEQ ID NO: 23115 - DNA, 581 bp, Zea mays
  Clone ID: cC-zmle189045a01a1
atgaaggatggcctatatgacattgttccccatgtattgcgggctgtgttatggctgagcttggagagctgtggcatatgtagtcgggtggctcttgagaattgccaaggaccctatgatccaaagattatcctgcccaccccaagggaacctatgctgatgactgcattgtgtagagggtcactcagcacacatgctacatagatgctacttgtgatagagattttaacaggaggataagacagggtcctggtgttccaatcatgttcattacatgacatatgtattcgatagaacggctccctgaggccacaattggtggagcaccaataatctgatcggtgcagacatgagatgttctgggatgtaatactatggcggtacttgtccatctgaccaagtcactatttcatgtttgagttcacgacatggactaggatcagaacgctgctttctaggttgagcttactgtaactactaagaaattttattatgttccaaccttatcatttctacaatgttgcgtgaggtctgaaggaattccttgttatatccgatctcggcttagacaagaatgataa

SEQ ID NO: 23116 - DNA, 313 bp, Zea mays
  unsure at all n locations
  Clone ID: cC-zmle189045a06a1
ggggggaaaaccccggggatttaaaggccagggctttnccgcaggccggggggggccccaggggggggcccaaagggggggcccaaacccccggggaaaagaaaacccccggggggaaaaacccccagggttccgggggggacaattttcccaaaccccaggccctgggaaagaaggggggccccaaaaaacgatgaacccttggggaaaacccagactgggggggcccccaaaaaaaaaaatcaggaggcgcccaagaaaaacaaaccaaaggggccccgggggggacccacaaaaacccccgggggggaaa

SEQ ID NO: 23117 - DNA, 499 bp, Zea mays
  unsure at all n locations
  Clone ID: cC-zmle189045a06d1
tctttctcctccatgcgctgcgcccctggcccctctgcccgagctcgcccatggcacgcagctgcgtcttcaagctcggtctccatctccatggcgccgtctgcccttgtcctgctccctagttccggctgagctcgcgccctgctccctggcatcgcaagctcgtcggagttcctcccgttccctgctcggaccgcggcttttcccccggagctccctgtgctcgccatggccaccgcgcctgctccctggacggcgctcggattcctccttctcggccgtttccagcgcgcccatctccaacggcgcccggccaaagcctccctacgcgcgcgcctgctcccatgtcgcgccaccttagctcgctccctcaagctcgctgagcccctgctttccacttccggtcgtccatggccgcgcgtcttnctcctacgcaagccactcgataactctncccagcgcacgctctncatggncctaccaccggacgccattgcgc

SEQ ID NO: 23118 - DNA, 408 bp, Zea mays
  Clone ID: cC-zmle189045a08a1
tttttacatttttttctttgaaccctaaacgaattatccatacgggcgatcagacagggcgctgatgacacactacagtacatgcagagatcagcacttcccagatggatgattcctgaagctgtctaaagaactccagcaatacaactagcaaccatatgatagcacattcacaagtttagtgctcatgccgcacccccaaatgaacgtgaaaaagggaaacgggatgccaatagaggatccttaaagataggcttctgaggacccatgtgaactttagaatggtacatactagcgtagatcctcgagaaaactaacattgctggagctgaccgcatgaggcccctccacaggatccttaaaaggagcctgatgactcaactctccaaatgcgggaacaacattgtg

SEQ ID NO: 23119 - DNA, 356 bp, Zea mays
  unsure at all n locations
  Clone ID: cC-zmle189045a09a1
gggacaaaaaaaacccccaaaaaaaacatttttaaaccaaaaaaagggccccgggcccccggggggccaaaccccgaaacccaaggggaagaaaaaaatgggggggggggggacccccgncccccggggggggaaaaatttctgaaaaacaacaaaaaatttccgggcgggaaattttttcccgggggggggggcccggccccccccaaggggcccaaaaggccccaagggacccgacattaaaaaacccttcctttttcccgtttgggacctgaacggaaaaaccccaaatgggtagggaaacaagccggggggaaccccaacaaggccccttttggggaggaaaaaaacccccc

SEQ ID NO: 23120 - DNA, 474 bp, Zea mays
  unsure at all n locations
  Clone ID: cC-zmle189045a09d1
gacccacgcgtccgactagccatattcttcctcagctggacaatcgagcaataatcttttagaacatggatttcctgagcgaccagagcagcctgagtgtcaatattatatgaggactggcgattgcaaatttggaactacgagtaaatataaccatcctcgagattggagcactcctaagtccaattacatgttcagccatctatgccttccacttcgtccgggtgctcagccttgtgcgtactatgcccaaaatggatattgcagatatggagttgcatgcaaatatgatcactcaatgggtacactaagctacagttcatctgctttgccactatctgacatgccaattgctccctatcctattagcttctccgttgccacgttggctccatcttcgtcttccccagaatatattncaactaaagatccatctatcaatcatgtagtatcaccagaggcaggacccgcgcc

SEQ ID NO: 23121 - DNA, 215 bp, Zea mays
  unsure at all n locations
  Clone ID: cC-zmle189045a10a1
aacgagggaacagtatgattactttattccatctgcccatttaactgttacaccgcagtttagtcgagcaatttttgaactacaccataattggaactggaaaagcaaatcctatgatggcaccattggaaaaactgctcagntntcaagcgctataaggattatacatagccaataagtttcggccttggcaaaaaatttggcaaaacgtgccc

SEQ ID NO: 23122 - DNA, 363 bp, Zea mays
  Clone ID: cC-zmle189045a10d1
cgggtcgacccatcgcgtccggaagatgtgcggcaggcacgtgagttcctctcgaaatagggtgatcttagccaaactcagatctttgccaaaattgagaatgttgagggcttgaaccattttgatgaaatactggcagaggcagatggtatcattctgtcaagaggaaaccttggaatagacctccctccttacaaggacttttcgacccacaagtctgcgcttcacaagtgcaacatggctggaaagcctgctgtagttactcgagtggaggacagcatgactgacaacctcagacctactcgagcagaggcaactgatgtggcaaaagcagctcttgatgggagtgacgccattctcctt

SEQ ID NO: 23123 - DNA, 104 bp, Zea mays
  Clone ID: cC-zmle189045a11a1
aaggcaagggttttttctcattgccccctccagaggtaaagcagggacgcaaagcccaaaaaaaaaaaaccgaggcattcggccggccccggcacggggaaagg

SEQ ID NO: 23124 - DNA, 426 bp, Zea mays
  unsure at all n locations
  Clone ID: cC-zmle189045a11d1
ccatcgcgtccgatctacgtatatgccctgggcccgggtcctctccccatgcccctctccattgtcggctggaccctcgcgtagagtgagggagacgagagctagaaaccaaagatccacgctgnccttgctctctgcaggagggcacaagaaggaagtgatggcggccacgaggattcagtgagagcccaacgatctgcagaaggaccctcccacctagtgcagcgcaggtcctgaagaggatgacatgttccactggcaggcaacaatattgggtccatcttatagcccatatcctggaggagtggacctagttacattccattgccctcctgattatgctttcaaacctaccaaggaggcatttcgcactaaggtgttccatccaaacatcaacagcaacgggagcttttgcctcgacatctt

SEQ ID NO: 23125 - DNA, 292 bp, Zea mays
  Clone ID: cC-zmle189045a12a1
aaaatgacgacaccactcttaaatatatttaactaattccttttacataaagcttctgggaaaaaaattcgtaggacagaccatcgatctctctagaaagcctggctcaggacatgtgtccacctcaatctatatggtagccgaatttacgggaaatggaaactaaactctacaggaaaccacccgtaatacacgtacattaacatgaattcgggaaaattcaaacaacatcttaaacatcctacccaagatgctcgaaatttgatcagtctataataaatagccttccgct

SEQ ID NO: 23126 - DNA, 581 bp, Zea mays
  Clone ID: cC-zmle189045b01a1
aacccaaccaaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgccccatggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaacttgcaggaaata

SEQ ID NO: 23127 - DNA, 330 bp, Zea mays
  Clone ID: cC-zmle189045b06a1
gccatgcttccgtcgtcaatcaggggggccaggtgaccatttcccacgcaggggctctaatcgatcacccaggctgctgacgacctaatgccacgctgcgttttctcatgcgctgctcttcattccgtcagctgagttgccggagaatgcccagagcggcttggccagggttcgcttcgtagccttcactgacagagacagagggctgtccttgcccatgaggcaggttccctgcctgacgttgcagatggggtagtcatgggggcagcagctgtagagatcgtcgcagcaagaggcgccctcgagcgggcagcagccccaggcgaagca

SEQ ID NO: 23128 - DNA, 581 bp, Zea mays
  unsure at all n locations
  Clone ID: cC-zmle189045b06d1
ggaatgccagggtcgacccacgcggtccgcttcactggaagctgaggttcagcgctggaccatggtgtcacggccgtcggctacggcacagagaacggcaaggactactggatcgtgaagaactcatggggcagcagctggggcgagtccgggtacgtgaggatggagcgcaacatcaaagcgtcctgcggcaagtgcggtatcgcggttgagccgtcatacccgttgaaggagggcgccaacccgccgaaccctggccccagcccgccgaccccgaccccggcgcccgccgagtgcgacaactactactcgtgccctgactgcaccacctgctgctgtatctacgagtacgggaagtactgcttcgcctggggctgctgcccgctcgagggcgccacctgctgcgacgatcactactggtgctgcccccatgactaccccttctgcaacgtctggcagggaacctgcctcatgggcaaggacagcccactgtcactgtcagtgaaggctacntagcgaaccctggccaagccgcactgggctttctccggcaacacagctgacggaatgaagagcagcgc

SEQ ID NO: 23129 - DNA, 285 bp, Zea mays
  unsure at all n locations
  Clone ID: cC-zmle189045b07a1
gaaacgggtcctctcatgtacaatcaaagaaacacacaacaagcatggcgagccaggccatgcctagctctctacgtacacacggagcgtgcatgtgcatccctgatgaaaagcatcaaagaaacaatagtttacgtcggtcacgcgacgctgaaggaggcgggggccttctcgacgcccttcctggcgcccttgaaccaccgcttgtcgccggcctgcgccttgcagatgtagagcttgccgncggagacggaggcggngatgagctggtgcttgccgccctcg

SEQ ID NO: 23130 - DNA, 431 bp, Zea mays
  unsure at all n locations
  Clone ID: cC-zmle189045b07d1
cgtccgcccacgcgtccggaagagccatctccgagtacgagctcccccgatgtgttcctctcgcaggtcgactacctgctcggcaagcaggcctacggcggcaagaccgactccgatggcgggttcgagaccgacgccgaggccaccgcctacgtgctggagagctccaccccagaggaggacggctagcagtactacagcatcacctggctgaccaggacagcggtcggcgacgtgggcggctagcaccaactcatcaccgtcaccggctccgacggcaagctctacatctgcaaggcgcaagccggcgacaagcggcggttcaagggcgccaggaagggcgtcgagaatgccgncgnctccttcagcgtcgagcgatcgacggaaactatagttgctttgatgcttttcttcagggatgcacatgcacg

SEQ ID NO: 23131 - DNA, 393 bp, Zea mays
  unsure at all n locations
  Clone ID: cC-zmle189045b08d1
gatcccatcgcgtccgctcaaggatcgattatcttaggaataccctgagatgcggttcatttttacttcgccacacccaaaggatttcccagatgagctacagtatttgatgcgggatagggataacatctgcaatcttattcacttaccagcacaaacaggcagtacagcggagctggaacgaatgcggaggggttacactcgagaagcatacttagaactagcccacaaaattcgcgaagtcattcctgatgttgggctaagcagagatttcataactggcttttgaggagagactgaagacgagctcgccgagacccttagccttgngagggctgtaggatacgacatggcctacatgtgtgcatacagcatgagagagaagacccacgc

SEQ ID NO: 23132 - DNA, 433 bp, Zea mays
  unsure at all n locations
  Clone ID: cC-zmle189045b09a1
tttttgtgttccttttggtgatgtgcccagggcctatttattgagtctatataaaaaaacatcatttacaatatgcttaggggcataactgacccgnaacggacgtgaaattgagcatcctctgagctatgacaaaattaaaatcccatgacgtgaagctattacaaatcaagatcattccaacactggggttattttccctctttcacaggcacagaagaacgaagctcctgtgtatcagcaggtgggatacacacacacacaccactcgtgcaggtctgtaaaagttccatccaggcagcttttggcaccgcaagcgtctggaagcagnaggtgcaaatttaatccgcctctgncgcttcttcagaggtagagcttgtccagatcgcctttgaatttggcctttatttgctccctcttcatgtttagcgct

SEQ ID NO: 23133 - DNA, 105 bp, Zea mays
  Clone ID: cC-zmle189045b10a1
accatgattacgccaagttctttttattttttgtttttgtaacaccttggggggtgggggataggtgcaagaccccccaagctgaaacacagcttcaccgctgga

SEQ ID NO: 23134 - DNA, 264 bp, Zea mays
  Clone ID: cC-zmle189045b10d1
cccctttccctttttttttagatcttcgaacaaatggacactttcatttatcttgggggtttccgcttgctctccttaccctctaccaacccacgaaccccataagtaatcttgtacccaaacattcactcacctctagatacgacaaagccttacttcatgaacctgctgtccctgttgagaaaaccaccaacgccaccggaagagccaccagaggcaccaccaccggtgccacccttcaagttcatctggagagccatcttt

SEQ ID NO: 23135 - DNA, 66 bp, Zea mays
  Clone ID: cC-zmle189045b11a1
ctagtatgtggagacacacacctaggatggaggggtattggtgcattaccccggaaactgaaaaac

SEQ ID NO: 23136 - DNA, 255 bp, Zea mays
  unsure at all n locations
  Clone ID: cC-zmle189045c06a1
ttttgaacatgaacgtatctcgttacaatttacatgttctttctaatcacttgattcagaacagtaaaaagatggaaatgaagaaaaggttccgtcactgcacggagaagagaagaggttagacctctatactaggtggaaattgaatggaaggaagaggggaggtaaacagtaacaggctactctacctatacaaccacagagacgtntctctctgatgttgcggtagcgcgcggagccgcctcccccccaaac

SEQ ID NO: 23137 - DNA, 312 bp, Zea mays
  Clone ID: cC-zmle189045c07a1
atggccagccctttttttttttttttgttttttggatcagctggaatggtttgaggtcttaatcacagctaaccgaacggaatcggaaacacgagagggcagtatcggagctccctaatccggagctttatcacacggaggttgcgatgcctagatccctgcaggtgtacatcgatcgccgcaaggctagtcggggggggcgggtactctaagctgcagagcttgttgactggctaggagacttgccaggcgcaggtcatgccctcggggatgacgacaaggcctaccgtgccgatttccaggaactactgc

SEQ ID NO: 23138 - DNA, 384 bp, Zea mays
  Clone ID: cC-zmle189045c07d1
ggggagacccacgcgtccgcccacgcgtccgaggacgcgtggggacccaggagcgtgtttgttttcgaggctgtgatgacgagcccaaaggaggccaccccggtccagttccacacaaccgggcgcctgagcttgtgctccttttgctttgccagcgcatcagggcggcggcgattcgcggcggtgagggcgtccgaggagacgatggcgacggagtagctgggcatcaaggaggagcgctacccgcccgaggcccgcctatccaagctgggcggccggcagaggccctagagggggtgcgagaagagcaagctcccgtggacctacttcgccaaggtgacgtgctacctgctgcaggggaaggtgatagtgctccccgaaggc

SEQ ID NO: 23139 - DNA, 357 bp, Zea mays
  Clone ID: cC-zmle189045c08a1
agagaggatctaatttaattaactagcatagttaatggtttgattaataggcacgtcacgtgcatctacatattagtactacgtactcttacggtctcacacgtcacgccttattcgttctgtatatgcatagcagctccattaccacgtttgctggggaatatacacagcatggcacattgaacgattgacatcatgcacatgtagctaagccatgatgccaggaccatgagacgcgccgatcgatcactcggaggtcggaggcgcaagaaggaagctagcggcgccgccatggcctgctccaaaccctagtccttgctcgctgaagctgccgctctgatcgacatccgctgcccc

SEQ ID NO: 23140 - DNA, 382 bp, Zea mays
  unsure at all n locations
  Clone ID: cC-zmle189045c08d1
cgtccgcccacgcgtncgctaggctagggactagggccgcccggccgcgtggaatatactcactcctgccttcatacgtaggcataggcgcggcagtacgtgtatgtggctagctatacgcgacctcagctcgggcgcaagctacaaccccgaccaggcgagaagaagcatcgatagtgagacgagctaacccaccagcagcaacgtaatccaaatccatggacaaccagccgctgccctactccacaagccagccccctgcccccggaggagccccggaggcgggcatgcctggcgcggcctgcctcccacccgagccggaccaccacctgctccagcagcagcaggcccagctgcaggcgttctgggcgtaccagcgcca

SEQ ID NO: 23141 - DNA, 441 bp, Zea mays
  unsure at all n locations
  Clone ID: cC-zmle189045c09a1
aactaggctaaaaggcatctctccatgacaacgtgttatacagaaaagactttttcacacatcccacttaaggagctatcctcgcacaacacgaaagctaaaaccatatcgaagagcaaaatacatttacactcgtatatgcagntttctgcaatcgccaggcggggagaaaagaaccactactgaagaatttacaatcatgaaatcgaacgggcatcctcctaccttgggtggttccaaggagagggaggcttgaataggaaaaccttgcggagcagatccacgtcccaaatcaaggctatgaagntgttccatcagttgcgaccttcgctccttgaagaaatctagnctagntggtagctctaccaaagaggaggatgtgaccattggttgcctcccaaattcaatgccctctgccaacttagggacgntgatggacac

SEQ ID NO: 23142 - DNA, 459 bp, Zea mays
  unsure at all n locations
  Clone ID: cC-zmle189045c09d1
gcgaccacgcgtccggatggatgaagtattagatatggatggagatgattctgcactgcttcttgctgcagcaaacgccgcatactgagctcttggtttagtcgcaactctcttggtggaatatgtgggcatttttcatgatgaacacctcagatgttccttgtcacctgaatctcaaattgaagatagaggtactgaagcatcaactgatgatggtaatttggaagccaagggcaatggatttcatgatgcagaaaatgatgtagatcaagaaaaggatgatgactatggcgtggagcgtatactttgagggaaattgagtgagatcagtggatatgctggcagagacctctatgactactaggcagncaatgctgaagagtcagatgctgaacgccctgtgaagatgtaggaaggaaatcagaatttgagcaaagnacagaacagcctttcaactga

SEQ ID NO: 23143 - DNA, 229 bp, Zea mays
  Clone ID: cC-zmle189045c10a1
agaatggaacccatttgtaggacttaaaccatggggcgaactcttggtttttacccctgctataaatgggggattttacccccccttttccatatccttgggggggacgagccccccccattgggccagaccaccaaaaaaagattagggggtcctttcccagggggggggggattttttattctcccctggatagacaccctcacttggaaagggttcctcttttttt

SEQ ID NO: 23144 - DNA, 390 bp, Zea mays
  Clone ID: cC-zmle189045c10d1
gacccacgcgtccgcaagaaattttgattcttctagtaggagctatgaacttcgaagttgcaatgcagatgggttcagtgacctatcaccatctgaaggatattatcttggagaaatgaggctcagacagctgcaacattggagatcatggagggtttgctccaaatatttccagcatatctgaaggcctggatcttgttattgcggcaatagagagggctgggcattatggaagaataaaattgacaatagatgttgctgctactgatttttgagtaagttgcatgggatgacttgtagaagtctgaccctgaacgcattatgcgggctgtttgagagtacacttgcaatgctctagttctcaaggcaaatcatgtgggcactgtcact

SEQ ID NO: 23145 - DNA, 73 bp, Zea mays
  Clone ID: cC-zmle189045c11a1
ttttgtttttctgattactttttttgcactgtgaggatgtagtcaaatgaaagagggtaacaaaaagaaacaa

SEQ ID NO: 23146 - DNA, 353 bp, Zea mays
  Clone ID: cC-zmle189045c12a1
ttttatatacatcattggtgcaaataatatcgccacaaaattacacatctcctcataaccacattactttcttattcttagcaaggatgccatggtaacttcactccgcatccgcaaatatccaaagctgcaagcagcacctgttatttgaattaggacttatagactatacagagacaagcataagtatatagtatcaacttcttgaactattgacacctttaggtagaaaggaggtacatggttgagctcttctggagtgcccaagccttgagcttcagcttgatgaagtccgaagctattggatccaatccttattcttggcatttttcgtcccatagccatacccaccg

SEQ ID NO: 23147 - DNA, 375 bp, Zea mays
  unsure at all n locations
  Clone ID: cC-zmle189045c12d1
gacccacgcgtncgaataccttaagcaagagaccaatgtctcaagcccagttttctcttttccaagcccagaggaaacacgttgtattggaggataaccaagcttatgccatgaaggaaccaggaaccggagggtatggctatgggacgaaaaatgacaagaataaggattggatacaatagcttcggacttcatcaagctgaagcacaaagctagggcactccagaagagcacaaccatgtaccaaccttctacctaaagagagtcaatagttcaagaaggtgatactatatacttatgcttgactctgtataggctattagcgcttattctaataacaggagctggttgcagccttggatatttgcggatgcg

SEQ ID NO: 23148 - DNA, 76 bp, Zea mays
  unsure at all n locations
  Clone ID: cC-zmle189045d06d1
ggaatngccgggtcgacccatcgcgtccgtatatataaataaaaattaaattatttttattttaattttttttacg

SEQ ID NO: 23149 - DNA, 299 bp, Zea mays
  Clone ID: cC-zmle189045d07a1
gggatccatcgctttgaaaccatcaaatttgatctccttccatttttcacaagctgggggttggtcagcactccatttgcaagctggtttgataatttcattaccttcacgagcaagaacgcgcccttcggtacgagcttggacacaggcttctaaagccacacgattaggtggtgcaccaggggcatttccccaaggatggcctaaaggtcccccccccaattggaatacggaatcatctccaaagatttcgggcagagctgggatttgccaaacatgaatacccccagaagccaccg

SEQ ID NO: 23150 - DNA, 293 bp, Zea mays
  Clone ID: cC-zmle189045d08a1
atcgattattgatgatgttttgaagaacagagttttgaaccatggagcagtttggaagtttttcatgactggaaaaaaaagggagatgggattgtagcttttatgagcactgctactagtaatgttcacatagcatggctctgtaataatactggggatcaccacatccaccagcagcaggcaatccggttgccaacgaggaggcagcctcagacaagcacctgagctgcagctagcctagcaatcggaaccctgaaaggggagcatgaaacgtaatccagcccagccttcgc

SEQ ID NO: 23151 - DNA, 431 bp, Zea mays
  unsure at all n locations
  Clone ID: cC-zmle189045d08d1
ccacgcgtccgcggacgcgtgggggaaagttcattcccgtctatcttgctcatggcatcctccaacatgaccccttcgaggtcctggaccagtggggagtgggcgagctggtgaagtttgctacagagaggggccgcaaagctaggcctaacttgaaggagggcatttgaggagtacacggaggagagccttcgtctgaggccttcttcgcgaaggctgggctggattacgtttcttgctcccctttcaaggttccgattgctaggctagctgcagctcaagagcttgtctgaagctgcctcctcgttggcaaccggattgcctgctgctggaggatgaggngatcaacagtattattacagagccatgctatgtgaacattactagtagcagtgctcataaaagctacaatcccatctccctttnttttc

SEQ ID NO: 23152 - DNA, 285 bp, Zea mays
  Clone ID: cC-zmle189045d09a1
ttttgttttttttgtttttttttttttttttttttttggtgtttggtttcgataaccaggggatgccgatgtcacccgggggacttcattgggaaagaaaaagacggggggctctgggcagacccaccgccaggagaagggaacgcccacccttgcgcttacaaggagggacaggggcccacactggccccagaggggggcgctgaccgccgcaggcgccggaggagacccaaggcttgcaccgggggggcgctggggccctgaaggagcggcccacccccggga

SEQ ID NO: 23153 - DNA, 396 bp, Zea mays
  unsure at all n locations
  Clone ID: cC-zmle189045d09d1
cggaannctcgggtcgacccatcgcgtccgcggacgcgtgggcgcacggtcccaacgaccgcacgctcgcgctgtggctcaagggtgacccctcgtacctggagggggagctggacttgacgctggccacctacgggatcaacgccgngtgcactcacctaggctgagtcgagccgaggaacggcgctgagaacttgttcatctgcccctgccacggatccctgttcaactaccagggcaaggaggtccgaggaccggcgcctctgtcgctggccctggttcacgccgacgtcgacgacggctaggtcctcttcgccccgtgggtggatgaccgacttcaggtccggcgtggacccatggaggaaggcatgttgatgatccggaaccagcggtgct

SEQ ID NO: 23154 - DNA, 404 bp, Zea mays
  Clone ID: cC-zmle189045d10a1
agccagcccttttttttttttttttttttattgtttcttttatgttcaattaaagaaacacacaataagtatggtgagtcaaatcatagcctagtttttaacgaatacactgtctgtgtaatgacatccccgcagaaaaggcccaaaaaacccatagggtacacccgtaaccctcccccaaaaaaggggggggacaaaaaaaaaaccccccaggcgggggaaaaaaaacggaaggggccaaaaaacgccccggccttttcccggggggggggggggaaaaaaacaaaaaaaaaaagggggggggcccccccaaaaaaaaacaaaaaaaaggggggccccgaaaggcgggcctccaggggggggagaaccaagggggcggaaataaacaccacgggggggggggc

SEQ ID NO: 23155 - DNA, 527 bp, Zea mays
  unsure at all n locations
  Clone ID: cC-zmle189045d10d1
gacccacgcgtccggtattcccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcaaggctacccgccgcagggctacccgcagcagggttacccgcagcagaggctacccgccgcagtacgcgcagccgcctccacagcagcagcagagcagcgggccttccttcatggaaggatgctaggctgccctctgctgctgctgcctcctggacgcctgcttctgacggaaccatccgagccgggttcaacacggctgcaagagaagcaaccagcttacggaagagctggaactgggccgngctattctagctttgtnctgcgttatcgccctcttttcttttctttttttttctctctctc

SEQ ID NO: 23156 - DNA, 353 bp, Zea mays
  unsure at all n locations
  Clone ID: cC-zmle189045d11a1
ttttatatatctcaacatctgatattgacgaagccattcttctttctatattgagagcagagaattatgactactacagaactttgaccaggaccaaacaatcggctgcaaatgcatggctacaacggaatctcaacacctgggtgagaatgccatgatcctcttctctctttttcgctgtaccataacaattgactagggcacaatataaccaataaatcctcgcagacaaagaagcgggaaaaaaaaaagaaactaagaacatcgnattattcggtcgctgagaactgaataactccatctccagaagacaaaagagcagagcttttaactctggagggagcaaagccatg

SEQ ID NO: 23157 - DNA, 439 bp, Zea mays
  Clone ID: cC-zmle189045d11d1
gacccatcgcgtccgacttaaaggtgatccgagagatgacttttcctttccttggttattccctgctggcatgagacctggtgcggaccgtgtggccaacctgtgggataggctgctgtgtgcaaggcccagcactttggatgtcgccctcccgatatcagatcctaccaaggcttctagaagaaaggtgcgcggcgagagggctcttgaggaatggttggctgccgacaatgctggtgacacagaggcctggcctcgtggccatggctaccgggaagactgagaacgttgttgggaccatgagctcctgttttaggagccatggctgtgctcgctccagcgatgatagctctgcacttttgccttctggagatggagatcttctgtgcacagcgaacgattgacacggtgctcgtaggtcctttttttttgcccgctt

SEQ ID NO: 23158 - DNA, 422 bp, Zea mays
  unsure at all n locations
  Clone ID: cC-zmle189045d12a1
atgtaataaattatgaatactcagaaacgtttgttacattgttcatctcatatatgagtttcaacctagtacaaatatagagggcattcttgtcttcctcatacaaaagaatcctattaacaactcaaataatctgggtaaacaaacagaactactcagattatataatccagattatataatcctccaaaaataatccagattatataatccatggggtaaacaaacaggccctaaaccatcacgtattccgggattcacaaatttgctactgaaggtgattttatacattaacgcatatatacatctgacgaatgcccataggtctacagcagnagcgtgacggaattctactatcacaagagacaactgacaacccgaattcctgggggtcaccggcacgagaagattgcccatgccct

SEQ ID NO: 23159 - DNA, 406 bp, Zea mays
  Clone ID: cC-zmle189045d12d1
gacccacgcgtccgattcaagctgatggagcgatcaggcattccggacatctctgccgatgaaagcggaggtctcatgctccaggagaaattccggttggatctggacgacgaggaggctatacatttcttccaggatcttatcaacgatagcgtgtgtgctctgttccctcaatggttgagaccatccatagatgggctcaatattggcggtaacacaagctaatgtcgtagaagcaagagtgaatctgtacatgctgactgtcacatgccacggtaataagcgagaaacgacactgatggatggaagcctaagcgcctagcatttggggttcaagctgcgccgcatctgcgaatagatagggctgatgcagggcatgggcaatcttctcgtgccggagacaccc

SEQ ID NO: 23160 - DNA, 256 bp, Zea mays
  Clone ID: cC-zmle189045e05a1
atcggaaaacacggaatttccccatcaggcccatttcatctggggttaaactatacatacaggcgcaggtgacacaacccaaggggtgccttttatttacacccccctgggtttggttggggggtgggattccggaaggccgctagctaggttttccaggtctccggggtcttacacggagaaggaaaccatttggttcacatacccacatagcgggggggaccaaaatgggtgggtcaggggcttcagggggggg

SEQ ID NO: 23161 - DNA, 365 bp, Zea mays
  unsure at all n locations
  Clone ID: cC-zmle189045e05d1
cccatgcgtactgacctatatggcaccacactttgatcacacacaggaagttgagatcagaaaaaagcaagctgccgctactgacgacaaggtctcggccgagctgcccgccaagggcaggccggcgtgctggagctaggaggaggcccgagtccccgccacaaggaggagcttccgtgtaggtggcgccttttagaccctagtcaagcccaccgactactagtgattcgnctcggagttcccgatggaggcctgcgacctgctcggaggcatcgcgtgcaataacccgatcttgccggatgccaagcccgacttaactagcgtggaggcgatgcatattgcggaacgcgcggacagggactacc

SEQ ID NO: 23162 - DNA, 141 bp, Zea mays
  Clone ID: cC-zmle189045e06a1
gttcctttgtttttttttatggtcattggtattagcgtgcctaggttcgtttggaataaaatggtgcgcgaggcttttaacgtaaggaactgcaggtcccgaacctaggggacagccggcaggaacaccaacctggtttgc

SEQ ID NO: 23163 - DNA, 387 bp, Zea mays
  unsure at all n locations
  Clone ID: cC-zmle189045e06d1
gcggaatgcccgggtagacccatcgcgtgcggctgttgcggagagcacaatccctttttaaaaagacaccgcccttcccttagctagcggaaccgccctctgctcgccgaggttggggtttcgagggtagacgcccgccatggacgcgttccagaaacagctggacttgaggatgggcgcctaccgcaacagcgacgccgaggaggagtgccggaactactacgaccgcgacgtctgccgcctattcctggctagnctctggccacacgacctttatcagctcacagaaaaaggatctcgaggcttgttctaagattcattctctccaactgcggtaagtgtatgaactagcgacagcaaagggaacagacattttggatagagaac

SEQ ID NO: 23164 - DNA, 263 bp, Zea mays
  unsure at all n locations
  Clone ID: cC-zmle189045e07a1
agccagcccttttttttttttttttttttttttttttttttttttttttttttttttacttggattctttgaccttattcaaaggaaacagcacacagcatgttccatgttcgggtatacatggatccctcgagaggcgaaacaagacgaccgagggccgaaaactgaaacggaaaccaaagcccagtttgaaagaacacacggaaacggagcttcttgggggctagcgccgcctcctcgccggggtngtccaaaaaccaaac

SEQ ID NO: 23165 - DNA, 502 bp, Zea mays
  Clone ID: cC-zmle189045e07d1
ccacgcgtccggccggagccggacgaacgaacgatgcagcaggacctcagaaactcagagtgaagaaacccggaacaggcgcatgcagagatgtcggcgagctcgaccaactccgcggcttccccggccgagtccggcctcgactacgacgacacggagctcaccctcgcgctcccgggctcctccgccgagcccgccgccgatcgcaagcgcgcccacgccgaccacgacaagccgccatccccaaagtctccctctccctctcccttcccttctctttattcctctccgcgtgtggacgacaactggacacacgacacgacgcccacggaccgcttttgctgaccgacgtcacgtgctgcaaggcgcgggccgagggctggccgccggtccgcgcgtaccggcgcaacgcgctgagcgacgaggccaggctcgtgaaggtggccgaggacagcgcgccgtacctgcggaaggaggacctcgcggcgcacgacgggtacgc

SEQ ID NO: 23166 - DNA, 354 bp, Zea mays
  Clone ID: cC-zmle189045e08a1
aaacctcaattcagtatgctttttttttctgcatccgcgcgcgcatcagatggatacacgaatcatcatccccaccaaatgggcttgaacagcaaagaaaaaaaaaagaatggaatgatccgagcgaggccaagatcaatggcaatggcagtaggagaggcaatggccgttctcccgcgccgcgcccgcgcccgcgcagggggtccgggcctgaatgcggcggcggagccgccgccacgccgcaggctctccggagctcctcgtacctgcggaggtcgaagccccgggcgcgcatcacgcgcttctgctaggccgcgaaccggctctcgaagaatccttcgaacgacggctcct

SEQ ID NO: 23167 - DNA, 407 bp, Zea mays
  Clone ID: cC-zmle189045e08d1
cccacgcgtccgaagcaagagaagtttcttatttcgagaatataataataatatctgcattttgcatgagcataacattagcaatcgctctttcttttcgatggatctcctatggaaaaaagaagagcagcctagtaaaccgagggaatgttttttttttgttgttgtcttgagttcgaaggcaacacccaggtcgagaaggcaatcgagaatgcgatccccgtgcggcacgccgccgccgccgaggagatcgaccccgcgagggaggaggagctgagggccatggaggcggagattgcggagatcgaccgcgcggcggcggcgcgggtgcggcgggagctgtggtgcgggctgacgtacctggagatccagacgggcgggttcatgcggctcaccttctgggagct

SEQ ID NO: 23168 - DNA, 366 bp, Zea mays
  unsure at all n locations
  Clone ID: cC-zmle189045e09a1
agcggagtaaaaaagcgacagcccgaatttgcattaacaagtacattacatacacgattcctcctctgctctccaaagttttccatggtatacatacaccttcccaagatccatgacggcggncggacacctagcagttagacactcgaatcactcgagctgagcgtaccagaccccctggatcttgacatccttgggcgccttggccccgaggtcggtgtcggacggctgcacgctctcgaagacgccgatgacctcgccggtctccgggttgctctaggagacgctcaacgagatgttgccggaggaggatgcggcgttcttgatgttctccttctggagctcctnctcgncacctctgccccc

SEQ ID NO: 23169 - DNA, 429 bp, Zea mays
  unsure at all n locations
  Clone ID: cC-zmle189045e09d1
gatcccacgcgtccggggcaaaagccaaaaggcatcaccgccgcgacgacgatggcagcctcgctccaagccgaggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgcctgcaggtgcgtcgacgccgcgaagctcgccggcttcgcgctcgccacctcggcgctcctcgtctcgggcgcgagcgcggtgggcacgcccaagaggctgacctacgacgagatccagagcaaaacgnacatggaggtgaatggctcgggctcggcgaacctgtgcccgaccatcgacggaggcgtggagtcgttcccgttcaaggccggc

SEQ ID NO: 23170 - DNA, 338 bp, Zea mays
  unsure at all n locations
  Clone ID: cC-zmle189045e10a1
gggggtgtagacttttttttttttggtgtgtgctttttttgatcacccaggctgttgacgacctattgccacgctgcgttttctcatgcgctgctcttcattccgtcagctgtgttgccggataaagcccagtgcggctaggccaggggtcgcttcgtagccttcactgacagcgacagggggctgcccttgcccatgaggcaggttccctgcctgacgttgcagaaggggtaggcatgggggcagcagctgtagagatcgtngcagcaggaggcgccctcgagcgggcagcagccccaggcgaagcagnacttaccaggctcgtagatacagcagca

SEQ ID NO: 23171 - DNA, 548 bp, Zea mays
  unsure at all n locations
  Clone ID: cC-zmle189045e10d1
atccccgcgtccgcaaaaattatttaaaaaaaaaaaaaaaaaaaaaacaaaaaaaattttattttcacaaaaaaaaaaaataaaacctaaaaatagtataaaatttattcaaaaatcactccataaaatccataaaatacacaccctattcttccactaccctcctgggggggccggcccctcaatcccccgctctctccggccccccccccccccacccccccctctttttgtcccccctaaattcattctccggggccggcgctccccccccgccctgccccgatacccctccgtgccccccctctagacccccagcaccacccccccctctggccccccgtcgttctcgctaaagggcccgcccccttgggcctctcccccagagcgccccccccaattggatctggaccccccccctgaggcccccccttaccccccggggcgggggggtccccccccgggnacccccccccttttctccggcccctcccccaaccccngccccctctccccctcctccccccccctccccggctcttcccccc

SEQ ID NO: 23172 - DNA, 292 bp, Zea mays
  Clone ID: cC-zmle189045e11a1
cgagataaatctcaatcaatatattgattatttctaggaaacacatgtcggtatgagggcaccattgccgagtacatctcatatgtaatctaaaagatggcacctccaacgatgggttgctgcaaggcaaggttcatcaaagagaactggttgtatggcagcaattgttagttgctgctgcaggaaggctgcgaccaaagggttagccactgcctaaggattaatgaactgtagtcgctgttgcaggtacgcagcagagtttgacacagccagttggctgaaaggaagcaac

SEQ ID NO: 23173 - DNA, 364 bp, Zea mays
  unsure at all n locations
  Clone ID: cC-zmle189045e12a1
agcgacatcgaaccacttcttttatacaaaagcacgcagcagagagctaaatggaacacagcgtcatcatcatgggccagaaccatcgncccatcacgcatctagtacaacgccggtaccataccataccaccatctttaactggcccccggattcacgcttccttattttcagttcagttcggaaggggatccaaatccagagtcaccaccggcaaagacgagctcgggcgcgcgcgcacacacacacacactactgggcctctgccagcggctcggcctctggcgccgacgaaaacaccttggcgatgcgttcggaggggatggctgggatgtacttggcccccgcgtagccgtgctccgcg

SEQ ID NO: 23174 - DNA, 293 bp, Zea mays
  Clone ID: cC-zmle189045e12d1
aaaaaccgtatcgtctcgcctgttctgtttccttcttctcttctcgcagcccggttagccgtccaggttccaccggtcctgtggaggcaagcgtatcccgtgtgtgggtcgcgcgacggcggtagagctgtcctaccccctgctccagcatgcggtggagtgggtggttttggaggagcacttccagccgaggagggccccgaagctgaaggacctggacttcggccaggaggcggatgtcctgaccgcggcgggcctcgatgggctgttctgcacttgcaaggagcacgccg

SEQ ID NO: 23175 - DNA, 245 bp, Zea mays
  Clone ID: cC-zmle189045f05a1
tttttttttttttttttttttttttttttctttgttttggtgtgatgttttttttttttttgttttttttttggtttcacctccggggaaggagctggtcttaatcgtcaggggaattggagagaggggaggggaacccaatgagggggccctaggaaaaacaggccctcctcatacgcctataggatccttcaaaggcaggaagggcccgcccaggcagaaaaggtgggaaaacgccccccaat

SEQ ID NO: 23176 - DNA, 253 bp, Zea mays
  unsure at all n locations
  Clone ID: cC-zmle189045f05d1
cactcatccgatctcactgatccttcagcgccactttaagaggctaaccttactatgctgatctccttgattggtccaaagaggttgagtcctagacagctggaagtcagctgctggaccttatcactacccatgagggagaactagatctaacagagtttaacataacagnncacggtcgaatcgttcacatacaagtcaggcttttatccatttgatgccgccggaagcatgtgccctgcagctctctggc

SEQ ID NO: 23177 - DNA, 90 bp, Zea mays
  Clone ID: cC-zmle189045f06a1
gagcggccagcgcctccaccgctgccgcgcatacgacgagcgctgctggcctcggctgcgacgccgagacgccgggacgaggaggcagga

SEQ ID NO: 23178 - DNA, 87 bp, Zea mays
  Clone ID: cC-zmle189045f06d1
acgtcctcgctgcctccggcgcgggtctctatcaggctcacggaccccgacggcctccctatgcgcaaggtcgcctggggatcttgt

SEQ ID NO: 23179 - DNA, 185 bp, Zea mays
  Clone ID: cC-zmle189045f07a1
gtttttgtgtttaccccgcaagcggatgcagacgcccggaggatgtttcgccttgggcttcttgacagggaaaccgtggtccctataggccacgtccacatcagtgggacagacacgaactaatcagggtcagccggcaacttctaaggagctgactgatggatggtgatcgcacactccctatc

SEQ ID NO: 23180 - DNA, 343 bp, Zea mays
  Clone ID: cC-zmle189045f08a1
agttggttgtttttcggggatctttagatttttgaccccctctaaaggtacctcgagcagggggggtccgggtttttttaggccttgggcgctttggggggagaccccggcccaaagacaccccccccttaagtgggtaattgggtctttttatgcgcttctagtcggtgttttaaatgagaagggggctgtcgcgcccccccggggggccccaaattataaaccacccccgggtgtcgggggaatttattattaccataaccccctattccctattaaaattaagctttgggttattaggagcccgggggggcgccgggggttacaccaaaaatttccaatc

SEQ ID NO: 23181 - DNA, 456 bp, Zea mays
  Clone ID: cC-zmle189045f08d1
gacccatcgcgtccgcccatcgcgtccgcatcaaccagacgctcagctatgcgagggagctggagcgtattgtatgatttaatttcacagtaatccctggttagatagtttatttctgaggtcacttggcatggcatgtactgccctttacatttgagatcagctctgatcgcagctcatgtcagctctgatcaatctctgaagggcttgatctctgcggcattgtttcaccacattaactgcattgcttgaaagaagcctgtcatccattgctgctgttaacttttgatgggcttaatattgaattttttcacaaatttaatcaattttttttattcacattaacttcactttgctggggggatgatgccatttccatcgttggtgttgatggcactagctcttgtgcagttccttgaattcctccgaagcgttcttttactccatggggggggg

SEQ ID NO: 23182 - DNA, 350 bp, Zea mays
  Clone ID: cC-zmle189045f09a1
ccccccccccccccccccccccccccccccccgccccccccccccccccccgccccggccccgccccccggagcccaaacccccccccctcccttgtcgccaagggagcagccccccccccggagcgggggacgccccccagagaaagcccccccccccccccggcccgagaaaaaaacccccccccccccaaaagaggggggggggggggggcacacagcccggggccggcgttaaaggggcgcaaggccccccggggcaacaaacaaagggggaagcccccccgccgtcccggggggggggggaaaaaaaaaagggggcccccccccgggaaaacccagcgggggggg

SEQ ID NO: 23183 - DNA, 428 bp, Zea mays
  unsure at all n locations
  Clone ID: cC-zmle189045f09d1
acccacgcgtccgcccacgcgtccggtctgtctttccactttactcgccaaacatctttgaaatcaaggtattggacaggaagttagtcaagagtgcttagttgtattacctgagggacaggatgaacgcacttagaaaatgagtctttctgcttggttcaaggaatttcgccgagcggatcagcacggtttctgatgcgcaacggttgcagccctgagaattgcattgtctggttccacatcgttgctaagccatagcctgttgttgtcgattgccatgcttggttttgagctgcaagagctagcagatatatgttttccgacactatcaaaaaaaattgcgggtattcccttttcgatttacgacactgtagcttcatagcacaaaataacgtgctcagatctattacttncctccgcacctttac

SEQ ID NO: 23184 - DNA, 346 bp, Zea mays
  Clone ID: cC-zmle189045f10a1
caggacaataacatgatgagaataggttaaaagccctaatcctcatcggctccctttacataaaactctagggcctggagctccatacatagcatagctccatttgcaaacacatatcatgccacaatcttctagatttctgcatgaatatatactattaaacactacggattacaccagggggcaacatatttttgtccaataccaggataacaaactggacatgcttctaaagcgcagaactccagccctcatgcagattaggcaaacccaatcctgttctcgccgaagtcaaaaacagggggggaggcacccataaaaacatcacccagtttcccgagaggac

SEQ ID NO: 23185 - DNA, 462 bp, Zea mays
  Clone ID: cC-zmle189045f10d1
gacccacgcgtccggagcctcatactgatgacatagtcccttaggacaactacctggacacccagtactttggacagatcagcatcggcacgccaccacagaacttcacagtgatattcgacactggaagctccaacttgagggttccctcatccaagagctacttttcgatagcgagctacttacaccataaatacaagtcaaccaagtcgaagacttacacaaagaatggagaatcttgtacgataacatatggttctgggcaaatcgctggcttcttcagtgaggacaatgagtaggttggcaaccttgttgagcaaaatcagaaatttattgagacaactcgagaaaccagccctactttcatcattgggaagttagatggaattctaggtctcggatttcctgaaatttctgtaagaagagcccctccaatttggcagagcatgtaacagcagaaac

SEQ ID NO: 23186 - DNA, 279 bp, Zea mays
  unsure at all n locations
  Clone ID: cC-zmle189045f11a1
gattataagaagttttaacttttttctttgggggaaaaaaaaagaaaaaaaaggggcagaaaacaaaaacaaggtaatataacaatccttgtctgggacaaggggaaaaaaaaaaaggggttcaaaaaaaaaaaaaggccccccaaaataaggggtgcccaaatcaaaaaaaaaaaacaagggcgngccccccagcaaaaaaaattttatgaaaaaagaaaaattggggctcctagtaaaaaaaaaaaagctccgataaaaaataggggactctttttt

SEQ ID NO: 23187 - DNA, 339 bp, Zea mays
  Clone ID: cC-zmle189045f11d1
aggatatcaagcgtggttatgtggcctccaactcctatgatgaccctgccaaggaggctgccagcttcacctcccaggtcatcatcatgaaccaccctggccagatcggtaacggctatgccccagtgctggactgccatacctcccatattgctgtcaagtttgctgagctgattaccaagagcgacaggcgttctggcaaggagcttgtgaaagagcccaagttcttgaagaacggagatgctggtatggagaagatgattcccaccaagcccatggaggaggagacattctcgcagtatcctcccctgggtaggtttgctgtccgtgacatgagac

SEQ ID NO: 23188 - DNA, 383 bp, Zea mays
  unsure at all n locations
  Clone ID: cC-zmle189045f12a1
caagtccccctatatatcgaaaccatcactctagcaaatcccacaaacagaagttaaaaggtacccagctatgcctgggtagcattttttatgttgcagcaaaaaaggatacattccccgcttgcgaggtcgattcagcttcctatttcccagctcggcgacagcaaaaccagagatcactcccatgctttaagggcaccacccctcccaattgccttgatgatagtctgcttactgttgcgcgcactgcactctctgggctccgcccggcatctcgtcgtcctcctcgtacgcctcctgggcagcgtgagctagcttcctgcgcatctcttcctcgatgttggtcacatcatgcatagncgnctcctcgcattcatctatct

SEQ ID NO: 23189 - DNA, 184 bp, Zea mays
  Clone ID: cC-zmle189045g05a1
ttttaactttcatgtttttggggttcacacacctaggtagctggggtattggtgcattaccccggaagctgaaaaacagcttcacccctggactggtgggcatgacaagcgaaccgactcctaggacacaagatatatgttcgacacaaccagggggtacatcctgcctggcacaacaaacccg

SEQ ID NO: 23190 - DNA, 123 bp, Zea mays
  Clone ID: cC-zmle189045g06a1
ctggcattattttccttgacaagtctaactagaggttttgttcgtacttcgagtgggagaacattcaattagaagagagataaacaactaactagaaaataaagaagtatgcctgcgcactta

SEQ ID NO: 23191 - DNA, 251 bp, Zea mays
  unsure at all n locations
  Clone ID: cC-zmle189045g07d1
accagcaaacacttgaggtttaccactctttacttttccctacatgcaggtcaccagatcctcctgcttggcgtgcctgacgaacctcctccagtaccagtgccccgcccagacggcgcgcatggcctcctgcggcacgcctttggtctcctgcaggaacgcggcgataaaagcagncatgacgaggacccatccggcgtaaaacaagaagatggcgtgcttcatggcgctaagcagggagacgaacacct

SEQ ID NO: 23192 - DNA, 150 bp, Zea mays
  Clone ID: cC-zmle189045g08a1
ggaatcagatttgcacgtgtatattgatgcctgcatgatgaacttgtttgtttgtttgaactctagagtggtctcattattgaaacccagtggcaaccgtgggccggcttattcagacgacctcgccggaacgggcgaatctcaccgaat

SEQ ID NO: 23193 - DNA, 513 bp, Zea mays
  unsure at all n locations
  Clone ID: cC-zmle189045g08d1
ggaatnctcgggtcgacccatcgcgtccggctgggagtatgatttaaagagaggtattttcccgggacttagtctatagtttgtacactaaatgtgtttgtctaagtcacaggaaggtcctctcaaaagttgaagtcaaaaggtgtaagttacgaggaatgcacataagagagtagctgattgggtagcacaccggacaatctggtgccctctaccttgtctcgggtgtctctgctaaaaatgtcagacagtatgggccatgcatcatacagttttgaccctccaacgactatcttcaaacggctactcgaaggcaacgacttgctggtgcaccagacagtccggagctggtcaatcattggtgtcaggctgccggaggtgtgccaccggacaccgaacagnctggagcacccgcagnagaggcaatttttcctagatttggatcttctttgaatggaaaggggcaacaactaagggatcctttggggttataaaatggacccctatgcgccc

SEQ ID NO: 23194 - DNA, 321 bp, Zea mays
  unsure at all n locations
  Clone ID: cC-zmle189045g09a1
ttttgacgaactaatttaattactattattatatggtcgagaagtgaatgaaaatcgtgtacaaatgaaacatctaggagccgtatactcaatcctttaacgtatgaataactagtatatcttttacgtataccaagagagaggcgccttttacgtactaatgaagccccccgtagattagcggttggctgatggcaggcagagcagctgttgttataccacccgggcgatcgccgtcgcttacctgtccgcgccccatcatccaatagacaaaactgccctggaagacggncctcctcaccgaacgcgcgtgagccggcc

SEQ ID NO: 23195 - DNA, 391 bp, Zea mays
  unsure at all n locations
  Clone ID: cC-zmle189045g09d1
gacccacgcgtccgcccacgcgtccgatcctctccagctttccgctccgcccttgtcgctcgtccagccaccgagcccgagcccgagccgccgagaattctatccagaagcaagcaacaagagcccacccccgcttcgcgcgctctttcgtgccaggcaaacacagagcacagctatctgctcgtgtcccggtccgtccaactcgctcgctcgctcaatccactgatgaaggggatcccgctggagagctactgcctcgccgagcccaagccggtcatcgccttctgcaggctgctcagagccgncagggacgccgccctgctgatgctggccgaggaggggctgagccgcttcccgcccgacagcgccggaggacgccggccaccagccc

SEQ ID NO: 23196 - DNA, 86 bp, Zea mays
  Clone ID: cC-zmle189045g10a1
ttttaggatatcaaacaggcatcgttcatatgcagggcataacaaagctttgccaccagacggatctttggttctatcccatattc

SEQ ID NO: 23197 - DNA, 381 bp, Zea mays
  unsure at all n locations
  Clone ID: cC-zmle189045g10d1
gacccacgcgtccggccatgtgtagcattagatactgcatagattctggaactgaaagctcctgtatatggtagcatgggacttccaggaatgcctgtgacagcagtacctggaaattcggctagaaccgtatatgctgctagagaagaaaacggaattgaagggtttactttcaaagccgcaccataggaccgatcaactaacttatgttacagnagagctggtatcttagagatgggtccatgagagactctgctgatggtcatacctccatgaagcacatattaccggaatcatgaagattgcttcagaaggagctatactgagtatcgggatgcacacataattgaatcggatgaggtcaaggtatacctgggagct

SEQ ID NO: 23198 - DNA, 323 bp, Zea mays
  Clone ID: cC-zmle189045g11a1
agagccagccctttttttttttttttttttttttttttttttttttttttttttgagtgggattatttataatttttaagtttaggtttttgtagggttaccatttttccctatagtgaattgtattaaagccaggctgaaaaagggcatagaagacatcagagagaaaaagaaataagaaaaacaattccccaggaaaatacgaagccggaagaaaaaaaaaaaaaggggggggggaaaaaaaaaaaagcaacccacaaaaaagggggggggcacaaaaaaagttttccaacaaggaaaccagaagagccagctgcacaaaa

SEQ ID NO: 23199 - DNA, 370 bp, Zea mays
  Clone ID: cC-zmle189045g12a1
ccccttcccgccccccccccccccccccccccccccccccccccggacctggggttgtctctcccccaggggagtttaggagtgagccccgccaccagcacatggccaaacgccaaaaacgaccccaagaacacacccccaaccagcgcccacgccccacggccccccccaacccccggggggccccccggacaagaaaaaaaaaaaaaacagagggacccccccgccggcgggggacgggagcacgccagggaacggaggcccgcacagggcgccggggcgggggcggtagaaagagccccaaccgaagccggcggggcgaaccccacgggggaaaaccaaccggcggtgggggggcccccgcgggggg

SEQ ID NO: 23200 - DNA, 437 bp, Zea mays
  Clone ID: cC-zmle189045g12d1
gggtcgacccatcgcgtccgcccacgcgtccgccctcgcgtccgccctcgcgtccgcccacgcttccggttctctgcttcgcgccaccgcagcgttgttgctgtggttcgttctgatggagggtccgcagatcctgcccatgcaagggaacacgaactacaaccggagtttcctgcctagctgtagcggcaggcctaggagtagcggcaacgtcaatagcaacaggtactggtcaagatgagaggcaccgattgcaattccgattccaattccttcaagagcggcaggatcccttttctttttctttttctttttacatcggctacaacaatttttagtctatgccagtagtacatatactgcaataaagcttgttttcggaattgcatgtttggcatgtcactatgctctgctggctggtctttgccgatgtaacc

SEQ ID NO: 23201 - DNA, 259 bp, Zea mays
  Clone ID: cC-zmle189045h05a1
aaaaaaaaccttctttccttccaaaattggggattgggcccctttcccagggggcttttttttgcccccctgggggaaaaaatggttctggttatcccgccctgggcccccaatttcccagaagggggggacctcccccatttccccccaagaggggggggggcccccggcgagaattggagaataaaatttgggcccctgggaccccctttattcccgggaagggtgggaacaaataccagggcccctttccccccgg

SEQ ID NO: 23202 - DNA, 506 bp, Zea mays
  unsure at all n locations
  Clone ID: cC-zmle189045h05d1
ggaatgcccgggtcgacccacgcgtacggccgaggacagggccgcgacttctgcccagccggcggatgcgtgcccggaggacctggagaacatccgcgaaattaaatgggtactggagctgctgatgaagaacagagacatgacctttggcgaggttaagcttaccatcatgattgaggaccctagagatatagaaagaaagagaacactcgggattgaggatcctgatgaaattactagggatgatttagctgacgctttggctgaagttaacgaaagaatgattccagagaatcgcgttgcacttcagntgcttgcctaggagatggcagaatggcctgacattgagatagtagctcctaaaaagaagagcaatcctgggaaatctgtctatgcaaaagccacagatactggcatcgatcctgatacagctgctaaaagactttaccttgactgggactctgctgctgatatagatggcgaagaggaggacgatgatgaaactg

SEQ ID NO: 23203 - DNA, 502 bp, Zea mays
  Clone ID: cC-zmle189045h07a1
agccagcccttttttttttttttttttttttttttttttttttgttttttctttttttattgtttgtatttttcattttttttagagaaccaacacaacccggggggggaggagctaacccacaaagggggtaaaaacgacccctcctgcggccgaaaaaaaaacatattggaagccggcttgaaacattcacaaaagggggggcaaccaaagcatccccgggccgaaggtcgatcacttgcacccaaagactgctttctgggacaacccgggggggttccccccacaacgggaacaattccccccttaaacaaaaaggggaggaaggcgccaactaccgggataacagggaaacccctagggcccaaaaataccaaatgccaaggctcagggccggggccttccgcccacccagaaaattaggaagcgggctttggccggaaacaaaaaagcgcccatattttttgcagggggggggggaaaaaaaaaaaacaaaccgggg

SEQ ID NO: 23204 - DNA, 377 bp, Zea mays
  unsure at all n locations
  Clone ID: cC-zmle189045h08a1
ttttatctttaggaagtccctttattatgttgaggcttcagtcaaatataatctgagctgagaaaaaatgatattctaaattctgaaatgtagctagttacaaccggatcctgccaaagccatgcatgcactcagctgcgttggcaaatttgccagctgaaaatcttcaactgtttatggttgctgcatggctttagatctgctgtacacctgcacaactcaagctcagtattttcagccttttgatttgctgcacggctggtcggttccgcaatatctccacatgacacaagtgtttatgggtgctattctgtaggactccatgtaccaggaacttaaatgcagnattgcagnctttagaagtgcttcaagaaacc

SEQ ID NO: 23205 - DNA, 428 bp, Zea mays
  Clone ID: cC-zmle189045h08d1
gggagacccacccgtccgcccagacataaaggcaattaaaccacctgaggcgtatgggatttttgttttgttggtggaaaatgacaagacaggatacgattttgacagggtggattctgaaaatggtgtgacatactgtctattggaatctgatgaccaaagcgatgaagcctccagtacatgcaaggaaatgatcgatcagtctgctgatacaagggttaatgtcaatgataagaagatactcttgctctacttgtaggatcatgttcattggagataggctgatcgctgggctgatcagaactgccgcatttcttgcagctcctataggtttcttgaagcacttctaaagactgcaatactgcatttaagttcctggtacttggagtcctacagaatagcaaccataaacacttgtgtcatgtgga

SEQ ID NO: 23206 - DNA, 123 bp, Zea mays
  Clone ID: cC-zmle189045h09a1
ttttaggattacgaagaagttttattcaagtcacgagcttatagtcgcaattcgtacaggagctgagtgcgtgcacgtacgatagccaagtacgatgaccctgcacaaccagtcaaccacaga

SEQ ID NO: 23207 - DNA, 315 bp, Zea mays
  unsure at all n locations
  Clone ID: cC-zmle189045h09d1
acccacgcgtccgcggacgcgagggacggcggccacggcttcgaggagcgcgagacctgggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgaggttgactggttgagcagggtcatcgnactaggctatcgtacgtgcacgcactcagctcctgtacgaattacgacaataagctcgagacctgaataaaacttcttcagaatactaaaa

SEQ ID NO: 23208 - DNA, 272 bp, Zea mays
  unsure at all n locations
  Clone ID: cC-zmle189045h12a1
ccccccgggccccgcaagagggggaacccccaacgacagaaataaacccagcgaggaaaaacccccgaaaaagggacccctagggggnntggccgctctcccgagccaggcccgcccccgcacaagggagcccgggcccggagcagcggcggggccgtcgtcacaccggatgctcaccggaaatgctcggacctgcggagggcaaacccgcgggcgcgcatcacgcgctttagctcggccggaaaccggccctcgaagaaaccctcaaacga

SEQ ID NO: 23209 - DNA, 368 bp, Zea mays
  Clone ID: cC-zmle189045h12d1
gacccacgcgtccgcagactcgagagggagaggaggagggtgtccgatggttgagtttttattagctgcagggataggtcgggttcgggtccgccttcggagtgtcccaagagaagggaggcgcggcagcgggtaccaagaggatccaccacatccagcgcctctgggcggccaaagtgtcatgcgaagcggaggagcgaggccagagccgcagtctcgacgcgtcgctcaccgttattcgggagcgcgcccagctcatggcagaggtgctgcgtgctctgggtggggtgatagcctttacctcgctctttggggtgcctcttgggcacaactcatgctttctacaaggccctgcttttggtcccgca

SEQ ID NO: 23210 - DNA, 348 bp, Zea mays
  Clone ID: cC-zmle189046a01a1
cgattcatattctggattcactttcagaaatctctccacatacaaacagagagcatacaacttgagacatgtacggtaagggtcgcttattatccttgtaacaacatcctacagccaagcaaggccaacatcaaagctttattgctctcaagcttcgctcattatgcattggacggaatatatcctctaaccggaagacatgactacagctccaactctttcgggagggatagagacgcaactccgaaccatgtttcagaaacacgttgcctgcactttgctgggggttgatgccaatcccatcggtggtgatgatggcactggcctggggcgggaccttgaactcct

SEQ ID NO: 23211 - DNA, 563 bp, Zea mays
  Clone ID: cC-zmle189046a01d1
aaaggaagcgagagagccgcgcacctatctggcaagcgacgccgtggcctagatcggagtcggaggcgaacacccccatggcggcggctggcggcggctcacgagggaaggtatccttcaagatcatcctcacctccgaccccaagctccctttcacagtgttcagcgtgcccgaggcggagcccttcaccgcggtgctcaagtacgccgcggatggagttcaaggtcccgccccacaccagctgccatcatcaccaacgatggaattggcatcaacccccagcaaagggcaggcaacgtgttcatgaaacatggttcggagctgcgacttattcctcgcgatagaggtggagctgtagtcatgtcttccggttagaggatatatacagtccaatgcataatgagcaaaacttgagagaaataaagctttgatgttggccttgcttggctggatgatgttgttacagggataataagccaaccttaccgcacatgtctcaagttgtatgctctgtgcttgaatgtggagaagattcttgaaagtgaatcccggttctgaatcg

SEQ ID NO: 23212 - DNA, 325 bp, Zea mays
  unsure at all n locations
  Clone ID: cC-zmle189046a02a1
aaaggaaggcacagggttttcactcattaaattgataattttacatcgataaccaggtaaaggtatccgagaaacatgttaaggacagagnttacacgttcaatctgtattacctgttgcaacaaagttcgcgccggcgcgcaacactaccacgtgactcggcactactaaatctactctggatgtttttcatctgttttcgactcttttgggcccatcgtcaagataaccgggccagaaaatttacactcacggaggctccttctgatgcagacatgcagtttaaggtttgcaagtggtgcaagatattcagnnccaggtcttt

SEQ ID NO: 23213 - DNA, 608 bp, Zea mays
  Clone ID: cC-zmle189046a02d1
cccacgcgtccgcacaatttcttcatatgtgaggaatgccgcacacacttctatgaaatgtgttcaagtgtatcagtccccttcaaatctgcccgtgaccttgccctctggctatggaccgcgcataacaaagttaacgagaggttgatgaaagaagaaaaggagttagacaatgctgatccttcatttcctaagatcatctggcctccaaagcaactctgtccattgtgctaccgttcttctagtaggacggctgatggagccatgcaggttgagtggaatgaagatgaagtattcaatttcttggttaactactacgggaagatgcttgtatcatcctacagggagacctccatgcagtcctttcaagtaggctcaatttctgacgattctttcgcatccagtgccgcaacagtacctattggagctgccctgggtatcgcccttgctagctgtacatttggggcgctagcatgcttttggaggacccaactaagaacagaaagcaagaaagaactggtactgtatatctgcaccacttgcaaacccttaactgtatgtttgcatcagaaggagcctccggagtgtaaatttttggaccgttattt

SEQ ID NO: 23214 - DNA, 373 bp, Zea mays
  unsure at all n locations
  Clone ID: cC-zmle189046a03a1
tttttaattcagggaacccaaccatcaaatgtgatgtggacaaaccaaaaccatacatcgattggttttatcaccatccatgagacggaattgcgaggtgccgaggacgttgtacagccaccccttgactagaactgctcggaaaccaagagaactttgccatgcattacctggtgaatgtaggtgatccggctattattttcataaatagatgatcctagtccaatgccctgaatctcaatgttggctgagacaaaagagctgacatgctaatacatagctgcgnagntcaacttgactaacaaaaagggatgcggaaactctatctgtagatgccctgttagcttgtcctcttcaaagcaaacaagcttcg

SEQ ID NO: 23215 - DNA, 340 bp, Zea mays
  Clone ID: cC-zmle189046a03d1
tttgggtttaccacgcgttcgcaccttccataccactcttctctgcctcacactcctttcatgctccaattcacgcgcaggaatggaacttggtgcgaccagtgccctttaccctctgcaccgctgcaaaaccatttacctggtcaggcatgcccagagcatacacaatgtcgtgggggataaggacttcggcgcgtacatgatacatgatactgttcgatgctcagctcactcctttgggttggaaccaagtctatggtctgcttgagcatgttaaaaaaagtgggcttgcataaaagattgaattatatttttcttcccctttctgtggactattgca

SEQ ID NO: 23216 - DNA, 477 bp, Zea mays
  Clone ID: cC-zmle189046a04a1
aatattatattgtgtttcttttcccccaaaaaaggggggcgaaaaccgcgggttggggacaaaaattacacacattcccattaactcaccgcccgaggggggctccaggcccccggccaggggagcggggggccccccaaaacaagggggggaaaaccgcgggggcgggcgcttttttttagggggaacccaaaccccctcaaaagggggggggggcccccccaccccccgggggggggacaaaggccccggaggggggccccgccccccccttgaaaaagcaaaaaaccccccgggggaaaaaaagggggggggccttggctggggcatgtcccttgcatggagaaaagaaacccccccccgagaaaaaaaaaaaattttggcagaaccccgggggggagaggcctactcccaaaactttcttggcccggggggtcccccggaattcccgccccggcccggggggggccccccttc

SEQ ID NO: 23217 - DNA, 464 bp, Zea mays
  Clone ID: cC-zmle189046a04d1
agcagctccggaagcacggcctcaccgccgccggctccgtcaagttgtcgtcgtcgtcgccggcggcgtcgccgtcgtccaaggacaaggacaagcccaagaacaagttcctcgccttcgtcacgcccaagaaggatcatgaagcttactgaagtgggttgcagtgatcccattcctggaccatgtcccggcaacctgtagctgtagtgcactccactagatttctgttgtgtttgttctcgacttgaaatagagcctgtacgatgtgtgtatggccattctgtatgtgtgagcatcaactctaacatggaatggagacaagagccaactttcggtgctgatgatgatgtgaatgtgtgaaatttatgtcattatacagtgttttagacagacatttgttggaaaaaataaataattaattataaattttttaatttttaattatttttatttttttatatatt

SEQ ID NO: 23218 - DNA, 134 bp, Zea mays
  Clone ID: cC-zmle189046a07a1
cttattaccaaattttacatgttacatcaagttttataatgtacataatcagagtgattacaaaaaagtgattcaaaggaataactttgaactgttataaattgtttataagttcgaaacatatgctagcttaa

SEQ ID NO: 23219 - DNA, 473 bp, Zea mays
  Clone ID: cC-zmle189046a08a1
atcacaaaagcgaatgaatatgacgataccaatcacgtacaacatatataggcagtcaggccataaaataatatttagccaaccttgttactagctttacctactaccgactccgactccccaggggatttcggtctttgattgagggttcactactagcagtgtacacgacacaaataaaataataacggtactcgttccatgcgggaaatggtctcccagtttttcgtcaacatactccccacctttcctagccattagaatcctacctcctcaggccctcaacgatgtagtgtagcatacaggtccatagagggctgtatggcttcataagcggcgctcgctggtagaaagttattaacagaaacctccttgttctcattcttcttggagccctcgaagaagcgcctgatttcagccaagcggtgaggtgggagctccttgatatcatctgaatgcctgtactcgggatc

SEQ ID NO: 23220 - DNA, 621 bp, Zea mays
  Clone ID: cC-zmle189046a08d1
cccacgcgtccgtaaccatattcaactgcgtcattgagataccaaggggcagcaaggttaaatatgaacttgacagagaaaactggactgatcaaggtggaccgtgtgctgtattcatcagttgtttaccctcacaactatggattcattcctcgcacgctttgtgaagacagcgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatattaaggagctcccaccttaccgcttggctgaaatcaggcgcttctttgaggactacaagaagaatgagaacaaggaggttgctgtgaatgactttttaccagcgagcgccgtttatgaagccctacagcactctatggacctgtttgctacatacatcgttgagggccctgagaggtaggattttgatggctaggaaaggtggggaggaagtttgacgaaaaactgggagaccatttaccgcatggaacgagacccgtatttatttatttgggtcgtgtttact

SEQ ID NO: 23221 - DNA, 497 bp, Zea mays
  Clone ID: cC-zmle189046a10a1
tttttacggttcaaatggtataaactattataaaacattgagttacatatcttttatcagagtcacacaaaaaatcccttggtaactcaaaacaagagactgtttggactgttcgcttcggattaaaatcagctatttagactgttgtagctgtaatccatagagacaaaaacaatttagaagtagcagaagccagtacggattgaaaccaaacgaacaggctgaccgatgtagcatgtcactcaaagggcgtccttgactccgatgtttagaagtctacccagtttttcactttcgcaggagtcaacagtatcggcagaaccacccaggtgctttccatggacaaaatcttgagggacagtacgcctgccaactatttcaagtatggcatcctgaatctctgagccatcctctcgctgatcaagctccacaacatatgggttctttttttaacttaagctccttaaacacgggctttgctcttttgcagaccgggc

SEQ ID NO: 23222 - DNA, 313 bp, Zea mays
  Clone ID: cC-zmle189046a10d1
ttttggttttactacaaaacaaccttatctgtgaaaagggtgaattttttcgtttttaaaacaattctatccttttatcaaacacccaccttttaaattatgtacatacccaggctcaaaatacttatcactttggaagttggaacacaaaacgaacaactctcaacattccgtctaggtcgtccattaattcacacgccaactctgtgtccaatctcctaaaacaaattcccaaagcctggaacgccgacagcggaaaccgctataccatggggaacatgttcctccccaccttggcgaactgcaggatcac

SEQ ID NO: 23223 - DNA, 430 bp, Zea mays
  Clone ID: cC-zmle189046a11a1
tttttggacgcaacgagttgcttttgatgcaagacatgccagattattatgtacacggattcttgagacgcctattttttttttaagtatttacaggaggaggggcattgtcctacgtcgatccacggcggcgcggcgccactcatagcagcccaaaggtgttctcgccgctgtaggtcatgtagaggaacccgtcctcgtccttgttctcctcgtagatggcagacatcatggcagctgcatggacaagaaaaagtaacagcattgtacacacgggcaccatggacaggtaggttttattttgtttttccccacgatggtatggcaaacctgttggtgggagggtgttctttacgaagatgaaaaatcgccttctcggcgctgagcttgatgcgctttcgtaccacgtacacaaactgtcccactgtga

SEQ ID NO: 23224 - DNA, 543 bp, Zea mays
  Clone ID: cC-zmle189046a11d1
tagtgctttcttccagcgttccagccttccattcatttgtgctttatctgctctgtattactccagcgggcgggggaccattatgagcaggagcgatggctaggagctcggtcaagctggagcaccccttcgaaaggaggcaagctgaggctaaccgcatcagggagaagtaccccgatagaattcctgtcattgttgagaaggccgagaggagtgacatcccagacatcgacaagaaaaagtaccttgtccccgccgacctcacattgggacagtttgtgtacgtggtgcctaatctcatcaagctcagtgtcgagaaggcgatcttcatcttcgtgaagaacacccttccaccaacaggtttgccataccatcgtggggaaaaacaaaataaaacctacctgtccatggtgcccgtgtgtacaatgctgatactttttcttgtgcatgcagctgccctgatgtctgccatctacgaggagaacaatgacgaggaacggttcctctaccatgacctacagcggcgagaacacctttgggctg

SEQ ID NO: 23225 - DNA, 537 bp, Zea mays
  Clone ID: cC-zmle189046a12a1
ttttctgagctatcctgtgcattctgacaaaggctacatgactcttaccccaacgcttaagctcggagcttttctcggagcatctccttgcaagcatctccgtccttggcgaatcctcggataccctcgtggagcttgtcgaaagccatggggtcgttgaacaactcccatcggaaggcagcctcgttgtcgacgaatgagaccttctcctccttggcttggtcggcgggggcagcgtctagcttctttggcaccttggcgtcggagttcttgagctcctccaggagtttgggggcaatggtgaggtagtcgcatccggcgagctcggtgatctcaccagtgtttcggaaagaggcacccatgacaatggtgttgtagccgtgttgcttgtagtagttgaagattcgctggacagacttgactcctgggtcggtctcggcagtgtactcctttccagtgctcttcttgtaccagtcgagaattcttccgacgaatggtgaaatgagagtgacaccagtctcggcacaagcgacgggt

SEQ ID NO: 23226 - DNA, 450 bp, Zea mays
  Clone ID: cC-zmle189046a12d1
gacttattttctagagacgcccgccttattttctactttatttttccaacagtatgtctaccgctattgatgcctggaaagcttccgtaaccctaagtcgtcttctactttttagactttgtgtccaacggggcctatgactctcaagatgctaccaccaacccttgtgtgatcctcactgcctataaactgccaacttctggacagctcattggctcctccattaatgttgaaaagggaaagtccgccctcctggaggagcaggccgacaacaccatgcacgctctgcttttcatgttcagaaaggacaatcctcaagaaggtttccggtttactacccatcgaagtctatgcaccgattctccttctacgttgatgcacccaaggctgaagatacacagcacatcggtctgtacaacgatgctgatatttcaccaaaccgatttttga

SEQ ID NO: 23227 - DNA, 381 bp, Zea mays
  Clone ID: cC-zmle189046b01a1
accagcaaacacttgagttttaccactctttacttttccctacatgcagttcacctgaacctcctgcttggcgtccctgacgaacctcctccagtaccagtgccccgcccagacggcgcgcatggcctccagcggcacgcctttggtctccggcaggaacgcggcgatgaaagcagtcatgacgaggacccatccggcgtagaacaggaagatggcgtgcttcatggcgcagagcagggagacgaacacctgcgtctgcgcgaatgagaggcagagcgcgatggacaccgtcagcgcctgcgccgccgacctgatctccacggggtagatctcgctcggcaccacccacttgagcggcccccacgacacgccgaagctgaa

SEQ ID NO: 23228 - DNA, 565 bp, Zea mays
  Clone ID: cC-zmle189046b01d1
cccacgcgtccgggcgtctcaggtggcgtgacacaaatggagtcgttcctggcgaagttcttcccggaagtgtcgagcgggacaaaggacgcgaagcacgacgcatactgcaaatacgacgaccagcggctcacggcgttcacctcgtcgctgtacatcgccgcgatgctgtcgtcgctggtggcgagccgcgtgacgaggacggtgggccggcaggccgtgatgctgatgggcggcgtcctgttcctcctaggctccgcgatcaacgccggcgccgtcaacgtcgccatgctcatcctcggacggatgctgctcggcttcggggtcgggttcaccacgcaggccgcccctctgtacctcgcggagacatcgccggcgcggtggcgcggggcgttcaccgcggcgtacagcatcttccaggtgctgggcgcgctggccgccaccgtcactaactacctgaccaaccgcgtcccggggtggggctggcgcgtgtcgctcgggctcgccgccgtcccggccggcatcgtcgtactcggcgccctgctcgttccgacaccctcagcag

SEQ ID NO: 23229 - DNA, 292 bp, Zea mays
  Clone ID: cC-zmle189046b02a1
aaacaagcccatccaatgggctgggattttaattaatttttacaaaacagcatgcagattgtacgatgtttattattacaatatgtataatatgccaagattttccacttggacttgacaacaagagtgaatttaaagaggcaggaaattacatttgcatagggaaaacagacgctgccagttcggcatttccatccaaaactgacaaaacgccaccatccggaagctgattattgcggggcactctgcaagagagtgaagagaatccgcctagccagcccacgcgtccgaa

SEQ ID NO: 23230 - DNA, 312 bp, Zea mays
  Clone ID: cC-zmle189046b02d1
cggacgcgtgggctggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataaacatcgtacaatctgcatgctgttttgtaataattaattaatatcccagcccattggatggacttgtttaaaaaaaaaaaaatataaaaat

SEQ ID NO: 23231 - DNA, 306 bp, Zea mays
  unsure at all n locations
  Clone ID: cC-zmle189046b03a1
ttttagctgcgaacaaaaaccttgctcattcttctctcgtctcgtttcatagcgggagcaaacaaagggaacaacaggggtaccaacacctaatccaaaggtagaacggacactaacacggngacagaagcgaacggtaacacgatactatagatagataagataactcggacgaagccaggatgggcccacacatcagtccctccagccgccgccgccgccgccgtagccgccaccaccaccctcgcgccgaccgncgtagccgccaccgcctccgtagccgccgccaccaccctcgcgccgacc

SEQ ID NO: 23232 - DNA, 456 bp, Zea mays
  Clone ID: cC-zmle189046b03d1
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacagcggcggtcgcggcggcggcggctatggtggcgggcgccgtgacggcggttatggcggcggtggcggctaccgcggtcggcgcgagggtggtggctgc

SEQ ID NO: 23233 - DNA, 366 bp, Zea mays
  Clone ID: cC-zmle189046b06a1
attaaaatctacagtatctcattattggcatgcaaaatggtaattacagacaggggattctgaaacctggacacaaacttcttcctttgttttttttctgggagggggttgttcttaaaagggttgaaacctgaccacacactgacgataaaggtgaaaccctggaacaaaataatacaggatgggcacaggacaaacactaacgttttattggtactgggtactacacaagctggaggactggagcgccttcaacttttcatgcccatttgctgggcgacatgcctgccctgcaggaggagcaagcttgcaatgaaactttaatcctccattcttatgatgcaacgcaggcttttccccttgagc

SEQ ID NO: 23234 - DNA, 564 bp, Zea mays
  Clone ID: cC-zmle189046b06d1
cggacgcgtgggggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcggtgccttctcggagataacacggcgttcgacctgatgc

SEQ ID NO: 23235 - DNA, 488 bp, Zea mays
  Clone ID: cC-zmle189046b07a1
ccgaaaaaccttttattgttgcaaagaaattgctcactccatactttacaattctaggtatcatatatatgctccttgtaataattgaagagctcaaatgaaacaatccatttacagatacataatcaccccaacaataacaaacatgacaactagcacaggaagagttacaagatagggatctcatcacaggagcagcataggaagttgtctagaactcttcgagatcctgtccttattttctcaaagtatgcagcaagaacatttttgttgcaccttattcttttcactacgagtagtaaacggttgcctagcagaagaggtaggtgacaacctatcatccctcaccctgttgaagataccagggtacttttcacctgatgctgcatttgcatcatcccattcgccaaagggtggtacagccactttttcaggctcatagccacccggtttatccctgttcttccaggtgtatgctggcccaaccc

SEQ ID NO: 23236 - DNA, 561 bp, Zea mays
  Clone ID: cC-zmle189046b07d1
cggacgcgtgggcggacgcgtgggcggacgcgtgggcggacgcgtgggcggacgcgtgggcggacgcgtgggcggacgcgtgggcttttgaagccgcaaggtcagaagagaggatccacctctcagttcgattttcggtggctgaagtccttctacctcggggggtttgagcgttttccttgataaatttgtgtttcttcgagagtttattttttgtgttttctcttgagagattcgtgcgaaggacgtcgtcttcggtccattttcttgggtagtcgaattgctcttatacagcgtcaaagcatccaactttgacttcttcgtggtggcttcttctactactctgtgttgtcgaggagacaatttaatctttatttaattgggttggatgcttgttcaagttgcagttgaaagggtagcagaagacaccattaatcctggtgatttggtgcttatctgctgaaaattgagggtcaaagtaaccatttgcagttcttacttctcgttttcttgggaagatttggtgaattctgtgcaggaagagcttacttaaatctccct

SEQ ID NO: 23237 - DNA, 394 bp, Zea mays
  Clone ID: cC-zmle189046b10a1
tcgacctttttttattttttttttttttgctacattccgatcatgttttgaaacgaggcacagattaaagattcgtaaattaatttgccttaatgttgtttatatatatatgctttgatggatattactaacctacccctcttactcttttgaaccactaacagcagtaacaggtgatacggaattacagtatggaaccgagttacagacctttttatgccaaaaacgtgcccgacttttcatgccagggctgtgctgcgctgtgacggagggatcgctgtccgaccttacaccgatcagtccttgcccagggtgtaccggacaaaacctcggaccttaatgttcttcctgagtgaggcgaccgttttcttcacgagatccttaaccgacttgc

SEQ ID NO: 23238 - DNA, 373 bp, Zea mays
  Clone ID: cC-zmle189046b10d1
agtttctgatgtttaccgacctatcatacgcagacaagaaagggtttttctaatcgactactgccggacaaacaatagacccacaagggcctgattacgcccattatacaggcacaaacctataatggtcagccagcaccatcagacatgctgactgaattatggagaaatcacgcgccgcatcggctgaggtcacccaatgtttcagttaaccggcagaggcgctaatgccttagcgctgtgcgtcacggaatacatgacatggcatcatgccctagtggtctgcttggcgggcttgcccataccccgttcttgagaggaagaagaactggccgacgatcatgaagttcaccagaagctgcaccgtggacct

SEQ ID NO: 23239 - DNA, 109 bp, Zea mays
  Clone ID: cC-zmle189046b11a1
accgctcaactaccttttggactgcacgcccttctgtaaccagctcacggcttcccccatccgtgactacacctgcccggtcattaggataatcgcagaacccatgcct

SEQ ID NO: 23240 - DNA, 118 bp, Zea mays
  Clone ID: cC-zmle189046b11d1
cacgcgtacggccggatgcattacttctctagagcgtccgcccctccgaattttaagaggctctaccaatcccgatggcctcctcgaaagggtgagagtatttgggccataccctccg

SEQ ID NO: 23241 - DNA, 64 bp, Zea mays
  Clone ID: cC-zmle189046b12d1
gggacattcacgcgtacgcccacgcgttcgaaaacaaaaaaacaaacaaaaacaaaatacttta

SEQ ID NO: 23242 - DNA, 419 bp, Zea mays
  Clone ID: cC-zmle189046c01a1
agccagccctttttttttttttttttttttttttttttttttttttttactggattctattttttcttttttttttttttccccccgaccgccaatccgcccaatagggatccgaagaccaaaccgaggaagcgccccagacccaaacccaaaacaccgaaaaggcaccagaccgaagaccaaaggcccccacaaagaagaacacaaactctacgcggaaggacaagcacaaaggcgaccggggggacaatgggaagcacacaaaaagccccaccaccagcagccccgaaaggcaaaaagaaaaacccggaggaccggaaaactgaactaaaacccccgaaacagggaaggccacacaacagcaaccataaacacaaacgccatgaggcgacattgcaaaaccaaccagccacgcccaa

SEQ ID NO: 23243 - DNA, 375 bp, Zea mays
  Clone ID: cC-zmle189046c01d1
ggtctgcccacgcgtccgcccacgcgtccgcccacgcgtccgcccacgcgtccgcggacgcgtgggaaaaaaaaaaaaaaaaataaaaaatgaggaaagtgaaaaaaaaaataaaaaataataaaataataaaaaaaggtcggacgtttttcggggatcctttttatctttcgcctccccttcgatgcctagttttttcttttttgctccttcattttgtttccttgcccttcttttttctcttttcttgttggttttcaccctgtctgcttccccccttttttttcttgtctcttatccccctcccccttgtttggttttcttccatcaaggctctgtcctttcgcctttcccatctttttttttttctaaatg

SEQ ID NO: 23244 - DNA, 274 bp, Zea mays
  unsure at all n locations
  Clone ID: cC-zmle189046c02a1
agggattagtattacgaagaagttttattcaggtcacgagcttattgtcgtaattcgtacaggagctgagtgcgtgcacgtacgatagccaagtacgatgaccctgcacaaccagtcaaccacagacattcattaggcacgcaggcaagcacgaacgggcgtggatgccggccgccgggcggctcagtttgccctggcgaggaagctctccctgcgctcgaggacctcgccggagcaggagtagatgtcctcttcgaccctggnctcgcgcacc

SEQ ID NO: 23245 - DNA, 543 bp, Zea mays
  Clone ID: cC-zmle189046c02d1
ccacgcgttcgcccacgcgttcgcacagcaatccacacaagcacttcgacgtcacacgggcgctgcgcacagacacactaagcgttggcaccaatggcttactaccaggaggtggactactgctcggaggaggtgaggtcggtggcccctgccggcttttgccgccacggcggtggcgtccagcagcacgtcttcaaggagaagttcgaggaggtcgacacggtcttacgcgccggcgccaaccaccaccaccaccatggtcaccacggcggccacggtttcgtggtgcgcgagaccatggtcgaagaggacatcaacacctgcaccggtgaggtccacgagcgcagggagagctttctcgccagggctaactgatccgcccggtggccggcattcacgcccgttcgagcttgcctgcgtgccttatgtatgtcatggggttgactggttgggcagggtcatcgcacttggctattcgtacctgcacgcactcagtttctgttccaatcacgccatttagcttgtggcctgattaaaactttt

SEQ ID NO: 23246 - DNA, 295 bp, Zea mays
  unsure at all n locations
  Clone ID: cC-zmle189046c03a1
ccagcagacatgaattgcattcaaatcattcagcaccttgacgctacaacgccaaaaacgactgctacaagggtaatgaaatcgnatgacgccgagtgactccctccttctattactttcaattaacttatgttggaatctcccgcatgtcgcctctacgccgttccgcctgactttccccatttgacattctctactgactcccccgactgctgaatttgcgcattctcaagccaagcacgcgcttagctggtagtgaacaacatcctgaacacacgcttccacaaaggcgcct

SEQ ID NO: 23247 - DNA, 545 bp, Zea mays
  Clone ID: cC-zmle189046c03d1
ttcccgggtcttcccacgcgtccggtacatcgtctgtactgcttgctacacatacatacgatatctaataccgtataatctcgtgtcaagtcatacgagcacaaatcatggataaagagaagaaagaggatacttatggcgggtcgacgggcgtctatcccgctcatggagctcatggatatgctggggatcgtggatctaccatagtcgggtcagaccacgaacggggtgcatacgggggaaacgagaaggaagatttctatgatccaagtttggagagcagggcgactaggctgggtttgaattgggagtcgttcaagcgggctccgggtgctacgaggggtcttgtagtacacggtggtgccgcacctgaactggtcggtcaccagaatccgctcttgcagcaaaaaatgaaaccgaggcatctggctatgatcgctgtaggtggttctatcggtactggtctattcgtcgcttctggtggtgcactccgaacgggtggtcccgccggtgttatcatcgctcggtgcattatcggtgtcatg

SEQ ID NO: 23248 - DNA, 407 bp, Zea mays
  Clone ID: cC-zmle189046c05d1
cccacgcgtccgatttgttttgcaggtcgtaaatccgtcttcagaccctaaggtgaagaaataccacgatgcgaaatatcagatattcagatccctgtatgagcaacaactctctcatcgcgcaaccatggcacaggcattgcagtagggctctatggccactttggctcttcactcttggttattgatacccttggtttcatcgccatgttttattggcttatttacatgtaatcaatatcgccttgagtgatttgatagaatagaaaccatgataagatgcatgtatacacaaaagaaaactggtaagatgatctttctcacagggacgtgaaatccccaaagcctgtgcaatgttaataaaagaaaaggaggttcattttctaaaataattgattcatctttaa

SEQ ID NO: 23249 - DNA, 347 bp, Zea mays
  Clone ID: cC-zmle189046c06a1
actgacaatgaatgcgataatttggggattcatccacagaaatttatgtaaaacattgctcacttgtaatagtggaacgaacacaagggaactagtctgtcatggcttgcacgtttgttaacacacacactaaaaaaaagaatttgcaattaatcacgccagcctgacccaaacttatctggaaatacccaaagcctggctgtaataagctgggcaagggtggagttactactacttgctagaaaagaactccgtagtagagacagtactatatatcacaggattaattggtctatgaccaaaggctcattgaaccgttgcgcccgaaaaaacaattttgggcctgg

SEQ ID NO: 23250 - DNA, 464 bp, Zea mays
  Clone ID: cC-zmle189046c06d1
gatgtgacggacgcgctgtgtctcgcccattcctacgacgacctacctgacgacgggtttccgttttgctgagtgcgcagccgcaccacatgcatcttctcgcgaaacatacgtacggtacatgtgccaggcccgagatagttcatgtcgggcgcgacgggtcactgagcctttggtcatagaacaattaatactgtgatatatagtactgtctctactacggagtacttatctagcagtagtagtaactacacacttgcccagcttattacagccaggctttgcgtatctccagataagtttaggtcaggctggcgtgattaatttgcaagttctttttttttgtgtgtgtgttaatcagcgtgcatgccatgtactactagttcccttgttttcgttccactattacaagtgtgcaatgttttacatatattactgtggataaaaaacaaaaaaaacgcata

SEQ ID NO: 23251 - DNA, 479 bp, Zea mays
  Clone ID: cC-zmle189046c07a1
aagtaatacggacccaatatagttaaatctgggcagggctatacatgtagattaatttgaagtttaatcaaacccgtaattcataaaactatactactatgtagcaacagctgggtgtgaaatttaactttacattctgagagagtactatgtagcaacgctttgttcgttcgtctgcccactcgttgtcgctggccttgtttgcgatatcctccccttacattgttctcagatcctaaatgggatgagcggcgtggagtttgacaggtacgccgtcgcggctgacacgccgctacctagtttcactgggtaccccacatgcttgagcaccatcttcacaccgctcagacatcccagaagttgcagctcgttgaggttgccgagatggccgatcctgaagaccttcccggcgatcttgttgaggccgaggccgaagcttaggttgtaccgcttccacgcgtgcctgacgacctcggcgc

SEQ ID NO: 23252 - DNA, 573 bp, Zea mays
  Clone ID: cC-zmle189046c07d1
ggaaggactacctcaggttctacgacatgggcacgtactggccctacacgccctccatccagctcctctacgggctccgcaccgcgctcgacctcatcttcgaggaagggctggacaacgtcgtgaggaggcacaaccgccttgggacagccaccaggctcgccgtcgaggcgtgggggctcagcaactgctgccagaaggaggagtggttcagcgacaccgtcaccgccgtcgtcgtgccgcccaacatcgacagcgccgaggtcgtcaggcacgcgtggaagcggtacaacctcagcctcggcctcggcctcaacaagatcgccgggaaggtcttcaggatcggacatctcggcaacctcaacgagctgcaacttctgggatgtctgagcggagtggagatggtgctcaaggatgtggggtacccagtgaaactaggtagcggcgtggcagccgcggcggcgtacctgtcaaactccacgccgcttatcccatctaggatctgaaaacaatgtatggggaggatatcgcaaacaaggcccgcgacaactagtgggcagacgaacgaacaaa

SEQ ID NO: 23253 - DNA, 113 bp, Zea mays
  Clone ID: cC-zmle189046c08a1
atgcccgcgtacgtgagctctgtatcctcgtatcgccgtcgccctttttttttttttttagccaccccaagcagcaccaccatttccttgcggtttatgtctgaacaaaccct

SEQ ID NO: 23254 - DNA, 598 bp, Zea mays
  Clone ID: cC-zmle189046c08d1
gttttaatctggatctgggcgagaaacaatcaggagataaggttggtgatgttgtaataccaccttgggctaaaggcagcgccagagagttcatctggaaacatcgggaagcactggaatctgattatgtatctgagaatctgcatcattggattgatcttatttttggatataagcagagaggaaaggcacctgaagatgccgtcaatggcttctatcactacacatatgaaggcaatgttgacatatacgcagtatctgatcctaccatgaaggctgtaatactagcacaaatcaaccattttggtcagacccccaaacagttattccagaaaccacatccacagaggcggactgacaggaaagtccctcctcatcctctacggtactgtgcctatctaacacagcatgagattcgcaagacatcatcttctgtgttccagattgtcttctacagagataagatctctaattgctgcagataactgattgttcaagccgctaacttataatgaaaacactgtctggggatcacctggccgaagcttgtactattaacttatggacatgatagacttttgtttactcatgaaaacct

SEQ ID NO: 23255 - DNA, 356 bp, Zea mays
  Clone ID: cC-zmle189046c10a1
acttttgtttttttttttctattgcttattaccaaagttgtacagttccatctggatcatataacagtacatgagtgcttgacagacttgtcaatcttgacagggctcgcacgcttgcgcatctgctccatgatggtgacgatcgcggtgatcttcatgggcagattggaggacatgttcccatacaagggctgaatccccgagtgcctgtgccttcgagaccctctccactgttggccggtcaaccggactgagccttcaccaggcaggaaggggagtccaccacgcggacagagaccacaaccttgtccaccttgtcgcccagcacctgcttgatcaccctgagcagggcctcg

SEQ ID NO: 23256 - DNA, 444 bp, Zea mays
  Clone ID: cC-zmle189046c10d1
gggagatgattccagagcgtcgtaacttgatccgacagccaggagagctcatttgccaacgcattatagtatgatttttggtagcgttggatacgaaggatgcactgcggggtgcacaagattgacccctgttacctcttgcgcacccgtaagcttcctgagcatcatctagcgctatgtgcgctctgtatttatcagggacaactcagaagagctgatcccatcgtgactgacctctgtcaagggcatagacgactgtgaggacgctacccttaacattttccgtgagaccgttcatccgaacaggatactcacggctattcgaaataaccaggcgaaaaagtgcatttgagctcgccctttgagattgctgacaacaatggggactacaacaagttctatgaggccttcccgaagaacctgatgcttggtattcacgaggat

SEQ ID NO: 23257 - DNA, 373 bp, Zea mays
  Clone ID: cC-zmle189046c11a1
ttttagcaagtacaaaattatccagcagcatatgccgatgataagggaaacctcatccaggcttctaaaagaacaagcatgaaaaattgatccaacccgtatggaaacaccactctcttctgtccgtggaaaactaacacctggaaagatcccatgcctgaggcaccttaacatgggggcgtgttaacaacatttgcaaagcattcttggcacttgatcagctttacttggctggggccgaatggggaggctagcttgctcttgtcaatccaacccaaggacaaatgcccgcgcctagttgacgcgtgggcctgaacatgggcggacccctgggcggatccttgtgcggacgcgtgggcagacccttgtgacc

SEQ ID NO: 23258 - DNA, 564 bp, Zea mays
  Clone ID: cC-zmle189046c11d1
atcttttcaggttatgctgctccatatgccgaccttataaaggggacaatactggctcccgacccggtaatgttcacagcagtcataatgcagacgggcttcaaaattgaacgaaacagaataaaattagagtgacccaggactttggatctgcagtaacgcagggacaggactaacaacaaactcttttttttcttttgcactcaacttcacctcacgtggggagggtgatcgctttacaccggccacgctgggtcttaaagggtttgacctgcctggatctggccccatcccatgaggcgccaatgcttcttaacgcgacgggtcatagcaaccttctgttctcgggtcgtgcagactggcgcggcgagctgttccttggcaggaatccttcttaacagtaaccacaccgacgcctgtggacatggaccctatgttaagcatgaggatctcacccttggtgagcttcgaaaccttccctgccttctttgaaccttttggcctcacacccaacagccttccggataggaataaaattgttctcaatctctacgtaaacatcag

SEQ ID NO: 23259 - DNA, 364 bp, Zea mays
  Clone ID: cC-zmle189046c12a1
tcgacctatatttatatatttttatattttatttattattttattatatttaaatgggtatttatatgaaaaagagaagaaatataaatggggcttaaaaaaaatataatagttaaagtaagaaaggagacagaaattaaaaggtatacataagaacacgaaaaggggggaaaaaaataaaaatgattttatttattatagaaaaaaattatacatagttgcagaagaaaacgaatatagaataggaatatgcttttatggaagtgtacaaaagcacaaaaataattgttgctaaatataaaaattttatttatataaaggaagtatatttcaaagagtctgaaagggattttatattgggaaa

SEQ ID NO: 23260 - DNA, 422 bp, Zea mays
  Clone ID: cC-zmle189046d01a1
tttttgatctctgaacaaaagtccacgttcattcatatagtcgttacggcttgctatcctgattctctacaagcccacgaaccacaaaagtaatcatgtactcaagcattcactcaacttttgagaagttgaagctttacttcatgaacttgctggccatgttgagaagaccaccaacgccaccggaagagccaccagaggcaccaccaccgctgccacccttcatgtacatctggagagccatctttgctgcagaggcgacaacgtcctgcttgttagagccgctgggagcattgccgtaggcgttctgctggtcaaacagcttagcagcctcacccatggcaatgccaatgagctggttctggccagactttccactggcagagttgccctggttgaacatcttcatggcctgcatcgcg

SEQ ID NO: 23261 - DNA, 466 bp, Zea mays
  Clone ID: cC-zmle189046d01d1
gcaacaactcgaaccagtccggtggcagcggcaacatgggtgcagctgccgcgatgcaggccatgaagatgttcaaccagggcaactctggcagtggaaagtctggccagaaccagctcattggcattgccatgggtgaggctgctaagctgtttgaccagcagaacgccaacggcaatgctcccagcggctctaacaagcaggacgttgtcgcctctgcagcaaagatggcactccagatgtacatgaagggtggcagcggtggtggtgcctctggtggctcttccggtggcgttggtggtcttctcaacatggccagcaagttcatgaagtaaagcttcaacatctcaaaagttgagtgaatgcttgagtacatgattacttttgtggttcgtgggcttgtagagaatcaggatagcaagccgtaacgactatatgaatgaacgtggacatttgttcagagatc

SEQ ID NO: 23262 - DNA, 252 bp, Zea mays
  unsure at all n locations
  Clone ID: cC-zmle189046d02a1
aatgccatcttactagtttaattggtattaactcaaagnctcaaacgtgcctcttgttgcattgacacacatgtacaatacaatcgtacatatagnacgttttattcgacaagcagcctctgcatgcaataatagtacaacccccgatttaattaattggactaatgcatgctgaggatggatcagatggagatgctgctggggatgccccctcccanagactcccggcttggagaaaggcttgagcagctc

SEQ ID NO: 23263 - DNA, 530 bp, Zea mays
  Clone ID: cC-zmle189046d02d1
ggagaagttcctcaagcagccggagacgacgctgctggacatgctgcccacgcagatgcaggccatcaaggtcatgacgacgctggacatcctctcgtcgcactcgcccgacgaggagtacatgggggagttcgcggagccatcgtggctggcggagcccatggtgaaggcggcgttcgagaagttcggcggcaggatgaaggagatcgaggggttcatcgacgagtgcaacaacaacctggacctcaagaaccgctgcggcgccgggatcgtgccgtacgagctgctcaagcccttctccaagccgggagtcaccgggaggggcatccccagcagcatctccatctgatccatcctcagcatgcattagtccaattaattaaatcgggggttgtactattattgcatgcagaggctgcttgtcgaataaaacgtactatatgtacgattgtattgaacatgtgtgtcaatgcaacaagaggcacgtttgagactttgagtttataccattaaactagttagatggcatt

SEQ ID NO: 23264 - DNA, 206 bp, Zea mays
  Clone ID: cC-zmle189046d03a1
ggaaaaggggccgcaaaaatcccctttttccgggggaaagaagcctaaaacctttcccaatctttggcccaaaaaagcggggatcccctttgatgagggcaaaccaaacatggttcttcgggatcaaaaaagcctgcccccggcgattctggaggcattccacccaaacccccgggaccccgggggcgacccgggaattccggacc

SEQ ID NO: 23265 - DNA, 173 bp, Zea mays
  Clone ID: cC-zmle189046d03d1
cggggtttgggtggaatgcctacagaatcgactgtgtcaagctttcttgattccgtagaaacatgttttgtttgacctcatcatagaggatctccgcttttatcgtacaaagattgtgatatgttcttagcttctttctacctgaataagaggatttctgcagacccttttcc

SEQ ID NO: 23266 - DNA, 335 bp, Zea mays
  Clone ID: cC-zmle189046d04a1
gcaatgcaaaccatgatttgcaaatataatttgcatgttcacaaatccacatgaatatgtacactttttgttggattacattagcaggatttacatccactgcagaattactactccttcgctgcccacctcggatcgaagcaaaaaaaaaaaaaacacgagcaaaccaccccctgcgcgcatgcttgacgagcacgagcacgacgcgttcaaacaaacccttcgccatccagtccctggggaacgatgcaggccacccggccggtgcatccgcacattacacgccgccgatgcaagaaaagatcctgacgctgcgggccctgagcggcgcgccc

SEQ ID NO: 23267 - DNA, 300 bp, Zea mays
  Clone ID: cC-zmle189046d04d1
aaatggaggggctcatcccgttcatctacaaggccatcaaggagcggcgggcccggagctactactactcgcggtgcaactccagcggctcgtcgcgcggccggctcggggcccgcgtggaggacagctcgcgggacctgcagcagaagcagtgggagtccgccgccggtgccaaggcgccggcgggggcggcggcggagcgggagatggcgcaggcgcaccgccgccaccgctccctcgacgagctggcgggggaggtgggcgcctcgcccgggtggcgccttctctttccgggcgcgc

SEQ ID NO: 23268 - DNA, 366 bp, Zea mays
  Clone ID: cC-zmle189046d06a1
atatcgagataaatctcaatcaatatattgattatttctaggaaacacatgtcggtatgagggcaccattgtcgagtacatctcatatgtaatctaaaagatggcacctccaacgatgggttgctgcaaggcagggttcatcaaagagaactggttgtatggcagcaattgttgttgctgctgcaggaaggtagcgaccaatgggttagccactgccaatggattaagtaactgctgtcgctgttgtaggtacgcaccagagtttgacacagccagttggttgaatggaagcaactgttgtaagtcggcagcagggtttgccacagcttgctgagtcagagctggtacaattggtgcaccaactgt

SEQ ID NO: 23269 - DNA, 606 bp, Zea mays
  Clone ID: cC-zmle189046d06d1
acccgtccggaattctcgggtcgactccacgcgttcgtttcatcattcaaaaacacaccaagcgaagcgcactatcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggctttgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcgaacgtagctgcataccagcaacaacctcagctgcaaccagttatgccagtgctcagtcaactagccatggtgaaccctgccgtttacctacactactttcatttagcccgctcgcggtgggcaatgcacctacgtacctacaa

SEQ ID NO: 23270 - DNA, 586 bp, Zea mays
  Clone ID: cC-zmle189046d07a1
ggagaagcaaatatgttattgccgttcaatcaacaatgtaatttacagttaatgaaaatgtcgtggcaccttgtttcttcctatgtactacctacacatacttcattttagttttgctatcggctcgattcgtttggaacagtaggtgggctcttcctaaaggcatgtttcctgcaacgctgaaaaatgccatcgtacagcaaatcaaactgcactccagctctttcccggttcacaatgaatagaatgtggtcagcttcaataatcttgtaatacctgcagaaatcaatggagcagatatgtttccattagtgaagagcgctaaataaacaaatgaaatcactttaaagcatgatagttgaccagttggattcagagttgaatgctaaataatactccatccatcctaatttactagtcacgctaggccttgaatttatgtgtatattaaaatacattttaatagatgataacgaatctataaatatatatttagacatacttagatatagagatatatatttatgtatatagatcgcaactctttcctgatctattaaatgcttaaccaattttttttggacaa

SEQ ID NO: 23271 - DNA, 429 bp, Zea mays
  Clone ID: cC-zmle189046d07d1
cggacgcgtgggcggacgcgtgggcggacccctgggatgaaggattgggaagacaccaacggtgctttgagcacgggctctgtgacacatccctgaattcccattgagcttctacaccattttgtagtgcatgattctgactgccatccttggtaatctgggatatggtgggtgcgataattcatacttctaattcaaacttctaagtggctggtctcttacttgattcatgataaataccactattgtgtctcgaaataatgtctctatgaccactatttttcccataaaatatggcgtgcctgtttttaaaaaagtcaacacatttaacacttttgactatgtcagtaagcctaaatcgtatgttacagtgtatgcatgctatatattcaaaagtactttaatataatgctcactttgtgtttgttg

SEQ ID NO: 23272 - DNA, 486 bp, Zea mays
  Clone ID: cC-zmle189046d08a1
gcgtacgtatagcttggatacctctagcagcggcacgccctattcttcttttattttttactttctttctttgtgtttgccttttagtttgggggttggggtcttgtcggttttttctatttttaagaaaaaaaacatccccggccctttttttgttatttttcacggggcccttttttgggggtttttgtgggccctacaacaaagaactttgggggtaaaccacctgtttctaaaatcaactcaagggggtgggcccctgtcctgcttgccccaggaatttagggcggaaaaatgggggggcccgccccccacaattttaaaacaccccctttttttttggtgggggggaaacgtaccccaccgctcggggaaaaaaaaaaaaatttccccttggggggtaaacccgggtttgaaaaaaaagaagaaggagaccccatattaagaaaggtccggggggggcggaagaacttttggttttttccc

SEQ ID NO: 23273 - DNA, 533 bp, Zea mays
  Clone ID: cC-zmle189046d08d1
cggacgcgtgggcggacgcgtgggaggtgagcttcgagctggagctggaggcggggacgagcctgctggagaaggcggaggcgttcgacccggcgtacgacgacgacgcgcagaagctgtgcggcgtcaagggcgcggacgccaggggcggcgtggggccattcggcctctgggtgctggcctccgccgaccttcaggagcggacggccgtcttcttcagggtcttcagggacggacacggcaagcccaaggtgctcatgtgcaccgaccccaccaagtcgtctcttagtccggatctgtacaagccgaccttcgcgggcttcgtcgacgccgacatcttcagcggcaagattgcccttagaagcttgatcgatcggtccgtggtcgagagcttcggcgcgggaggcaagacgtgcattctgtcacgggtgtacccgtccatcgccgtcgggaaggacgctcacctctacgtcttcaacaacggcgaggtggacgttacggtgtccggcctgaccgcctgtgagatgaagaaa

SEQ ID NO: 23274 - DNA, 535 bp, Zea mays
  Clone ID: cC-zmle189046d09a1
ctattttatttattttttctttagagggatgccttatacagacataaaatacagaacatgcctcaccttgtgtttgtccaagacgaagcacagtgccacagtatggctatacctacacagtgcacaattgctggacacaggaagcaacatggggatccatacaacataaaacctcaaaaccttacagacttatccttttagaggacacaggaagcatgcctggatgggttgtgcaccctcacctttggtctctttttgcgtgccaggctccgatccaggaccatgacctttttacttaggtccgtgatgacccccatctgatcgttgccggacgccagaagcttttgcagaaactctttcagcttctggatctcttctggcagcaggtaatagaagatggcctttttatcatcaagaactggggaggcaaaagaaaaccttgttttttgtttgcacagagaggtttttagggaagctttttttttacaggatttgcacctgtttttggaaggggggggcatcctttggaatttcg

SEQ ID NO: 23275 - DNA, 548 bp, Zea mays
  Clone ID: cC-zmle189046d09d1
ggacgttccatgcgcgcgtacttatgcttgggaccgatgtagcggacgacctttcaactcctactaatgtctttgttgtacctaacacagaagaccaacgtgaagtccatagatatcagcttgcaggtacaagctgtggattccatgaaagattgtggcgaagtaccacatggaacaatagaggcttcgacgaatgatgatgaattagaactgggtacttctgcagatgtagaaaagaatgatcaacctaccttgctggaaccaagatcggagtctgtctctgtcccagaactgtccgtcttggatgaatctgacgataaaatgcaatgtggtgtttctggcaaggatgaggaagcacatgtggtggagaaaactgtaactattgctggtgacaaggtaacaggaggttttgcaaatttcgaggatcctttttgtgaggcatcgaggaaggaacctgactttgagaagagtcacccaagcctcggagaagaggaagaccattcaatatgaggaacagtcttccctggttaggtagctgtgaattatca

SEQ ID NO: 23276 - DNA, 213 bp, Zea mays
  Clone ID: cC-zmle189046d10a1
cagtgtatgggaaaatttttttttctcttttttgtatttatcgtcatacatagttattagtcgtgatttttgttttgagaagacgggggtatccaattttcgacccccagaaaattagaagaaaccccgaagggttctataaaacaccttaaaaaaaagtggggcgccgtgccaaccgcccgggaagcgccccttttctttgcggggaaaccc

SEQ ID NO: 23277 - DNA, 571 bp, Zea mays
  Clone ID: cC-zmle189046d10d1
ggggtgagttcgaagcagtcgtccttgctatcggttgctatcctagaaaagttccatgaggaaggttcaggttttactgcacaaatcttgttgacatgggtgtggatttatgatgctcgcatggcggcatggatagctattcattttctgaaactgggagggtatggcattattggcatatccccaaaggttcaccctgttcttatgcttatcggttatattatcatcggcggcgaagctataatggtatacagggtacttccaacatcgaaccacgagacaaataagctgatccatctagttctccacgggattgcacttgtccttggtgcggttggaatatatttcgccttcaaaaatcataatgagagtgggattgccaatctttacagtttgcactcttggattgggatagggacgattactttgtatggtattcagtggatagttggattcggtacattcttcttccctggtgctgccccaaacgtgaagaagggtgttctttcttggcacatactttttgggctctttgtctacatcttaacactggctaatgcggaactcggct

SEQ ID NO: 23278 - DNA, 465 bp, Zea mays
  Clone ID: cC-zmle189046d11a1
gtaaggggcatgggggcgcccattcctaatcttattcaattacgcttcaaagaaacagaagaagaaattaacatgcaggccattacattacatgaagggctaattaactgccccgggagagcattcttttgggtgcacggttattacacgggctattttgagataattaccacaaacaccccaagggtaactatctccacacgttttactccctgcccttgcaatcctgagtctattacaactttaccccctaaccttaaacaaaagaaccagatttattaattaccccttgactccggccgtcgagctcggctgggtgccgctgccggcatcgtggatcggaccgacatggccgtacgtgaccgtgagcaggcgatcagcacgcataatacttgacgagctcggggagcgactcccgctgcgggtcggtgtttttgagcattcaaaggaggtggttgaacagac

SEQ ID NO: 23279 - DNA, 179 bp, Zea mays
  Clone ID: cC-zmle189046d11d1
gcgcgcgcggaagctctctatccatccacgtgttgagggagatacgggtatggcgaatgtctggctgagcaagcttaagagcgtgcttatgaggtggtactcctaaagccggatattgctcacaccacaagggcgctcggctcgctcctcacacgacgttcatgcacatttgtgcgcca

SEQ ID NO: 23280 - DNA, 201 bp, Zea mays
  Clone ID: cC-zmle189046d12a1
tttttagatgcaaatagccatgtctaaatttacaccgatgaccaccaccatgtttacattcagatcattaacaggagaggaggtggatctagagcgagaggccaccggactcctcgtcctcgttgaggtcagaggtgtagatggtgtagagggaccagatgaggccgaagacccccaggaggatccacccggacgcgtggg

SEQ ID NO: 23281 - DNA, 379 bp, Zea mays
  unsure at all n locations
  Clone ID: cC-zmle189046e01a1
gttgctccaagaagcacctttttttccttaagattaacttaaaataaagcccgacgggggtaacagcttccatcgatccgcaanccatgctgtttgatagcatgggtctgcgtgaaaccgaggatgaacacagccctttcaactgacacagagcgaccttgccatcaaaaacacagatgggcaacaacaaacaccacccgaacgaagataaaccctctggacttggggaaacatcacgggagcgaacaggataacttggccgggcgggccccaccggtcaggtcctccagttcccgccggagttgccgtatccgccgccacggttgccaccgccatagccggcggcacctccaccgtagccggcgccggctccgtagcc

SEQ ID NO: 23282 - DNA, 120 bp, Zea mays
  Clone ID: cC-zmle189046e01d1
gggacgcggggcctatggggttggggtatgtgcgagaccaggactacatggtgagtgaaacatgtatgagttgccggtgattcgatggaagactaatctgggcgcactgacgatcactcc

SEQ ID NO: 23283 - DNA, 492 bp, Zea mays
  Clone ID: cC-zmle189046e05a1
ttttgcacaaacatggttcatcttagtgtacaacgccaactcatcatctcgacttgcctatgcaatgcaacgtgaaacaaaagacacacatgcctctcgcagcatcaatgaatccacgtacgtacaccctcttcgatccgaaagacaatgaagttgcatagcatagccgttgagcttagctgccggggacgaagttggtggcgaaggcccatgcgctgttgttgactgggtcagcgatgtgggcagcgaggttctcgagcgggcccttgccggggacgatggcctggacgaagaagccgaacatggaaaacatggcgaggcggccgttcttgagctccttcaccttgagctcggcgaaggccttggggtcgtcggccaggccgagggggtctaagctgtcgccagggtacagggggtcgacgacctctgcgagcgagccgccggcaatgcggtagccctcgacggcacccatgagcacgacctggcaggccc

SEQ ID NO: 23284 - DNA, 551 bp, Zea mays
  Clone ID: cC-zmle189046e05d1
cgcgagggccggctggactacctcggaaaccccagcctgatccacgcgcagagcatcctcgccatctgggcctgccaggtcgagctcatgggtgccgtctagggctaccgcattgccggcgggccgctcggtgaggtcttcgacccgctgtaccctgacggccgcttcgaccccctcggtctggccgacgaccccgaggccttttccgagctcaaggtgaatgatctcaagaacggtcgccttgccatgttttccatgttcggcttcttcgttcaggccatcgttaccggtaagggcccgctcgagaaccttgttgaccacattgttgacccagtcaacaacaacgcatgggcctacgccaccaacttcgttcccggcaactaagcttaacggctatgctatgcaactttattgtctttcggatcggagagggtgtacgtacgtggattgattgatgatgcgagatgcatgtggggcttttgtttcaggttgcattgtatatgctaattttgaaagatgagttggctgttgtcactaagaatgaccatttt

SEQ ID NO: 23285 - DNA, 302 bp, Zea mays
  Clone ID: cC-zmle189046e06a1
catagacatacaaatttaatgggtattgcacaatgatagatccacatcacataaaccatcaacaagcttcacaacaaaatcattcgcaaaacctacacatgttattatgttttgcacatatttgcaaacactttacaaaatcattcacaaaagtactaacgcttcaagtgattcgcaaaagcctttacaaaagcactccaacttcttgtatccttttgttttaaggcacaagcttgtaggggttgtgatgtccccatttacttgatgctaacaagacatttccttcaccaaagccattttcg

SEQ ID NO: 23286 - DNA, 228 bp, Zea mays
  Clone ID: cC-zmle189046e06d1
atccttaattattctggatcgacccacgcgtttcgctaagatggactttggtcgaatgaaatagtcttgttagcattcaagtataatggcagacatctacaactccctacaagctttgggtccttaaaacattgaggatacacataagtctggagtagctttatgtgtaaggctttttgcgatattaccttgatagcgttatgtactttattgtgatatgtatttttg

SEQ ID NO: 23287 - DNA, 534 bp, Zea mays
  Clone ID: cC-zmle189046e07a1
ttttgcattcaggtgagcaaatgtccatgataccatatcgtaactttcaattggtacacaattctagaggagatttggatcctcacgactcacaggtcccaatagagttccataaccaacccgactgagccatagcaaagcatggactcgctctcttacaggaactcatgtatcgatgttcctagaatttctacagctgagacacgaacagtgtagttcagtttcctgtgttagaattgttcatcagttgagctcgtctccttagtagctttgtcgacgatgccatcaccagcagtgtcggtgttttccaacttgtcctcctttgactctctgctttcatcatagttttcagaagaaccatccagtttcaagttccccaagttagctgacaagacctcatttgtgccgtctccatttcctttgttcccatcattttcggtagcatcttgaagccccaaattctttaagctaagtgacacatcttcctgctgcttcttaagggtggtcctcagctcttggaatctgagcgaagct

SEQ ID NO: 23288 - DNA, 442 bp, Zea mays
  Clone ID: cC-zmle189046e07d1
ctagaactagtccctaaccctagctgcggacgccgtcgccgcctccgcgcccaaccgatgtctgattctgaggcgtccccaccgcccactccggccgccgcaacgcccgcagcgccggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctcaaatttccaagagctgaggaccacccttaagaagcagcaggaagaagggtcactttagcttgaagaattggggcttcaagatgctaccgaaaatgatggga

SEQ ID NO: 23289 - DNA, 268 bp, Zea mays
  Clone ID: cC-zmle189046e08d1
ccacccgtccgcctactcgtacttggacgcgtgggcactctaatgaatgttcttccctcgattgggcggcacgaaacccgagatcggtaccatcatcaatacccggacccgttaagcgcatgcgtatgtctctgtaaagaccgcgcatttcttgcgtgccgtgttcacgctcgcgcgcggtggcgttaaacttgttagcgccacatgaaggaagaatgaaaaataattataaactcgtcctatatcgatttgaaccatccgaggaggc

SEQ ID NO: 23290 - DNA, 438 bp, Zea mays
  Clone ID: cC-zmle189046e10a1
aaaacgggaatttcacttctcattgcattatcatgaatctcataacataacaggggaaacacgaatcaagccgaggcgccctggtgtgtacatatccacacctaaaccgctaaattaaactgggagcgattcatgataaactaagaccaccactcatatcaccaccattttattcatatccaaaggaacggacccagggggagtcgacaatgaccgagggagggcggccgaacagaccatatcagagagatctaggagagctgtccgcagttagcgaccttgaccaccttggagggggagccgttgcgggtgcccacctttttgatgggcttgacgacgtccatgccctctacgaccttggcgaaaacaacgtgcttgccgtttagccaaggggtcgcgacggtgcaaataaagaactgggaccccttggggttgggc

SEQ ID NO: 23291 - DNA, 592 bp, Zea mays
  Clone ID: cC-zmle189046e10d1
gacccgggtggggagatccacgcgtacgacaatatcctcaaaccctatctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaagtggtcaaagtcgctgactgcggacagctttcctagatctctctgatctg

SEQ ID NO: 23292 - DNA, 241 bp, Zea mays
  Clone ID: cC-zmle189046e11a1
cttctggaagcttcccagacgctaaagtagccatgcgttattagctatcaccgcgaaataatcatgcctcggtctatggcatctaaagatgcacataaccaaagcgtatattgcattcttttacgtctcatgactacatatatctccgagcataacatacccatgctctttatttcagaaactgtacgagtaaaaaggcgacgagcaagcaagcatcgccttgattatttaaaccctgtcg

SEQ ID NO: 23293 - DNA, 285 bp, Zea mays
  Clone ID: cC-zmle189046e11d1
ccacgcgtacgccacagggtttaaataatcaaggcgatgcttgcttgctcgtcgtcttttttttcgtacagtttctgaaataaagagcatgggtgtgttatgctcggagatatatgtagtcatgagacgtaaaagaatgcaatatacgctttggttatgtgcatctttagatgccatagaccgaggcatgattatttcgcggtgatagctaataacgcatggctactttagcgtctgggaagcttccataagaaaggcaaaaggggggagaattttataatatgg

SEQ ID NO: 23294 - DNA, 482 bp, Zea mays
  Clone ID: cC-zmle189046e12a1
tttttggtattttaaacttggaataatattattgatactaaaaaggcacgaccgtcaaagccgttatattggatgatgagcagtgaccacaggacagaatcgttcacttgttgttttaaccttcatagtcatagatgccacctatcttgaccagcagctcgcctcacctttcgacgatggatttcctatcataagattcatttctctacgaaaataacctaatgattaacccttttctagcccctgcccaccaccatgtgcacacaaaccccaattacgttacacatgcgtgcttcgttgccatccttccttatataatttacacaattttttgcgacttccaagtagccatagttttgcccaaacactgcgttctgaccggtagatactatccaccttaaacgtgatacgctaaacatactgaaaatggcaagcacgttaccttagctcgggtttaatttgttcttgattttttttttaca

SEQ ID NO: 23295 - DNA, 409 bp, Zea mays
  Clone ID: cC-zmle189046f01a1
agcccccttttttttttttttttttttttttcttttcccctttcttttgcttttggtttccacttcaattgttcacccaggttattgtttacactgaccctgccccccaaggggaagggggacacataaggaccgaaccaccgccgccaagggccccaacgaggaggccagccaaaagtcaacccacaaccccccctcaaagaaacggggaacccccccgcccgcagcatagggccaaggaacaggctgccgaggggggaacccccccggcaaaaactgggcgatctgggccgccaacagccccggaaccagaccccttagagggggccgctgtaggagggacagaagaacccacccaaaaaacccctggaaccggggctgggggcccacccgcgagaaccccaggcaa

SEQ ID NO: 23296 - DNA, 557 bp, Zea mays
  Clone ID: cC-zmle189046f01d1
cgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggtgctgttggcggcgcagatagcgcagcaactgacggcgatgtgcggcctgcagcagccgactccatgcccctacgct

SEQ ID NO: 23297 - DNA, 360 bp, Zea mays
  Clone ID: cC-zmle189046f02a1
ttttatgcttgctggattaaattgttctgtgattcttattatatctaacggttttgctaagcgcttttactatcatcataagctcattatcgtgcagccatcatttgacccactcgtccggctttacagctgacacttttaaaaaaaggcgttgatgagaccgctggggctggcatcgtgcgtgagaggctccgagaactaaaaaagctcaggctggatcttgggggccaagctcttgccgagctcgacgccccactgatcgaagctagagaggttccagatggcacccccagagaaagagaggagctcgtagcagacgaaaagagcaccaatagtggcaggtgcgaacttgtcccccag

SEQ ID NO: 23298 - DNA, 463 bp, Zea mays
  Clone ID: cC-zmle189046f02d1
cccggccactgtggacagttcgtgaacgagaaaaatggacatagtttcgtgtgtgagaatagaaattctttatggagttgggggtctcagactagaccttgatgaaggaatacagcaactccaacactgtacccagttagggctgcgagagcagtactaacagttatttctctttttacctgttgaagagagctatgaactgcctgaacacgaccgtatatatcatggtctatataggagacgcgagacatgctcaggagaacttgatctccacgttgctggcttacaactttttcgctcaggctgaggccctcatggtcggcaagacccctgaccaggtcaagactgagggtgctcccgacaacctcgttcctcacaaggggttgcttggtaaccgggccaccaccttcattctggctgacaagaacacacatgccactcttggtgctctgatagactacta

SEQ ID NO: 23299 - DNA, 384 bp, Zea mays
  Clone ID: cC-zmle189046f03a1
aaacgaacaaggggtattttgtttaaaaaaaaaaccggcaaacccccgtttggggagaggtccttggaaccccaactgacattttacctacccaggcggggggacctacaaggagggggccggacaaccccttcccttaaagaatttctattcacaaacagagtttccgttctgtataacccatccccaagctcagggtaaacatgcctttttggtgcccaacagaccctgtaacatttcggaggggccccctgccacaaaaggggggggggcccaccgtgcaccccccgccatgtttttgcccatttccatttggaagaaacccattatcccccaaatagggccccatggagtttttggtgagcccgtgggggaccccatttt

SEQ ID NO: 23300 - DNA, 491 bp, Zea mays
  Clone ID: cC-zmle189046f03d1
gaggatgggattgtgagcccagtgaaaaaccagggccactgtggatcatgctggaccttcagcactactggcgcacttgaggctgcatatacccaggcaactggcaagcccatctctctctctgagcaacagcttgttgactgtggttttgcattcaacaatttcggatgcaacggaggccttccatcccaggcctttgaatacatcaaatacaatggtggccttgacactgaggaatcttacccttaccaaggtgtcaatggaatctgcaagtttaagaatgagaatgttggagtcaaggttttggactcggttaacatcaccctgggtgctgaggatgaactgaaggatgctgttggtctggttcgcccagttagtgttgccttcgaggtgatcactggtttcaggctgtacaagagcggagtttacactagcgaccattgtggaactacaccgatggatgtgaaccacgctgttctggctgttggcta

SEQ ID NO: 23301 - DNA, 533 bp, Zea mays
  Clone ID: cC-zmle189046f04a1
ggctgaaccaacatgaatccattaatttagccctgaggtagctacaggaagagacggagaagtcagagttcattatgataggtagataaactccgatatatccaaaagaatataagggtatttcatagacaaagcttgtgtacttgtttttgaggatttgacgaacttatcaaacaattcaaaaaagtatcatcgactggatccatgcagattggacgattggtctcacgtcgctggttggaattggccttattacatcacaaacacagcaggaattggtgctccgacatgatacaagacatcaaacatagtaggaatttgtgtgtcaacatgccaatcaagacttctagttgctaaatcactgcaatatgggggcaagagagtaccaactttccagcaaataattggttttgatgacgtgcctaaaacgcaggccatccactcactacgcattacgcagaagaagaaaaagaagctggcaatgacagagactctgaccatatctttaaccagcatgacaagaaatcctacaa

SEQ ID NO: 23302 - DNA, 552 bp, Zea mays
  Clone ID: cC-zmle189046f04d1
ctgcttgtcagcattcgttctgatccacatgccagtgtatgcctttatgatatggcccccgcacagcattttctcttgaagcttcctgtctccgtagtcgcagctgaaagagagtggaacgccttgatttgtaggatttcttgtcatgctggttaaagatatggtccgagtctctgtcattgccagcttctttttcttcttctgcgtaatgcgtagtgagtggatggcctgcgttttaggcacgtcatcaaaaccaattatctgctggaaagttggtactctcttgccaccatattgcagtgatttagcaactagaagtcttgattggcatgttgacacacaaattcctactatgtttgatgtcttgtatcatgtcggagcaccaattcctgctgtgtttgtgatgtaataaggccaattccaaccagcgacgtgagaccaatcgttcaatctgcatggatccagtcgatgatacttttttgaatggttgataagttgtcaaattctcaaaacaagtacacaagctttgtttatgaatacccctatattttt

SEQ ID NO: 23303 - DNA, 276 bp, Zea mays
  Clone ID: cC-zmle189046f08a1
aattttttactcatttattttttcctttacctttctatttttgttttttttttttttttcggtacccactaaaaaattttaaaacccgttcttacattacaatggggggggaagaaaaactacctgtttctcccaaccacccccttaacacctcccctaactttggcttggggggagcaccccaaaaaaaaaaaggggctttacccgggggtggacccacccaaattgtttaccggtctgggcccaacacaacacaaacattctaattttctaacc

SEQ ID NO: 23304 - DNA, 546 bp, Zea mays
  Clone ID: cC-zmle189046f08d1
cggaattctcgggtgcgacccacccgtccgacggcggcgacgagaagtggcgagccccgagagcgggtttagttagaggctacgggcggtcgggcgcggcggcggcggcggccatgagcagcgggagcgagagcactaccgccagcaggtggctcgagctggccacgctgcgcgcgctggcgcgcgacgccgcggagcagcttcggctgccgcgggccggcacgtcggcgtcggcgtcgtcgtcgtcgccgtggcgcgggcgcgaggaccacctccacggccacggcaagacggccaaggtgatgcacctgctgctctggggacccaagtgaagcggcggcgagaggccaccgtaccgccgggctctcccgccggcgttgcttcgtttgctctggctgcaatccgccccgcacggactgtactgttcctatacacctatatactacgacgtgcacctggactacgacgtgctggtgaccatactaatactagtggcctgctggtccctggctttttgcttgcacaaccccttccgtttttttgctc

SEQ ID NO: 23305 - DNA, 363 bp, Zea mays
  Clone ID: cC-zmle189046f09d1
accttttactctttttgtctgttttgtatgagggaacacgccttgatgtgccatgtaatgggcgtactgcctcatttaacctgacgacaccgcatattactcgaccaattcttcacctactccttatttggatctgcaaaggcaagtcctatgatgggaccctaggaaaaacggctcatttttaaagcgctgtgtgattatacattgccactaagttgcggcctaggcaaaaaattggcaaagcgtgccctagtggacgataggatgccctgggtgtctaaacagccagctcaatgatcttgaccacataggaatcacccactttttggctaacgaccactcggcggtgggaatggaccacgc

SEQ ID NO: 23306 - DNA, 158 bp, Zea mays
  Clone ID: cC-zmle189046f10a1
cactcttctcactacttccctcacaacacccccaacgtggtggtcgcgcgaaacacaccccaaaaacaacacgcgccccaccacaatggaaacaaaaaactcccctccggcagaaaaccccacccccacggccggcaaataacacccccccccccccc

SEQ ID NO: 23307 - DNA, 473 bp, Zea mays
  Clone ID: cC-zmle189046f10d1
ccgggacgttccacgcgcacggccgcacgctaggaatctgttgaggctgagtcagtgtctggttttggagttgtggaggccaatggaacggtaaggaacagaggcgacactaaaagctaagcgtggtttatgtaacatgctcaataactagtgataactttgaagtgcctgtgcaatccagcccgtaacaaacgacacacatgcatttgagatgaatgattaattcccgtacaaacaccctatacgatccgaaagaaaatgaagttgcataacataacctgtgagcttaattgccggggaccaagttggtgtgagtatgcccatgccatgttgttgactgggtcaaccaagtggtcagctaggttctacaacgggcccttgccggtgaccatggtctggaccaagaaactctaacattggaaaacatggcgaggcggccgttcttgagctcatttaacttgagctcggagccc

SEQ ID NO: 23308 - DNA, 389 bp, Zea mays
  unsure at all n locations
  Clone ID: cC-zmle189046g01a1
gatcagcgctacggcggcgggtactacggcggcggaggcgccatcgcgacgccggggtacgctccggcggtcccgtacgggatgtcgcaagtgaacatcgagggcaacgggtgcgggcgggcgctgccgccgcagccgaccgtgaaggtgtactgccgcgccaaccccaactacgccatgagcgtccgcgaggggaaggaggagctggcgccggcgaaccccaaggacgagtaccagcactggatcaaggacatgcggaggagcacgagcatcaaggacgaggaaggttacccggcgttcgcgctggtgaacaaggcgaccggggaggccatcaagcactcgctggggcagncccacccggtgcgcctggtgccctacaacccggactt

SEQ ID NO: 23309 - DNA, 555 bp, Zea mays
  Clone ID: cC-zmle189046g01d1
cggacgcgtgggttttttttatgttctaattaatacaccccgagcaactttattatatgtattattacaaggcacatacatacagctgcaataacgtatacatgaacaccctttgtctcgcaactgctggcatgcatgcaaaagacggcacgggccacgggagataagacattaagacccctgttattctgctagtacgtatgcatgcgtacgtagatagtagacgctgctaatacgtacatgcacgtctgcaccatatatgcatgcatgtgcacgatcgatgggcggcgcgatggtcatatcatccgttggttcagtagtagggctggatcttacagcgctggttgtcgccctcgcaccactttcagagcacgacgttggtgccgtcacggacgccgccgtgccacttgtcgccgtggagggcgtcgaaagtgaagtagatgttgttgaccatgccgacgcagcggaagccgttgccgacgtagtggctctccgtcacagtaccgacttgtccaaaaagccgggttgtagggaccaggcgcaccgggtgggact

SEQ ID NO: 23310 - DNA, 373 bp, Zea mays
  Clone ID: cC-zmle189046g03a1
aggtatgatgcacgcggccgcaagcgtggaccctctacagcggccgccctcgctcttttttcttttttttttttttctttccttatcccttggtctttcggggttgctgtgactacatcaaattattttttttcccccaaacccacaagcttttatttattactccataaaaaacttcctgagcccattgtcaccaattacaagcctacacaaataaccctggctccctctgagtgccaaataccacaggactctaaacagtcgggcctacttcccataattgttggataacaccccacaactgcctttgtgattttagacacccaagtccccctcgccttcttttttagggcccgcccccttaaaaggcccc

SEQ ID NO: 23311 - DNA, 485 bp, Zea mays
  Clone ID: cC-zmle189046g03d1
acgcgtccggcgccccggacatcttcgagagccccgccgtcgtgtccctcacccgcgccggggtcgagaacctgctgcgcctggagagccgcgccgagccgtggctcgtggtgctgtacgcgccctggtgcccgttctgccaggccatggaggcctcctacgtggagctggccgagaggctggcggggtccggcggcgtgaaggtggtccggttccgcgccgacggcgagcataagccgttcgctcaggccgagctgcatctgcagagcttccccaccgtgctcctgtttccgagccgtaccgaccggtccatcaagtacccgttctagaagagggacgtcgacttgctcctcgtcttctgtaacagccttcggtgaggcccgtcagtgagcgagaaccatcgttctctgtcagtatgtaccgtgttacatgtttggggccatctaggtgtgctgtacgtatagagggaagcgtgagggaactgg

SEQ ID NO: 23312 - DNA, 183 bp, Zea mays
  Clone ID: cC-zmle189046g04a1
caggttaaaaacggcctacaaagcagctccataatcatcacacgggacagtacagcgcgactaccaaaaacgatataagaatttcatccgcaaaagacctttgcttattttacaggtatgatctaaagctagaaccccacgcgtccgcccacgcgtccgcccacgcgtccgcccacgcgtccg

SEQ ID NO: 23313 - DNA, 223 bp, Zea mays
  Clone ID: cC-zmle189046g04d1
cggacgcgtgggcggacgcgtgggcggacgcgtgggcggacgcgtggggttctagctctagatcatacctgtaaaatatgcagaggtcttttgcggatgatattcttatatcgtttttggtagtcgcgctgtactgtaccgtgtgatgattatggagctgctttgtaggccgtttttaacctgaaaaaaaaaataaaaaaataaaataaaataataaataagg

SEQ ID NO: 23314 - DNA, 367 bp, Zea mays
  Clone ID: cC-zmle189046g05a1
agggcccgtgacaagttatcctgcatgaacgaaccccaaataatgacattggtaacttaaaaggaaacccctggtggagggttcttgtggggatcaaacgaaaaatttacccagctgtacccgtaattttttacctaccccgatggaggtttggaattaagatacttcgggtcgacaaacatacatgtggctggacaaacaagcttgtgacttggaggactaccttaactctgccggatggaaggttttggaccgattctctaagggacacatgaatatttttgggtccaccacccccgaggggttcctgaacagaatgtttagggcaggacgggctggcccatatgtcaacgaaggtagggtgggt

SEQ ID NO: 23315 - DNA, 459 bp, Zea mays
  Clone ID: cC-zmle189046g05d1
ccggaattatcgggtcgacccacgcgttcgagcaaccgacccctcctcgctgtattagtagggaaggataagatggagcctggcatagcgggactgagcgggccggtccacgcgggaacgattgggaggtcgtgcagctcaccgcgtccgtatactccgacgtgcccgctccgaggaagccctagccctccgacgaagcggaagctaatagatacggtgcaaagggggacgatctaaccgccggactactcatgttcggccacttctccgtgtctcatagcgagtgttttagcctccttttatgcgccgacaccaaagaaccaccgtccaaggacaaggaggagccttgcgagcatactaagctgttggaggacgacgtccccaccatcccgttcgattacggcaatgcgcctaaaggcaatgtgttttggtcggggaagagccggccgggttctcgta

SEQ ID NO: 23316 - DNA, 501 bp, Zea mays
  Clone ID: cC-zmle189046g06a1
agaaccaagagtgcttaaagcgacagacttcaattacaaatgcaaatacttgagcagttcagcatgtgatgatggaaggaaacacccaaacattacccaggggggccaggacacaaacaaaggtttttcaacaccacaacctggctcgacagccaaacagattcatgcaagcagatcagtattcctcctcctcgttaccgtcatgactgccgccctttgcggggacctccttgtagtccttctccagggcggccaggtccttccgtgcctcggagaactcccccttcttcatgccctcggcgacgtaccagtgcacgaacgcgcgcttggcgtacatgaagtccaacttgctgttgatgcgggagaacacctttacgaccctggtggagttggagatcatgcacaccgggcgctgaacctttgggaggtccgtacccggcaccactggcggcgccttggtattgatgcccacttgaaccccgtgggcaccaaccacgaact

SEQ ID NO: 23317 - DNA, 555 bp, Zea mays
  Clone ID: cC-zmle189046g06d1
aattcttgggtcgacccacgcgtacgcccactcatccgcggcatcacagactgatggccaagtgcctggagataagaccgcgggacatcacgatgaggccttgagcaccttcttcagccagactggtgctgggaagcacgttccccgtgcaatcttcgatgaactagaacccactgtgatcgatgaggtgcgcactggcacgtaccgtcagctcttccaccctgagcagctcatcagtggcaaggaggatgccgctaacaatgtaccccgtggccactacacaattggtaaggagattgtagaactgggccttgaccgtatccgcacgcttgctgacaacgtggaccggcctccagggcttcctggtcttcaatgccgttggtgggggcactggctctggccttggttgtctcctgcctgagcgccggtgcgtggagtacgggaagaaatacaagctgggctttactgagtgcccatttccccaggggtcaagcttctggtgggagccttacgacagtgtgctcttcactcacttactcctggagcgcactgatg

SEQ ID NO: 23318 - DNA, 291 bp, Zea mays
  Clone ID: cC-zmle189046g07a1
gcaaggttatttgggcccctcatgttccatgacagcgggatatttaagttcattggatcagtaccgagcctggttttttcaagaaaatttggaggtttacgatcgacactgactcattaaatttttcaggtcccggaaaaggaccttttctgaggggtaccacaaataagccggggtttttctaaggccattgggatcaaaaaaggggttcaaaaccaacagggggtggattaccgttgggacaagggacccttgggtttaccctggaatttcggaccggttcctgggggg

SEQ ID NO: 23319 - DNA, 318 bp, Zea mays
  Clone ID: cC-zmle189046g07d1
ctgtgccaacggtgatccacgccctgttggttctgcttcgctctgttgatcacattgtgcttagtataaccctggctgatttgtggtaacactgagtaaatgtacatttcctggaactggaaaatttgatgagtcagtgtcgatcgtatctgctactattttcctggagaatgcatgctcggtactgatccactgaacttaactatcctgctgttatggaacatgaggggcacaaatagacttgcaaaatataaaaaattatattttttttattaccaatctatgaattttcttctttaatataataaaaataaatgg

SEQ ID NO: 23320 - DNA, 381 bp, Zea mays
  Clone ID: cC-zmle189046g08a1
actttaattttacaaataagtgttcaacacgtagttagcgtattgtcttgttttttccaagaactgtgagcctgaacatacaattgcctcttacaatgaccatgaacaaacatactaccacagacatttcataatgctcacagtcaagctccaacgggtatggattcaaatcaactggcgggtaaaatacccctggcgaggaagctttccctgctcttgaggaactcgtccaaacaaaccttgaggccttcattcaccctggtttcgggcaccacaaaccggaggacgttgacacatatgcagacgcctgggcggaagaaaatcctgaccctgtaaatcctgaacggggcgctggggtggtggcagctttccctataggga

SEQ ID NO: 23321 - DNA, 306 bp, Zea mays
  Clone ID: cC-zmle189046g08d1
ctcacgcgttcgcccacgcgtacgcggccacggctttgtggtgcgcgagaccagggtctaggaggacatcaacacctgcaccggcgaggtccacgagcgcagggagagcttcctcgccagggctaactgagccgtccggtggtcggcatccacgcccgttcgtgcctgcctgcgtgccttatgtatgtctgtggttgactggttgtgcagggtcatcgtacttggctatcgtacgtgcacgccctcagcttctgttcgaattacgacaataagctcgtgacctgaataaaacttcttcgtaatact

SEQ ID NO: 23322 - DNA, 233 bp, Zea mays
  Clone ID: cC-zmle189046g09a1
caccattaagcgtatgcgtccatccttgatcggaagaatgactcctccccagaaaacaatggcccttaaggccttttttttggattacattcgcatgaatcccttcttggtaaaatacactccatcgtgctgactgattatggggaaaaaagcgcctgattgacgtggcaccccatctttcatacacagccagaagcgtcaataccctatcaaacaaaccctccgtcatccat

SEQ ID NO: 23323 - DNA, 423 bp, Zea mays
  Clone ID: cC-zmle189046g09d1
ttattttttttttttttttttaaaaaataacggaggaggggtgccacacttgcaccgaacaaaaaaattaagcatccaaaccaatgcgttaaaaaaagtcatttaaggaaaaggggctgcaaaaatcctcttattcaggttgaaagaagctaaaaacatatcacaatttttgtaccataaaagcggagatcctttttgatgaggtcaaacaaaacatgtttctacggaatcaaaaaagcttgacacagtggattttttaggcattccacccaaaccccgtgcacatgctttggaaaccacccaattcagggcacaggaaaattattggttctttacggacatggaaatgggatcataagaatttttttcaatcttttcaaaatccccagttatcgttacggaatttatcggaaaacttttttc

SEQ ID NO: 23324 - DNA, 109 bp, Zea mays
  Clone ID: cC-zmle189046g10d1
gcgaccttttattcattttttagtttaatgagggcccttcctacatgcaagcacgtggggcttttactaacttcacgcagccactgctcttggataccacccctaattc

SEQ ID NO: 23325 - DNA, 400 bp, Zea mays
  Clone ID: cC-zmle189046g11a1
atttatggcctttgcaaacaaactgcatttgcaagatatagggtattgcttacagcatttcaaaatatgattacagatcctacccttgtttggccgaaatacttctaacctttgctatgttcctctctcaccaaaatgtggcaaactaactgaaacaaatatcacgaacgaagggccttgtccgttgtttgtctggatgaagcaagcaactctttgaactgtgctaatgccttctctgttatttgcttaaacggtgtgcgctttatcacatgggctccaaagaagtataacagggcattttgagcagttttcgtgttgatgcctctatcctggaagtagaagaagctcgtctggatcaagctcaccactgatggcggtaccaatgagtacactttcacat

SEQ ID NO: 23326 - DNA, 373 bp, Zea mays
  Clone ID: cC-zmle189046g11d1
gcaaagcccctggtttaggtacaggaatacaagccaacgacagctaaaatatcctttttgtcctcgaacaccgcccaagaaggagggaagcaacaccatccaaatgtcaccaaaactacaaatgctattttaatgtaagcttggcgaccacctcgaaagtatttaaaggcaccaatgacaaccaccattgccagaaacaatcttcatttagcaagccattgaagaggatcagcctgagcatgggaacctagagcgcccagagcaacattgagtcccatggccgtgagcatcatctccaaaaaacctcgctaccctacatgaacaagcggagccggatgaacctcctgataaacaacgccatcttgttgaccaa

SEQ ID NO: 23327 - DNA, 205 bp, Zea mays
  Clone ID: cC-zmle189046h01a1
agggttgatttttgaccggatagagaaacaagaaaaaactccccttttttttgggaaaaaaaaaacaaaaggggggtaaaacccccccccatttaagggaattttccccccccctggggggggccttttcccaaaaagaaatttttgggggaacatttgaattttccttccgaaaaacccaagggggggcaaattctttaagttt

SEQ ID NO: 23328 - DNA, 415 bp, Zea mays
  Clone ID: cC-zmle189046h01d1
ggacgcaagagtcacggcgtattcagatgcaatagcgaggctgggagcagatggttagcgaacaccaccaccgtgtattcatcagcatgtttctgcgaatggagcaacatagatatgctcaaactctgaagatatgcgaaaattaagactcagaatgtctgggctgacctggggtttgcgagtaggatagcttgatgtttgcaaagaagctcgagtgtgggagataggcccgacttggggtgttgtaatcgacctaaattcgtgtaggtaattaaccacttcatgttacttgttgccaaaaaaaaagtgatgattctgcttgtacaaaaaaacaaaataaataaaattataaaatatttaaaaaatataattatacatatgtttattattatttatttttccttacctttttcct

SEQ ID NO: 23329 - DNA, 461 bp, Zea mays
  Clone ID: cC-zmle189046h03a1
gcagcaccaagaagcaccattttttccttaagattaacttagaataaagcctgacgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccgctcagttcctccagttcccgtcggagttgccgtagccgccgccacggttgccaccgtcgtagccgccgccaccaccaccgtagccgccgccgccaccgtagccgccgtcaccgccgtagccgccgtcgccatcacggagcccgccaccgtcgtagccgccgccttcacggtcaccaccgtacccacc

SEQ ID NO: 23330 - DNA, 668 bp, Zea mays
  Clone ID: cC-zmle189046h03d1
ccggaattctcgggtcgagtccacgatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggaggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgcctgtgttcattctcggctccagcagacccatgcataaacagtattgactgcggatcgatggatgcttgttacccccgtcgggcttattctagtttattctaagaaaaaatggtgctttttgtgctgcaaaaaaaaaaaaataaa

SEQ ID NO: 23331 - DNA, 360 bp, Zea mays
  Clone ID: cC-zmle189046h04a1
gaaacgaacgtaatccattcactttttggttgggtgcggtatacaatacaacaggtctgtacagattactcatcgccgtcgccttttcacttggagaccgcacccccaaaataaaaaaaaaggacaggaacgaatccaagaggaggcccctcgaagttcaggccgagacgatggactcgaagcagtggagcccgtcgaactcgggcgcgaaccgcggccgcgcctcccgccggcgctcggccgccggggcccgctggtcggccgccttctcctgcctcggcgttggcgccgtgtccgccgccgccgcctggggccgaggccgcccggcggccgaggcccgccacgagagccgggcggagg

SEQ ID NO: 23332 - DNA, 365 bp, Zea mays
  Clone ID: cC-zmle189046h04d1
ttttgggtcgaccacccgtccggaaaaggggacccccacctctgccgatttccatccgtcggggctttgtctgtgaccgaccagaccatgggcaagagcctggcctactccatcctgagctcgtcgccggcggacatcttcgcggccggcctttccttttttctactcctccgcccggctcttgtggcgggtctctgacgccgggcggcctagtccccatgcttgctgcggtggactctgcgccaactcctaggcaggagaaggcggttcgtcagttgtcccctgcggtacaactccatcgggaggctcggtcgcggttcgcgcccgagttcgacggtctctcactgctatgagttcattgtctt

SEQ ID NO: 23333 - DNA, 382 bp, Zea mays
  Clone ID: cC-zmle189046h06a1
ggaaccaaaaacgggcttggccctaaattagccaaagaagccgggcccaaaaggtgggacccaaggggtttgcaaaagaaaagccccagaaccggttgccgctttcgggtttttttttggtaaggccctaaaccaacgggatcgggaaactaaaagatccccttaataaacaccgggtggaaacaacttaacatttaagggccgcaaaacagttagctaattgggggcccaaccctcgatttgctcccccgggaccttggaaacaggggttacccatcggcatcggtttcctcggcactggggccatccttataaaaaacccttggcttcgggccatcctcatcctcaggtttagccttttttgggggtgggctttcctttt

SEQ ID NO: 23334 - DNA, 586 bp, Zea mays
  Clone ID: cC-zmle189046h06d1
ctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctggacagaagaagcaggactatgagaagactaaggcaaactttgataagaaggagagcacaagctcaaagaaggctaagactgaggatgaggatggctcgaagtcagaggttgatgatgaggatggcagcagtgacgaggaaaacgatgacgatgagtaaacactgtctccaaggtcacgaggtagcaaatcgagtgttaggtccccaattagcttactgttttgctgcctttaaatgttaggttgtttcaaacaggtgtttatgaaggggatctaattagtttcgcgatgccgttagtttagtgcctttagcaagaataagccgaatgctgctagctgttctggagcttttcttttgctaccacttg

SEQ ID NO: 23335 - DNA, 502 bp, Zea mays
  Clone ID: cC-zmle189046h08d1
aggagctggacggccgcaacatcaccgtcaacgaggcccagtcccgcggcggccgtggaggcggcggcggtgggtacggtggtggccgtggaggcggcggctacggcggtggcgggcgccgtgatggcggctgcggctactgtggtggctgcggcttactgtggcggtggcggtctactgtggtggtggcggcggttactgcggtggcaaccgtggcggcggctacggcaactccgacgggaactggaggaactgagttgtggggcccgcgcggccaaagtatcctgttcgctgccgtgatgtttaccctagtccagagggtttattctccgttcgacttgtgttttgttgctgcccatcttgtgttttttgaattgcaaaggtcgctcttgtgtcaatatgttagttgctgttgtttattcttcgcttccggcaaaccccttgtatttaaacagtattggactgcggattcgatggattgctgttatccccctgtcaggct

SEQ ID NO: 23336 - DNA, 71 bp, Zea mays
  Clone ID: cC-zmle189046h10a1
ttttctttgttttttcctttatctattcttattgtgatggggatactttattctttctaaactttaatttt

SEQ ID NO: 23337 - DNA, 212 bp, Zea mays
  Clone ID: cC-zmle189046h10d1
acgcgtacggctgcaggcaaatcatgggttgaggctttttctgtggctggtctgggggttttgaagcttcatggaattgcaaagccatgaggtgtaactaaaagctaggtgtaatttctgtctctgttcctcaattcttgctaacttttgcgtatcttgtttatacgtgccactgaatagcgtggattaatcgatgagatgtatgaattctt

SEQ ID NO: 23338 - DNA, 204 bp, Zea mays
  Clone ID: cC-zmle189046h11a1
acacaagaatcttctaaaatggggtatattaccaacaattgaaacgaactcaaggaaaaggttcccaagaatcttctaaaatctgttttattaccacccatagtatagaatacatggaaatggattacatgaattttttaaattttgtttttttaccaaccctataaaagatccatggatattgttctcatgaatcatacaatt

SEQ ID NO: 23339 - DNA, 369 bp, Zea mays
  Clone ID: cC-zmle189047a01a1
ggaggacaacctgttactggatcattgggatttttagcgcgaatagcacgagcgcaaaacgatatcaggtacttacagttgtttgcaaagggacgaaaaacatacaaggggacatgaccacaattgtttgcagtgttgacacgagtgggctcatacaatagacaatacatatgtcgcacttcgatcccgtttttttaacaaccagagcacaggaccgggggggtataccgtgttcgatatcaaaaggccgcggggcggtgctttgaccggctagttgtcggattgcatgctcctgagcatgttcaggatggagaggaacaggttcaggatgtcgaggtacagcccaaccgacgcccagatgtactcgtc

SEQ ID NO: 23340 - DNA, 583 bp, Zea mays
  Clone ID: cC-zmle189047a01d1
cggacgcgtgggcggacgcgtgggcggacgcgtgggctgactcttgggcggctggcgtggtggtttctctgactgcgtatgctttctgggcgtcaaagaagggcaaggaattcgggtacctggggcctatcctgtcttccgcgcttactatcctcgtcctaactagctttcttcaggttttcttcccactgggacccgtgtcggcgggcttgttcggtgggctaggggctctggtcttctcaggcttcatcctgtacgacaccgagaacctgattaggcgccacacctacgacgagtacatctgggcgtcggttgggctgtacctcgacatcctgaacctgttcctctccatcctgaacatgctcaggagcatgcaatccgacaactagccggtcaaagcaccgcaccgcggcctcttgatatcgaacacggtatacccccgcggtcctgtgctctggttgttaagaagacgggatcgaagtgcgacatatgtattgtctattgtatgagcccactcgtgtcaacactgcacacaattgtggtcatgtcaccttgtatgttcttcgtcactttgcaaacaact

SEQ ID NO: 23341 - DNA, 335 bp, Zea mays
  Clone ID: cC-zmle189047a02a1
gagggaacagtatgattacattattccatctgcccatttaactgttacaccgcagtttagtcgagcaatttttgaactacaccataattggaactgtaaaagcaaatcctatgatggcaccataggaaaaactgctcagttttcaagcgctataggattatacatagccaataagtttcggcctaggcaaaaaattggcaaaacgtgccctagtagacaatagcatagcctgattgtctaatcatccagctcaatgatcttcaccacagaggaatcacccactttctggcaaacgacgacgcggtcgtgggacttgatcacgcccgaggctttgc

SEQ ID NO: 23342 - DNA, 336 bp, Zea mays
  Clone ID: cC-zmle189047a02d1
gcaaagcctcgggcgtgatcaagtcccacgaccgcgtcgtcgtttgccagaaagtgggtgattcctctgtggtgaagatcattgagctggatgattagacaatcaggctatgctattgtctactagggcacgttttgccaattttttgcctaggccgaaacttattggctatgtataatcctatagcgcttgaaaactgagcagtttttcctatggtgccatcataggatttgcttttacagttccaattatggtgtagttcaaaaattgctcgactaaactgcggtgtaacagttaaatgggcagatggaataatgtaatcatactgttccctct

SEQ ID NO: 23343 - DNA, 415 bp, Zea mays
  unsure at all n locations
  Clone ID: cC-zmle189047a03a1
ttttaatggatatcaacaattaaccagcaggaaacaaaaaccaccactattgcacaaacatggttcatcttagtgtacaacgccaactcatcatctcgacttgcctatgcaatgcaacgtgaaacaaaagacacacatgcatctcgcagcatcaatcaatccacgtacgtacaccctctccgatccgaaagacaatgaagttgcatagcatagccgttgagcttagttgccggggacgaagttggtggcgtaggcccatgcgttgttgttgactgggtcagcgatgtggtcagcgaggttctcgagcgggcccttgccggtgacgatggcctggacgaagaagccgaacatggaaaacatggcgaggcggccgttcttgagctccttcaccttgagctcggcgcccacgcgtncg

SEQ ID NO: 23344 - DNA, 389 bp, Zea mays
  Clone ID: cC-zmle189047a04a1
aaataaattaataattttaatttggaatggggggggggggtgaatataaaaagggaaaaaaaaacatatggaaaaggaaaaaaaaaatttaaaaaaaaggataaaaaaaaaaaaaattttaaaggggaaaaaaaaaaaaaagataaaaaaaaggggggggaaaattattttttttggggaaaaaaaagggtctaaccggggatatttttaacaaaaaagaaaaaaggccccccctggggaaaattatttttgggggaacttttcgtggggaaggccaaggggggtccctgggggaaaccctaaaaaattccaaagccccaccggaggggaaccctttttttaaaaagggaagcttaaaaagggtgaaaaaaaaaaaaaaaaattttttg

SEQ ID NO: 23345 - DNA, 374 bp, Zea mays
  Clone ID: cC-zmle189047a05a1
gggaaaacccgccaaaagcccaaggggaaccccccaaaaaaccccgggcccaaaagggggccgccttccccaggggagaaaaaccaaagggccccccccgggggggaaggaaatttcgggggatgggcccctttaagggaaaaaaacccaaaaaaaaacctctcaagggcccccaaaaaaaccccatgggccccccgaaactaaaggggtgggttccctccaaaaccccgggttttggacccttcaggggaacctggaagccttttcccccagaaaaaacttttggaacgggagcccccaacaacacggggatttggtgaaaccccaaagggtgaacggataaatccccccccgaaaccacaggggcccccttt

SEQ ID NO: 23346 - DNA, 571 bp, Zea mays
  unsure at all n locations
  Clone ID: cC-zmle189047a06a1
ttttcctatttacagccagtccaccatttaatgtctccttactgacaataatggcatccaacttctcatcagttatggatgggccataagggtcctcaataggctccacttgtactatcagttctggctttatagactgcatatgacaacagaccaatcatggattattgtcaacacatcaaatggtcgacaaaacacagatacacaaacacataggcatattcttctttgtagttccttccccaaattacccaatgcaaggacatacacaatggagatatggaacttataactcctacacattaaaagccatgtatctccaaaattgagaacatagggctaatttccatttcagaaactccatccaaagtaaactatgcttaacgacttctgttagataaaaacaaatctctagccacatagcagtaacaatatacttctatttcatctgcaaaactgacaaatttccgtatgaaaagaactactgatgcttatgcacttctcccctgcatatataaaacagattggcatccatccccaaatacttctatngcataggagcagaaaccgc

SEQ ID NO: 23347 - DNA, 189 bp, Zea mays
  Clone ID: cC-zmle189047a07a1
gtccactcgttttttttttttggaccaaacacaaaatacaaacgggcttggatccaacttaaaaaaaccaccccacccttattcattccctggtatacatgtgcattatacctatccttttgtatagattgtcaataatgtccctaactacaaaactgtgggaaaatggcaactgttcctaaactttat

SEQ ID NO: 23348 - DNA, 154 bp, Zea mays
  Clone ID: cC-zmle189047a08a1
gggacacaagcaggatcattttaaatcttgagaagatatagggcaacaacaaccggtacattacgacagccaccaccatgagcaaccggtgctctggatcagaccaaaaccatgacaacgacagactagaactagagttcttcaatgtttcgac

SEQ ID NO: 23349 - DNA, 397 bp, Zea mays
  Clone ID: cC-zmle189047a09a1
cagccatgctttcgtcgtgaactacgggaccgggtgatcattctgcatgcaggggggctctaatcatgctggctgttggcggcctaatgccatgctgcgtttttctcatgcgctgctcttcatgccgtcagcagctgtgttgccagggaaagcccagtgcggcttggccagggtgcgcttcgtagccttcactgacagtgacagtgggctgtccttgcccatgaggcaggttccctgcttgacgttgcagacggggtagtcatgggggcagcagctgtagtggtcgtcgcagcaggtggcgccctcgagcgggcagcagccccaggcgaagcagtacttgccgtactcatagatgcagcagcaggtggtgctgtcggggcacgagtagtagttgtcg

SEQ ID NO: 23350 - DNA, 346 bp, Zea mays
  Clone ID: cC-zmle189047a10a1
cacgctacgtgctttcctgctgcacgaataatagtgtaacatggagtattccagtcaaaattttgggacatgcgtaatcactgaaaatgtgactgtccacctgtgccgacaatactgaataatctcaactagtcaacagctgtgatgatggcatcatgcgtaatctggcatgaacttcctaaggaatttgattggttgggactcctgaggcgcgagctcatcgaacggaacatagtatctctccttggcggacacatggcatctcgtcagtatcgtcttcatcaatcgccaattccagttggcttcattgacatacttgccccggacgcgtgggcggacgcgtggt

SEQ ID NO: 23351 - DNA, 507 bp, Zea mays
  Clone ID: cC-zmle189047a11a1
ggcaaaagaatcaaagataactgcgctagtgataaatacaggtgtgaatgagaaaacctgaatccatatgccaaaaacatcccaatcacagcccagatgtgggcaacaaatttatacaaacgccctctcaaaggctcctctcgaaaaaaccaaagatcctctcctccatgtagatccgatcaccaaggcgtcgtggcatgtgcctctcgtcagggaaaaggaggatttcatagggcttgccctctgccattagcgagttgatgagccttgccgtgtgcctgaaatgcacgttctcgtcaatcatcccatggatgaggagcagcttccctttcaggttcttggcgtggtacattattgacccgtactcgtaagcatccggatgctccgcgggcagacccaagtacttctctgtgtaaaagggtgtcgtaaccatcccatgctgttaccggagcaccagacaccgcacaacagaatgtgtctggaaaccttgcgaggcacattgctgag

SEQ ID NO: 23352 - DNA, 428 bp, Zea mays
  Clone ID: cC-zmle189047a12a1
acacatatggaaatgcaattgtccggtcaatatagcatctcgcggtttgtgtctacaatatgattgacgaaagttccacatgctgtaaattgccaacatttttttaacataagatgccattacaccatggttaaactcccaataatcatcggggcatcttgcttcgaatgcttactgcaagaagagggacctcattctctttttgtcatccaaatattagttcttgtatttcatgggctctttctcaaatccaattgttgggaattgttttgcaaattcctctacatcatggcgaagctttgcaatctcaacttggatgctatcagattgcaaaggggcaacaaagtccttcagctttgttccacctgtcgttgcagccttaatcttcaaggccagattcactgctgcatcgaagaagtcagcaactt

SEQ ID NO: 23353 - DNA, 567 bp, Zea mays
  Clone ID: cC-zmle189047a12d1
cataccattactggcttggctgttgcgctcaaacaggcaactactccagaatacagagcttaccaagagcaagttatcagtaattgtgctaaatttgcgcagagcctgatttcaaaaggatatgaactcgtctctggtgggactgacaaccatttagttctggtgaatctcaagaataaggggatagatggttcaagggtggagaaggttttagaaagtgtgcatattgcagcaaacaagaacacagttcctggtgatgtttcagctatggtgccaggaggcatcaggatgggaaccccagcccttacgtcgagaggatttgttgaagaagatttcgctaaagttgctgacttcttcgatgcagcagtgaatctggccttgaagattaaggctgcaacgacaggtggaacaaagctgaaggactttgttgccactttgcaatctgatagcatccaagttgagattgcaaagcttcgccatgatgtagaggaatttgcaaaacaattcccaacaattggatttgagaaagagaccatgaaatacaagaactaatatctggatgacaag

SEQ ID NO: 23354 - DNA, 407 bp, Zea mays
  Clone ID: cC-zmle189047b01a1
ggaccaacaccggaacttttttattattcttccatcgggcacaacacgggggggttttttttccaatccccatagcaaccataaaagatttaccggggtttatagcattggtggtaacccctaaatccgccgccaagtaaccccccaaatcctttttaacttatgtacaactacaaaactggacagtttttaaaagtttttgcagcctggggcaaatggttttataagggcaggggggtcttgatcatggatgaaccagttgggtcaaaaaggaaatgcctgacaagggtcattcccaattgatttggagctttcgcaaacatgttaaatgagaattgtttgaaatccacggatgaaagggtcgagccaagaaatccttgccaaattcattttgggaccctgaaaaa

SEQ ID NO: 23355 - DNA, 468 bp, Zea mays
  Clone ID: cC-zmle189047b01d1
gggtcgacccacccgtccgatccaactgaataatgaaggcatacaaacattcttcgtagcctttttcagggtgccgagatggatgtggcgaggatttcttggctcgaccctttcatccgtcgatctcatactattctcattctacatgtttgcgatagctccaaatcaattgcgaatgaaccttgtcaggcatctcctctctgacccaactggctcatccatgatcaagacctacctgaccttataaaaccatttgcaccaggctgcaagaactcttagaaactgtacagttttgtagttgtacataagttagagaggatctggggggttacttggcggcggatctaggggttagcagcaatgctataatacactgtaaatcttttatggttgctatggtgattggatagagaagcacaccgtgttgtgcacgatggaagaataataagagagatcaggtgatggtca

SEQ ID NO: 23356 - DNA, 376 bp, Zea mays
  Clone ID: cC-zmle189047b02a1
aacgtaggacaagtgccacacttgcaccgaacaaaaaaattaagcatccagaccaatgcgtcacaaaaagtcagttaaggaaaagggtctgcagaaatccttttattcaggtagaaagaagctaagaacatatcacaatctttgtacgataaaagcggagatcctttatgatgaggtcaaacaaaacatgtttctacggaatcaaaaaagcttgacacagtcgattctgtaggcattccacccaaaccccgtgcacatgctatggaaaccacccaattcagggcacaggaaaattattggttcttcacggacatggaaatggcatcataagagttctctccaatctcttcaatatccccagttatcgttacggatt

SEQ ID NO: 23357 - DNA, 581 bp, Zea mays
  Clone ID: cC-zmle189047b02d1
tctaaagattcatactcatggatatcccatatatctctgattctcagataccaatgtgtttttggtctgagcatctggtataacaattgccccagtgtttgtaaaactatactgttagatggacaagttattatatgtacccccattagtatttctattgaatacttgtgttgcaatatggtagcattttttttactacaagctatggaaatgtaaggctatgtatcataccttggtctattaagaatacgttactctgtacacatacacctcagtttgttgcgatggatgccctacactagtccttggtatatttgctatagtgtgcctgtttggcagacctacgctctatgattctatagatctgttagccgattctctagtagagtgattccctagcaagcgtgcatctatgtgacgaaaaatgtttcacaaatagtctacgaagtgattcctgaggggtcggagagtgtggatcaggttgggagcggtggggagcagtttttttttttggctcccactatagtacaaaacagagactagattcactcagctcccaccatggagcagttcagtttttt

SEQ ID NO: 23358 - DNA, 492 bp, Zea mays
  Clone ID: cC-zmle189047b03a1
ttttaccaaaatgacagacctgagctccgacataacatattcatataaccaaaataaccaattcaaggcaattaaatccaccccctagttcagctaattatagagcagcacctaaaattccaataaagtatacaaagtaattgcattctagagataggtatcaagcaaaaattgccagcaatttctgaatcatcagaaacattcagctggagaggacgccatcattcagtgatagattacccagctgctgctcggtggaggcattgctctgatggagatgctgggctgagcggagaacctccatggcttgagcaaccttagccttgagagcatctggcgactccagcaggtgaagaacctccgtgtgggccatctacaaaagcatgccagtgaccttggcagcctgctcacgcttcagctgttcaacaagaggatacaggttctcaccaagcatcagtctttgctgatctggtgaggcgttagcaagcgcag

SEQ ID NO: 23359 - DNA, 344 bp, Zea mays
  Clone ID: cC-zmle189047b04a1
aaaaagggggacgccgagaatttattgaagcgcgcacacacggacacgggacgggatttggagctcggcgacgatgtgtagtgtagtttagtgcacccccgacgacgacgacgttaaagaagagtgtgcagcaacagcgagcttccccaggtgcagcctgagcgcgagagcctgcagcgccaggagcaccttggggacctggtccttggtgtccgggtcgacgaggttgccgtcgtcgtcaaacttgctgggcggctggtgcgccctggtgaacacctcgggcttgttgaccaagtggaggtcgaggaagacgccgacctggcggacgtggtactgcgagcggc

SEQ ID NO: 23360 - DNA, 322 bp, Zea mays
  Clone ID: cC-zmle189047b05a1
gtccggacgcgtgggcggacgcgtgggcgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgt

SEQ ID NO: 23361 - DNA, 313 bp, Zea mays
  Clone ID: cC-zmle189047b06a1
gggaatggaataatttaaaattaaaataaattttaataattgtgcaggaaaataatgggtaaaaaaaaaaaatcaatcaaaaaaaaaaaaccaaaaaaaaggacaccaaacaaaaaaaaaacaaaacaaaaacggcggaaaaaaaaaaaaaaccgcaaaaaaaaaaaaaaaaaccccccacccaaagaagggcccacccccaaaaacaaaaaaaaccccaaagtttccggaggaggggcaaggggcgggaaagcccgaccagaacgggacatggagcacgggagaccccgggggcccggggataaccccggaa

SEQ ID NO: 23362 - DNA, 473 bp, Zea mays
  Clone ID: cC-zmle189047b07a1
ttttgctcttgttttttatgaatgagagaaaagtcattattagcttgctttattcctaaacaatgactcgcatgcgatggcctgccgacctccttattgggtacaacacatatgcctatctctagaatgcaaccccaccaaagggctgctgctaaaacaggggagaaatcggcatggctgcggggctgaacatgaatggctatgtgttgatgcagtataatgggccagagggaataaaagaacccttgtggccctgtcctcaggtggggcatgatcatcgaggacgccatgctgggactaatcatacgtggtatcacactcggcactcttaataggtggcctcatacttggcgtcttatgcgaaagcatcatactcggcatcatcattggtggaaccatgtttggcatcctcatcggaggcatcctactagctatcgtacttggcgacataatatactgcaccatgatcgatg

SEQ ID NO: 23363 - DNA, 396 bp, Zea mays
  Clone ID: cC-zmle189047b08a1
agcccgggaagctgggtttattgggattcactggcttttacagggtacgaacagcgccagaatcggagcccgcaggcacagttacatagcaaatcccaaacctcactggcagaagcacaacctctggagcaacattcagtattataagttcatcagggcagaaacaaaccacccacattttattacaccacagacaagctttactacatcctagcacagcacctgggtatcccgagccttcaggggagttccttgaggaagtcggggttgtcaaccaaaaccactttccagccatttggatcaacaaaagaggcgatcttagtgttgatcccaggtagaggccctggctgccgcaaaatcttgccacctagttctttggtcgccagatcaaccgcc

SEQ ID NO: 23364 - DNA, 465 bp, Zea mays
  Clone ID: cC-zmle189047b09a1
ttttgttggacgcaaatgacatcaacatgctaacatatgagcagttcgactacattaatgatatgttttgttagaaacttgtcgcatggtttcaacatacatacatgtgtgttcacctcgtcttaaaacaaaccaaataatggaaaacattgtctgcaaaattccagttgatttatcctgctagtattcatatactaccaagagagggtagcatcaatgctaaatggaagttgatatacataatggttcaagaattttgaaacaggatcatcaaattgagcaatgtatatgacaggcatccctcacttttatagctagcgccatggcaccaattagcaggcaaacatttttgagtttggacgcaaaggacattaagctgactgtatggagtggttagccaacatcaatgaaatagcatggataaagcatacaagcttgttcatttcacctacaaactcagattag

SEQ ID NO: 23365 - DNA, 278 bp, Zea mays
  Clone ID: cC-zmle189047b10a1
caaaaaaaaaaaaaataaggggggccggttttaggaatttttttaaacccaaaaaaaaaaacccccaaaaaaagggggaaaaagggaaaaaaaggcccagggggccaaaaaccggcaaaagcgggaaaaaaatcccgggaaggggcccaccgccaaggggctcaatatgggaagggcaacaagggggcccttgggaacccgggacaggggcccaaagggggcagggaaaccaagggaaccctgggccccagggacctgggcccccttgggccggggga

SEQ ID NO: 23366 - DNA, 370 bp, Zea mays
  Clone ID: cC-zmle189047c01a1
gaccattacccgactttttaaataattttccacagggcacaaaacgggggtcttcgaaaaaaaacccccatagcaaccaaaaaaaacttacggggggggagagcacagccccccccccctagaccccccgaaaaaaaaccccccaaatcctctttaactaatggacaaacccaaaacgggacaatttttaagagtttttgcacccaggcgcaaagggttttaaaaagaaaaaaaggttttaattatggttaaaccaattgggaaaaaaaggagatgcctgacacggttcccccccaaaaaatttggaggaaccccaaacctgtggaaggaaaaaaaaaagaaaagggccgcaaaaagggtggaacaaaaa

SEQ ID NO: 23367 - DNA, 349 bp, Zea mays
  Clone ID: cC-zmle189047c02a1
aacgtaggacgggggcctttcttgcaccgaacaaaaaaaacaagcacccataccagggggatgcacaatgcccattaaagaaaagggtgtgcataaatcctcctattcaccaagaaaaaacccaaaaacaaatcagatcctatgaccgaccaaaacaaaaaaaccctatgaaaaggttaaacagaacacgtttccccagaatcaagaacgcgcgccccggttaaatatccaaacattgcacccaatccgggggccaaaggtccggaaaccacccaattgaggttttaggaaacctattgaatcttgaaagacacgggactggcaacaaaaaagttccatccccccggag

SEQ ID NO: 23368 - DNA, 392 bp, Zea mays
  Clone ID: cC-zmle189047c02d1
cacccgtccgacaacagatgcaaacgaagcaaaccacaacaagaagatgcgtttttgacaccaaagggaaaggggcggggcagggtggcataacaagcgcaccaccgctagcacccgaagagcgagagctagagacagcattatatggacgccgacatcgtctgccacagaagacagcggatgggcagcagggccgagagcttccccacgacaaagcctggggaggcagcgcggaagcataaaagactgggataaacctaacactgttgccccaacagatacacccgatgcaggtgcaaagaacaccctgcaccagggcgaaccagaaggggtcatccgaggcaagaagggcaacgtgcgcactactatcatgaaaaccgggatgcccatga

SEQ ID NO: 23369 - DNA, 313 bp, Zea mays
  Clone ID: cC-zmle189047c03a1
tagcacgcgcatgatcaccaaatgcttgggcgcgcgcagaccccggaaccaccagaacactttcaggctcatcatgcggtacaccgcgttcacgatctcgggcgggagggggcgggacatctcctctaccaccgccttgctgctcacggcggacgaatccccccacccatcaatgctcgggccggctactccgccatcgacagttgtacgctagacgctagccaactcggcgatgcgagttaagcaaaagcttcttcaaagggggaggggactgataaaactcttcctacattgtataaccttactgacccct

SEQ ID NO: 23370 - DNA, 548 bp, Zea mays
  Clone ID: cC-zmle189047c04a1
ttttgggcaggtaaatagcagtagttgataactaattgcagacaagtcattgttttacacagcatcattcaaatccttaactggaatcaaacaaagtgctcaacgaacagggcaccaaaaacttgcacaggaagaatccttatctctcgggcgctcaagacacagaacacgggtacgatatacctctcacatgaaaaggttgggcctggaagccttgaaagtggtccggagcttcctggtaggcggcctgaccttgcggtacacaagcgggaacttgatctcggagttgtggaactgcttggtgttgtccctcttgcacagcttgaagtggaccgtcgctgtcttgatgatctgtatgcagggggacctcacgcggtggcgggaggccatctcgttgtacatctgctccactgcgccgttcaaggtggtgtcgcggtactccttgtacatgttgtggtaaccagtcctgctctggtagcgcagccagaagccatagtttctgatggtggtccgggtgcgctcaagatctcgttgatggcaagcatctg

SEQ ID NO: 23371 - DNA, 128 bp, Zea mays
  Clone ID: cC-zmle189047c05a1
ttatttttttttttaaagaccgactcttgaaagtaagttaacgatcactagcggactcgtcctgaacacaaacaaggctccacaggtgcaggcatgggacaatgcggaggactctatatcgtcaacaa

SEQ ID NO: 23372 - DNA, 375 bp, Zea mays
  Clone ID: cC-zmle189047c06a1
gttgtacggttgtttatttgtgacactttcctctaacataaacacctgatcccattattggtacgctggcccacaaagcgacgcaatggatatgccccatccgacaaagggggaaaagcttttctaagcaccggagggcggatctgccccacaactgacctgggggcaaaaatccaggggccaaaaaagaaccgaaccgggggggaaaataaagcaaatccggggcaaaatggctccccacacctgcaaaaaaaagcaacgggccaatatccgcacagtttgggcaaaaaaaagggaaagcaagcccttcactaccaacaacccgggggaaaacccccaaacgaaccggggggggcccccctccctggaagaaaa

SEQ ID NO: 23373 - DNA, 515 bp, Zea mays
  Clone ID: cC-zmle189047c07a1
ttttggggcaacacacagtacatttcaacggtatcaaataatttaccctgtttatttcaatcaaatgaacaaattaccattacaaacaaacacaagctaaattcaaacaaaacctgcgcttgcatgtactctggggaacaaaactaccccaggctcactttgtcttttctttcaaaataaggaaaactatggtcatggtacccacgctcacgcacctcacagatcgctgaattgtttctggaatgtgggattgatgcacgcaaatattgattttttctttcgctttgttccaaacaggaagtttcgcaacggtacccttgtccgacttggaaaatgcttgaattgtttctcgtggctactttcggtctctggccgcgacaagcgttgggatgaaatctcaaaactctcacgtagcccctccagagcatggctaactttggcttgaagccccctcatgtgttctgatgctgcctgcatctcgccctcaatcttgctggtagattgctgcatgttta

SEQ ID NO: 23374 - DNA, 481 bp, Zea mays
  Clone ID: cC-zmle189047c08a1
ttttgggcaggtaaatagcagtagttgataactaattgcagacaagtcattgttttacacagcatcattcaaatccttaactggaatcaaacaaagtgctcaacgaacagggcaccaaaaacttgcacaggaagaatccttatctctcgggcgctcaagacacagaacacgggtacgatatacctctcacatgaaaaggttgggcctggaagccttgaaagtggtccggagcttcctggtaggcggcctgaccttgcggtacacaagcgggaacttgatctcggagttgtggaactgcttggtgttgtccctcttgcacagcttgaagtggaccgtcgctgtcttgatgatctgtatgcagggggacctcacgcggtggcgggaggccatctcgatgtacatctgctccactgtgccgttcacggtggagtcgcggtactccttgtacatgttgtggtaaccagtcctgctctggtagcgc

SEQ ID NO: 23375 - DNA, 438 bp, Zea mays
  Clone ID: cC-zmle189047c09a1
ggggttggttttattaccttaaagaaacgcactagtcgaaacccatctcacgggaacaacatacaaccaagtgtgtccacaacgccctaaaaccaaccaaaacaaagaaaacaccccccggaaaacccccgggaaccaccccgccagcccccaaagaccacccacagagcgtagaatgagcgcccaaagaacgtggaaacacataccgctccaagaatcccggaacaaaatcattaaactgagcaatgtacacaacaggcaccccccaaaattataaccagcgcccacggggcaaccaaaaggctcaccattactcacattgaacgcgcgggacccaatccccactttatagaggggatacccgacagcaccgaagccccaaggacaccgcccccacgcggggaaacgcacctaaaaactaaggggagagagcaaaaa

SEQ ID NO: 23376 - DNA, 517 bp, Zea mays
  Clone ID: cC-zmle189047c10a1
gaggggcaaccccgcatatttattggccacacattacattacgacgaccaagccatcatataccaacacacatgacatgacatgacatgacagaatacacacagatgagcctttagactgtcttcagcggttacccctaaatttctctccctatatcccactcacgtgccacgtcagcgttctcttcccccctatatctccactctgtacagcgtttccccctaaatccttcccctataccccactacaaccataaaatatcattttctatacctacttttcacctcctatcaatttttcatctactaataattggaagtgggcccacgtgaacaatattagagagggtgagagaggcaccacagaacgagggggagagagaagctggctagggggcacatccgcgtagagcgcctggtagcgtgagccgttgatcggctagcgtgtgcactgtagcccccaaattagcgtgggggagcggcagtgtgatcccgtgaagacagtcttatattatttc

SEQ ID NO: 23377 - DNA, 484 bp, Zea mays
  Clone ID: cC-zmle189047c11a1
aatcgataattgatgatgtattgaagaacagagttttgaaccatggagcagtttggaagttttacatgactggaaaaaaaagggagatgggattgtagcttttatgagcactgctactagtaatgttcacatagcatggctctgtaataatactgttgatcaccacatccaccagcagaaggcaatccggttgccaacgaggaggcagcctcagacaagcacctgagctgcagctagcctagcaatcggaaccctgaaaggggagcaagaaacgtaatccagcccagccttcgcgaagaaggccacagacgaaggctctccaccgtgttctacacaaatgcccaccttcaagttaggcctagctttgcgggccctatctgtagcaaacttaaccagctgggccactcccctctggtccaggacctagaaggggtcatgttggaggatgccctgagcaagatagacgggaatgaacttttccaca

SEQ ID NO: 23378 - DNA, 429 bp, Zea mays
  Clone ID: cC-zmle189047c11d1
cccacgcgtccggttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggcggagagccttcgtctgtggccttcttcgcgaaggctgggctggattacgtttcttgctcccctttcagggttccgattgctaggctagctgcagc

SEQ ID NO: 23379 - DNA, 469 bp, Zea mays
  Clone ID: cC-zmle189047c12a1
ataatttttttttttttttttttttctcttgctcgggccgggaaatcctgaccggttcctgaaagcgtaccaactatccctatcgtgagtcgaataaaaaccgggcggggtcatgggcactgctgatccctgccagaaaatgtgatccgctcacaagggcacacaacataccaaggcggaaacacgaacgcgcaaagtgcagcccgggactaacgaggccagctaactgcacagcgaaccgaccttgtccctaacatggccgcttgctcaagacctgaggcgctctcatgccacattgcatttaatgctgtgggaacaacgcgctgtcgcgaagaagtccccacaacgatacgcacccggaagcattaatttgcacaaccgggacgggcaaacaagtgatcgcccttcaccccctggccctgagcataactgccccatgcgccccacgcaaacttgtcccagcacgcga

SEQ ID NO: 23380 - DNA, 435 bp, Zea mays
  unsure at all n locations
  Clone ID: cC-zmle189047d01a1
gattcctcatgaaatccacagttcgtttccaagttttactaatccctacttctgtacatcgttagttgcatattgcatccaaactaaaaaaaaaaaacagaaatgacacggcgcgcgagtcacccgggatgagaagctagctggacgcctgcaacttaactgcgaagaagcgagccaagaggaaggaagcantgagtgtggtgtggtggtgcgtgcgcgtcaatcgtgcgtgtcacgactccacggcctccgggatgctctgcagcgcgggcttccagtgcgccgctctgcagtggtggaagacctgcccggcgtccatgacgtccgccagcagctgcgcggcggcccgccgcctcttgaggccgtggagcccgccggccctcttctccatcagctgctgcagctgcttcctcgtgatcctgatcgtcacctccg

SEQ ID NO: 23381 - DNA, 359 bp, Zea mays
  Clone ID: cC-zmle189047d01d1
ggtaccgtgtcgggcctatccgcgcattcgaataatatacattcatatatcaatactgtcatgacacagtaagcgtgaagaatgctacagtaattacctaagatgaagagtatagaaacattgaacatcatggggaaggacctcattccttctgatggggcacgcgcgcttccatgatctattcatgcaaaagcgcgcgggaaagcaaaacacggtgaagatcagggcgggacgcacgagtggtgtgcctcgcactgggtcgcagcagccgtcaaagactgcacagtatgagcccctgccaacgtcttgcactgatgaaggctggaccaggcgtggtatgaggcgacgatctagaccac

SEQ ID NO: 23382 - DNA, 472 bp, Zea mays
  unsure at all n locations
  Clone ID: cC-zmle189047d02a1
tttttcactgaccaagaaacacctttaggtttcaaaagcaacaatgtcttgtctcacaaaacaatacaatacttgaatcaaacacctacttcttaaattatttacatgccgaggctcagaatacttatcactttggaagttggaacacaaaacgaacgactctcaacattcgttctcgttcgttcattcattcacaggccagcttggtgtcgaagctcgtcagacatatggcgaaggcctggaaggccgacagcgggtaccggtagtccatggtgaacatgtccctcccgaccttgccgaactgcaggatcaccgggtcatggtacgacgacgacnaaaacggcggtggcggggggccggaagcctgcggctgcggctgcgtctttgcaggagctatcagctggaagttcttgaccgaggccacggtgacgcgcccgcggaagttgaggcaccagcactgcagctgctcgtg

SEQ ID NO: 23383 - DNA, 287 bp, Zea mays
  Clone ID: cC-zmle189047d02d1
attgttgggtcgccccacccgtccggtgctgggaaccccagggcccatgcggatgcagtgcgctatgcattccatccccgcatcagcggtggagcccggcggcgtggtgcctgggcaaccgaaagagctcctcccgaggctgttcgacgagtccttccgcagcaccgcaacttgctctttctccaagtactccgtcgcggacagctccatggacctgggcagctgcccgtcctccgtggccgaggcgggcggggggagtctgcaagaaggagacgagtcggaaaagg

SEQ ID NO: 23384 - DNA, 446 bp, Zea mays
  Clone ID: cC-zmle189047d03a1
ttttggttttatttttttgattttttttttttttttattgggtttttttttttttttttttgatttttttattttttttttttttttaggaaaccgaaaaaggggatttcccccattaaaaaaaaaaaagagggggggtggacccgcggaaaaaaaaaaaagggggggaaaaaaaagggggggaaaaaaaaaaacccgcggaaaaaaaccaaaggtccccagggaaaaaaaaccaaaaggggcaggggggggggggccccggggaaaaaaaggggaaaggggccccggcccccggggggccccccgggaaacccggggggggcccctaaaggcccccccaattccggagaaaaaggggaaaaaaaggggaaaggaaaagggggaaaaaacccaccaagggaaaaaaggggaacccaaaaaaaaaaacccagggggcccaagggggg

SEQ ID NO: 23385 - DNA, 411 bp, Zea mays
  Clone ID: cC-zmle189047d04a1
cgagcgaaagaataacaaacattggtacccaagattgtttgctttcacaacgttacaacatatatatatcatatatgcatggacaggtacaatgcctctccagcagcaccagcaacaagggtggttagcagcagggactataaacaacagagtaccatccgcgttgatagattttttattactgcaaaattgatccccgcagcactaccggtagttgcggtagacgggagtgtacatgcagttctctgcatatttcaccaggacaacttcgagaagggctccatcttcccacccttcaccagcatcagaaagatctctgcgcacatcgctgcagccgtggctgcaaaagcctacgagctcggtctggcgacccgtctgcatatttcaccaagtcgctggggggaggcagac

SEQ ID NO: 23386 - DNA, 246 bp, Zea mays
  Clone ID: cC-zmle189047d05a1
aagagcgtgagtgtaaagtatggtgaccattcgtaccggacacttcctgaacaaagaaatggtcgcgaatgggcgggactcggacaatgcggaggactctatattgtcaaccgaagcaatcagcgataggcgcgctaagtacatcatggccaacctaccacacaaatggtcgttcatcaacaagttattcgccaaaagcgaacgggacctaccggtgtagcgctgagcatacgcatagattcgggg

SEQ ID NO: 23387 - DNA, 507 bp, Zea mays
  Clone ID: cC-zmle189047d06a1
atgcaagaagcaagcaaatgaacatgtaaatataagaagagacttggtaataaaattacacaaggatcatcatgcacatctcaaatcatgccaccaccgtaccagcagccaaattacaatatactgtaattaatagaagaagaagttctttaatttggatcccggctggggcgtgcggcgtacgtgaagtgtgattagtcgaaggtggccttgccggtgaacttgacgtcgatggggttgacgttcttgccgatgctgcggaagttctggccgacgccctccctgccggggttgaccttctccgggtagacgccgtccttggggtggaggtactgcacctcgccgttggggaagacgcggtagaactggtaggtgatcttgtacttggagcgcaacctggtgccgagcgccaggcactgctccttgcgcgccagctttaaaaggttggggccctcccgcatgatggcggcgccgccggtgggcatctcgaacacccgctccttgggg

SEQ ID NO: 23388 - DNA, 316 bp, Zea mays
  Clone ID: cC-zmle189047d07a1
aaaaaaaaaaaatggggggtgaccatggggccaaggccaggcccaaacccccccctttttgaaaagcccccccccttttttggaagggggcccccccccccccccccaggggcctggtccgaaaacccggggaaaggccacaaaaaaaagggggctaaataaaaacgggggccccccctttggggggggggggggcttttttggtggccggaacctttggggaggccccccgggcccaaatttggggggggcctgaaaggggggcctggcccccccggagcctaatttgggggggggctggcccccaattgggggg

SEQ ID NO: 23389 - DNA, 207 bp, Zea mays
  Clone ID: cC-zmle189047d08a1
atgatgacaacaatttatcttggggagaatttcactggacaattcataaacaaaaccccgtccccatatgggacgcatcaggacaatgaaaataaatctttttttttcacggctccaatcaacaaaattctaccttagtacctctttgccaatttactccaaaactcttctttgaccaacaagtaattcgccaaaacctatatgaac

SEQ ID NO: 23390 - DNA, 471 bp, Zea mays
  unsure at all n locations
  Clone ID: cC-zmle189047d10a1
ccacacatgcatcagtatatagacaatacagcagctagatgagctagcagcagcagtaacaacaatgatgatgatatgaccgttgaaaacaacgtcatgaaagtactaaagagtgactaaccactccatgcatggttcatctccacaacaacagtagtacagcagtaacaaacaaaatcaattaatacaccagctagatgaggtagttgtacgtagtagtagtaaaaacagtagtaataataactcagtaattaattagtagctttcaaggtatagatggacgatgagacgaccatatgcggatgcggtcagccagattattaccatgtggatgcatacataatactgctatagatggatggatggatnggatccatattagatgagatagatgcaactccgaaaatcaaatgggcggccggacggacaagaaagcgaggacgccggtgtgcgcctgcctaggacggcagc

SEQ ID NO: 23391 - DNA, 540 bp, Zea mays
  Clone ID: cC-zmle189047d11a1
gcacaacgaacaaagtatagacctctataacccaacttaaaaaatccacccaatccttattcattccctgttatacatgtccatttagctatacttttgtatggtttgtcaataatgtccctaactacaaaacgttgggtaagtggcagctgtacttcaacttgggatgtgagcggagtgcttgctgcagagccgtatccacagtcacaccctcacggaacaatttgtcatacatcaggcacatgaactgagccaggtactcctcatcatccacgtcatggttgccgcctttctccacatcactgtcctcccagtcgcttatagggctgacaggttcaggctctgattcgtccgcttcttcatcacggatgacaaacttgccattctctaggcttctattgacatccatcccatggtagactattgtcttggaatccggaggctcgatggacgacgagatgactgctttggcaccacaatccatgaatgccttgaccaggccatgagcaaggccatacttaccactgcatataatgatcc

SEQ ID NO: 23392 - DNA, 521 bp, Zea mays
  unsure at all n locations
  Clone ID: cC-zmle189047d11d1
cctatcttaggatggaggcgtgtggttttacttgtagaggcttcatttagtcctgattttggaaagaaaataaatcatgcacgttcccttgaatccttctgctcccagaatggtattaggttagctctaatgaatagcacttctgggtttgggaagccagccactgcacttcctaccccaataacttctcccttgtttactggaagtttcccatctagtccacttctatatagtccagagggcactcaacggatcagtcgaattgacctagttcctccacttagtttggatggccacccaactacaaagtcctcacctccaacatcaccattgaagtcaagacagccatctgcacatgttcggtcattgtatgataaactgcagaatatgcctcaagttggtgtgatacacttggctcttcaaaatgattcaactggttcagtattgagttggcagaatgatgtatttgtggtcgctgaacccgggaactngcagacaggtttctgcaatctgtcaaacta

SEQ ID NO: 23393 - DNA, 534 bp, Zea mays
  Clone ID: cC-zmle189047d12a1
ttttgaaacgagattcaaatcggctggcatgattgatgaaacaaatacacaccccaggattacactacacgactcccaacaggaaatggaaagcggaagcctgtaccagttcggtgactgcatacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgcggcgccgggccacttggccgccaccaggtgcgccagatcaaccacgcgttggctgtacccccactcgttgtcgtaccaggcgacgaccttgaccatgtcgtcgcccatgaccatgctgagcgacgcgtcgatggtgcaggacacgtcggagcacctgaagtcgacggacacgagcggcacgtcgcagacatccaggatgccctgcagcgggccg

SEQ ID NO: 23394 - DNA, 552 bp, Zea mays
  Clone ID: cC-zmle189047d12d1
cgtcgtcgtcgtgaacgacagcggaggcgtcaggaacgcgtcccacctcctcaagtacgactcgatgctcggcaccttcaaggccgacgtcaagatcgtggacgacactaccatcagcgtcgacggcaagcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcgggcccgcgcggcggcgctgaacatcgtgccgacgagcac

SEQ ID NO: 23395 - DNA, 531 bp, Zea mays
  Clone ID: cC-zmle189047e01a1
aaaacaaaacatttttgttttctaaagcaaggctaagcatcaaaaatctttttcgtaaaagggtatcaaggaagggaaatcaattggcaaggaaggaaatgcaccaacggtttagcacacaactcctatcacctaatgcaacaaacaaggtgataaagattttaaaacacaaggaggtggcaactacaccgggacttgcctgaataacactaggttagtgttgttagacgacatccacttggcgattatcttttgttttgatacttgtgtcgtttatccatcttcagattagttcatcagcttcatcctgcggattaacccgcgcttggggtcgacttgggtcttcttccgcatcacgcgattaattaacgtacctgaatggaatgcattatgcacatgaatgcatatcgacaaaaatattacaaacctaaatagtgctacgcgatagcgaataaaacacctagcggcgaggggttgtaccgttttattccgaaacactagttatcagcatatggctaagcgcaataatta

SEQ ID NO: 23396 - DNA, 486 bp, Zea mays
  Clone ID: cC-zmle189047e01d1
gctcgccccacccgtgcgccatctgatgattgcatccactagaattattagtcgttataattctcgtatttagcgcatgcgcgttatggcagtgttaaaaataagtgaagaacgatgggttcatttacgtgaaaggtacattaacttaaggatatctccgcgaggtgacgacataaaggatagatttactatttcatataaccatctgatgaattttgtcgttgacaattgcattaaataaataacataaacaaatgtcccatttattgttgacccgcaaaatatgtttggtgcgtactaaaactaaacctgggttttccgagccttgcagggtattccttaaaacaaggaatgttgttaaccattaaccattttcttgcgtgtgtttcatcagctaatgggatcttatgtgtattcccactgttagggcctttctcgctcagatccttaccccctatttttttggttagccatataccgactcta

SEQ ID NO: 23397 - DNA, 549 bp, Zea mays
  Clone ID: cC-zmle189047e03a1
tttttggcaatgctgatccatatgtcgtactcataaagttcacaatactggcttccgacctggtaatgttcacaggagtcataatgcaaacggcctccaaaattgaacgaaacaaaataaaattagagtgacccaggactttggatctgcagtaacgcagggacaggactaacaacaaactcttttttctcttttgcactcaacttcagctcacgtctgagtatgacgctttacaccgggcacgctggtacttcaagtgttgtacctgcctggatctggccccatccgatgaggcgccaatgcttctcaacgcgacggctcagagcaaccttctctcctcggctcgtgcagacaggcgcggtgagctgtagcttggcaagatcgttcttaacagcgaccacacgggcgcctgtggacatggaccctatgttaagcatgaggatctcacccttggtgagcttcgacaccttccctgccttctctgtacctttcgtcctcacacccaacagcctccggagtaggaagaaattgatctcaagctctacgtaa

SEQ ID NO: 23398 - DNA, 494 bp, Zea mays
  Clone ID: cC-zmle189047e04a1
gcacctcgtcctttaccccgtcgggcagcgcgccggactcgaagccgcggatgagattgggcctgacaacccacacgaaggggcgcttgctgtcggcgagcccccacgcgagctccacgaactcgtgcgggtccatggcggccatgctcccgaagctgacgtacagcacggagcccggctgctgcgtgtccagccactgcaggcagccccggtccgcctggaccaccccgtgcaggctggccgtggccgtcggcaccagcttgttgagcggggcgacggcgaacaccggcaccgacaaggccttgtggatctcggccagcgtgtctgtctcgatcagcgggaaggtgttgaagatgagccccgaggcgcgccgcgccgcggtgacggtgcgggccagcagttcggcgaactcctccaggtcggacgtgtcgacccggagcaggtctttgacgcggtacggtggtagctcgggtaccggatcctccttgcgctcc

SEQ ID NO: 23399 - DNA, 413 bp, Zea mays
  Clone ID: cC-zmle189047e08a1
aatacattacgcatggaaactaacaatatggtcagcacaagggaatgtacagttacggttacatacatcacatacctcccccaaaaaaggctaaaaaaaatacggaaaacctttgtcgtctgatcaagaatagcgaccttttttttttgttgtaaagccaaccgcactatatcgaccacacacgttctaaaagacagagatttacacagctatagccaccacaaccaggaaaagccgcctggtttccatcccatcagactatggatgagcagttcagtggacaatctacatacgagaatcttcagctcgattaagtttggccgcacagaatcttctgctgctgtccgtgcatccgagctcacgatgactgcgatagttggctccagttcatcaagcggtgccggacgcgtggg

SEQ ID NO: 23400 - DNA, 484 bp, Zea mays
  Clone ID: cC-zmle189047e09a1
aatcgataattgatgatgtattgaagaacagagttttgaaccatggagcagtttggaagttttacatgactggaaaaaaaagggagatgggattgtagcttttatgagcactgctactagtaatgttcacatagcatggctctgtaataatactgttgatcaccacatccaccagcagcaggcaatccggttgccaacgaggaggcagcctcagacaagcacctgagctgcagctagcctagcaatcggaaccctgaaaggggagcaagaaacgtaatccagcccagccttcgcgaagaaggccacagacgaaggctctccaccgtgttctccacaaatgcccaccttcaagttaggcctagctttgcggcccctctctgtagcaaacttcaccagctcgcccactcccctctggtccaggacctcgaaggggtcatgttggaggatgccctgagcaagatagacgggaatgaactttcccaca

SEQ ID NO: 23401 - DNA, 312 bp, Zea mays
  Clone ID: cC-zmle189047e10a1
ttttattttttttttttttcgctcaagaatgaagatggaaagacaggccacgtccacgtacgttgatcaaccaaccacgtgcttcatgtctacaacacacgcacgcacgcacgccgtggatacggaaacggacgctagctagctagcttcagtcggaccgcatgcggttgagctggttgagcgccggctggaggatgttgaagagcacccagccgatggcgggcgcgacgacgatgagcaggaggaggccgcggctgtcgtcggcgggcgcggcggcggcgattgccgcgaggtcctgcaccacggcggcgg

SEQ ID NO: 23402 - DNA, 439 bp, Zea mays
  Clone ID: cC-zmle189047e11a1
gcatgatgttccatttatatgggagaattagaattttagaaacaaaaaaaaatgtaccgacgacggctacgaatcaaggcgcgccgccggcagctaatgaatggtaaaacatactatggacgatcgggaatcgggaatccatccatccatccatccatgacggaatctagcttaatcgtccttgggagggtcggcgaagaaggagttgatggaggccatgatctcgggcttcttcccgcggacgaacttcctgaggccgtgcatagcgtacctctcgccctcgtcgtggttgtccaggacgccggccgccctcttctccttggtcacccgcacctcggggttgcccgtgatgttgcgcacaagctggtacgagcagatgcccaaggccacggccatcggcacgaacagcgggtacacctgatccatggacgcgcgcgac

SEQ ID NO: 23403 - DNA, 457 bp, Zea mays
  Clone ID: cC-zmle189047e11d1
ggtttacccacgcgtccggtcgcgcgcgtccatggatcaggtgtacccgctgttcgtgccgatggccgtggccttgggcatctgctcgtaccagcttgtgcgcaacatcacgggcaaccccgaggtgcgggtgaccaaggagaagagggcggccggcgtcctggacaaccacgacgagggcgagaggtacgctatgcacggcctcaggaagttcgtccgcgggaagaagcccgagatcatggcctccatcaactccttcttcgccgaccctcccaaggacgattaagctagattccgtcatggatggatggatggatggattcccgattcccgatcgtccatagtatgttttaccattcattagctgccggcggcgcgccttgattcgtagccgtcgtcggtacatttttttttggttcttaaattctaattcttccatataaatggaacatcatgc

SEQ ID NO: 23404 - DNA, 524 bp, Zea mays
  Clone ID: cC-zmle189047e12a1
agcccaaatagatctattatttccttcttttttgccaaaatccaacgagaagtcttgtgtggacacttacatgatctacataagtcttcaataaatcttctactgtactactttaagatgattttcttgatcaccacgatgtcttcatcgaaatccacgttgcaccgtccaaactatatttttaaacactagcaaacaattaatataaatagttatgttgatcatcaaacaccaaaacacttgcagtgattagggcattaaaacaaccaaaatagcacaaaacatagtcactgcagttctgaagcgtagaacaatccattgaagaccggaacatgctcccaaatcatcctgctacaaaacttggtacagcaaggtaacaaacaaaggtttcacagtttgatgattttgacaaatgggactttcgctgcaccgcagcaccttacgccttgagcttaccaaagaacctctgcttctcatcggtagtctggaagcgaccgtgcccaaatttggacgatgtgtcaatg

SEQ ID NO: 23405 - DNA, 402 bp, Zea mays
  Clone ID: cC-zmle189047e12d1
tttttgggtcgacccacgcgtacgcccacgcgtccgcggacgcgtgggcaaaggtaaaggttatgagggtgtggtcactcgttggggtgtcacccgccttccccgcaaaacccacaggggtctccgcaaggttgcttgtatcggtgcatggcatccggctagggtctcgtatacggttgcccgtgctggtcagaatgggtaccaccaccgcactgagatgaacaagaaggtctacaagatcggcaaggctggacaagagacccacgatgcctccacagagtttgacaggaccgagaaggacatcactcccatgggtggcttcccccactatggtatcgtgaagggtgactacctgatgatcaagggatgctgtgtgggtccaaagaagagggtggtgaccct

SEQ ID NO: 23406 - DNA, 523 bp, Zea mays
  Clone ID: cC-zmle189047f01a1
gccatccccatcaaccatggagtaagattcatatccaccactaatgccacgttaagcagaaatatccacaagaaccatcccgttgattcatcatgtgacaagaacaggcggcagcttcttaaagctggagctacttgctttattggaagatgtgatcgccctatccttcgaagcagggcctaaagcaaattctgaagaattcgattgctgattgttttcgctctgctctggtcgaacccagattttgatgaggccctcgcggcagatggtgaggatagattcactggtgaacaccataccagataggggatcggcatgtactcggtgggcaactaggggcgatagttttgggacatctcgcattctaggagaaggttgaagaacacctgttggagggcatgcattgtcccagtgtgtggaagggctcccgctgctaaacgtaggtgaggcacttgaaggatgccgtagtgggacaacaattcattcagtgccaggtcccacagaagtagttgggtgtcctgcc

SEQ ID NO: 23407 - DNA, 590 bp, Zea mays
  Clone ID: cC-zmle189047f01d1
gggcgaaccacccgtccgcccacgcgtccgtggaaacggagaaaatgtatatcgctttggttctgttgggcaggacacccaactacttctgtgggacctggcactggatgagattgttgtcccactacggcatccttcaagtgcctcacctacgtttagcagcgggagcccttccacacactgggacaatgcatgccctccaacaggtgttcttcaaccttctcctataatgcgagatgtcccaaaactatcgcccctagttgcccaccgagtacatgccgatcccctatctggtatggtgttcaccagtgaatctatcctcaccatctgccgcgagggcctcatcaaaatctgggttcgaccagagcagagcgaaaacaatcagcaatcgaattcttcagaatttgctttaggccctgcttcgaaggatagggcgatcacatcttccaataaagcaagtagctccagctctaagaagctgccgcctgttcttgtcacatgatgaatcaacgggatggttcttgtggatatttctgcttaacgtggcattagtggtggatatgaatcctactccatgggtgatggggatg

SEQ ID NO: 23408 - DNA, 455 bp, Zea mays
  Clone ID: cC-zmle189047f02a1
ttttattttttttttttttttttttttttatttttttttgaatctcaatcaatatattgattatttttaggaaacacatgccgctatgagggcaccattattgagtacatctcatatgtaatctaaaagatggcaccaccaacgatgggttgctgccacgacaaggcagggttcatcaaaaagaactggttgtatggcagcaattgttgctgctataggaaggcagcgaccaatgggttagccaccgctagtggattaagtaactgttgtcgctgttgtaggtacccaccaaagttcgacacagtcagttggttgaatggaagtagttgttgcaagtaggcagcagggtttgccacagcttgctgagtaagagctggtacaatttgttgcagcaactgttgttgcaacaactgttgttgcaggtatgtatgtgcattgcccatagcgagcgggct

SEQ ID NO: 23409 - DNA, 312 bp, Zea mays
  Clone ID: cC-zmle189047f03a1
ttttatttttttttttgttcgctcaagaatgaagatgggaagacaggccacgtccacgtgcgttgatcaaccaaccacgtgctttatgtctacaacacacgcacgcacgcacgccgtggatacggaaacggacgctagctagctagcttcagtcggaccgcatgcggttgagctggttgagcgccggctggaggatgttgaaaagcacccagccgatggggggcgcgactactatgagcaggaggaggccgcggctgtcgtcggcgggcgcggcggcggcgattgccgcgaggtcctgcaccacggcggcgg

SEQ ID NO: 23410 - DNA, 310 bp, Zea mays
  Clone ID: cC-zmle189047f04a1
ggacaagttggcggggcccttgggagagacgcagcgcgtgtgaatattactgagagatgatgagatgacagacaactccgcctcgatcggttctattttgcagcgccgctgtggaaagaaataccaaaaaaaaataacccccgtacatgagcgggtaaaaaataaaatggcggcaggacatgtctgacatcttgactgtttcagacatgctctcatgcttcagatcttcccgtgtggatcgaacgatctgtatcgacagcattttcccccccctccttttgggcttttcgctgggcgtcataaaattaaa

SEQ ID NO: 23411 - DNA, 396 bp, Zea mays
  Clone ID: cC-zmle189047f05a1
gtgaacattaagctgggtgccattacacatcatatacgtttgcttacagaagtgcaccctaaacacacgaggagagcagcagtaaactaacagctgcattcttgttatattttttggtcatttcttacgtgcatgctatacaaaagaaacttctacagtagtacaactactcacgtttttttacttcgactttgacagacagaccacgacgccgacggcagctgcagccagtagcagatgctgctagagaggcagcagccttccatgtgagtcaccgagtccccattaggggccggccagcgaacctagcgaggctggtggatcacgcgaggagcgctgctcttggggctgccggcgtacttggtcggcttctcggagtgcctgggtttctcccgg

SEQ ID NO: 23412 - DNA, 212 bp, Zea mays
  Clone ID: cC-zmle189047f07a1
gggcgtgtgcttaaactatggtgaccgttcgtaccggactcttcctgaacaaataaccggccccgaatgggcgggaccccgacattgcggaggactctatgttgcccaccgcagcaaccagcatcctccgcgctatgtgcatcatggccgacttaccccacaactggccgtgcatcaacaagttcttggccaaaagcgcaagggacctgccg

SEQ ID NO: 23413 - DNA, 176 bp, Zea mays
  Clone ID: cC-zmle189047f08a1
agcccgtgcgctgaaattttggtgacggtgcgtaatggactcttccttaacaaaaaaccggccacgcttgcgccggataccgacaatggagaggactcttaatttgcaacggcagcaatgagcatgtttcgcgctgtgtgcatcatggccaacttacctcacaactcggcgggcat

SEQ ID NO: 23414 - DNA, 489 bp, Zea mays
  Clone ID: cC-zmle189047f09a1
ttttgatgatatatatcctgggttttcatcttcaccaaccattacagcacagcaactgatgtcgagtggggagacgatgttcgacgcgtgctcagctcagctcatgggttccatcagtcgtcagtctcgcgtgcctcctcccgactgcagcaggaagaagacggcgaggccgacgacgagccccgacacggccagcgccagcgtcggcgccggagtacccacgcccaagttctgaaggaagcccttgccggtggccacctcgacggcgatcgcggaggcgaagccgaccatggccgcgcggcccagccatgtgtccggcccgccgcccttcttcgcgctctgctcgcacctgatgatggacagcgacctgctgctgacggccctgcaggagacgacgcgcctcttgctgggcgccgcagatgcgtggccggacacgcgaccgagcgactgcgccgcggcggcggccaccggcgactattagcggagggc

SEQ ID NO: 23415 - DNA, 531 bp, Zea mays
  Clone ID: cC-zmle189047f10a1
tttttgaagacacatgcaggtagacatacacatccacaataatattatgtagcatacacggtacaaccctcgagtttgtttctactttggaaagtttatctagtccatcaaaattcaccagctgcttgagtgcatcaaataaatgatggtttaaagaaaccaggaaggctacatttccttacacagaaaggagctccatcagtttgtattatttcggtaggaagaaatcaggaaactagtacaggggcaacatggctggcacattatgcagaagccgccaacagctccctttcagctcgctcgcggatcctccgctccaactctggcctgaagtgcctgataagcccctgcacaggccatgccgcagcatccccaagcgcacagatagtatgcccttcgatttgcttcgtgacctcatgaagcatgtcaatttcctccagcttcgcgtcaccaaccttgagcctctccatgatcatccagagccagggtgtgccctctcggcaaggcgtgcactgcccacaactctcatgc

SEQ ID NO: 23416 - DNA, 498 bp, Zea mays
  unsure at all n locations
  Clone ID: cC-zmle189047f11a1
gtacggcgacggcggcttgcggttgtgatgctggggcgcggtgtcgaggctgtcgctccggaccggccgcttcctggacggcgagccggccgcggagccgccgtcgtcggacgacgcggaggactggcggttggcggcggcggcggcggcgctgttgcccgccgtggacaccggcgccgccatgccgttgacctggccctgcagctccgcgtacttggccaccaccgcgcggagcatgtcgctgaggcgtctgttctcctcgccggctcgccggagctccgcctcgagcgcttgcacctgcacctgcacctcccggtctttctcgacggccaggaagtcctcctcgaccaggaccttggcggtgtgtggtcgcaggcggcctcgccgccgtcggaaggccgacgttgaggtccaggctcagggaaggctgcccgatcacgggtccatgtgcgccgccgcgagaatcaaangtacgtacgtcaggagcagcatacgggt

SEQ ID NO: 23417 - DNA, 571 bp, Zea mays
  Clone ID: cC-zmle189047f11d1
cccacgcgtgcgagcgcgactcctcagcttcctcctctccttccttccttagctgcccttcccgccacctctgacccgtttgctgctcctgacgtacgtacgtctgattctcgcggcggcgcacatggacccgtggatcgggcagccttccctgagcctggacctcaacgtcggccttccgacggcggcgaggccgcctgcgaccaccaccgccaaggtcctggtcgaggaggacttcctggccgtcgagaaagaccgggaggtgcaggtgcaggtgcaagcgctcgaggcggagctccggcgagccggcgaggagaacagacgcctcagcgacatgctccgcgcggtggtggccaagtacgcggagctgcagggccaggtcaacgcattggcggcgccggtgtccacggcgggcaacagcgccgtcgtcgccgccgccaaccgccagtccttcgcgtcgtccgacgacggcggctccgcggccggctcgccgtccaggaagcggccggtccggagcgacagtctcgacaccgcgccccagcatcacaaccgcaagccggcgtcgccgtac

SEQ ID NO: 23418 - DNA, 528 bp, Zea mays
  Clone ID: cC-zmle189047f12a1
tttttcagaaagcaacacaagatgccattgcagtttatatacagcatttatttacagaaaccatggcgtgcagacgtgcagttattccgcctgtacagtacagcacgcgccgatcgatcgcggcggcggcggcggcagcggcgggtgagcaaggggcccgctcagctgggcgcgaaccggtcgaggaggaggtagagcgtggtgtcggacatggcgccgccgcacctcgcgacgtccccctcccgcctgtccgtcccggccgccgaggctcctcgcaacgccttgttgttgctgctgctcctgtcgtcgcctcgccacggcctctgctgctgctggcacggcagccgcgggtcgtcgtcctcgccgagcccgtgggtggcggccacggccaccgtctgccacgtcccatgcagcgccgacgagagctcgccgagccacacgcccgccaggttgttggatgccgtcgtcgtcgtggaaccatggtggaggacgctttgctttgcgacttgcgtgagagagaaacaaaac

SEQ ID NO: 23419 - DNA, 514 bp, Zea mays
  Clone ID: cC-zmle189047f12d1
tttttggtcgccacgcgtccgcaacaagtcgtccaacgtccaggcttttctgttttgtttctctctcacgcaagtcgcaaagcaaagcgtcccccaccatggcttccacgacgacgacggcatccaacaacctggcgggcgtgtggctcggcgagctctcgtcggcgctgcatgggacgtggcaggcggtggccgtggccgccacccacgggctcggcgaggacgacgacccgcggctgccgtgccagcagcagcagaggccgtggcgaggcgacgacaggagcagcagcaacaacaaggcgttgcgaggagccgcggcggccgggacggacaggcgggagggggacgtcgcgaggtgcggcggcgccatgttcgacaccacgctctacctcctcctcgaccggttcgcgcccagctgagcgggccccttgctcacccgccgctgccgccgccgccgccgagatcgatcggcgcgtgctgtactgtacaggcggaataactgcacgtctgcacg

SEQ ID NO: 23420 - DNA, 434 bp, Zea mays
  Clone ID: cC-zmle189047g01a1
tttttttttttttttttttttttttttttttttttttttggtttttttggtgggaaatttttccaaagatgaaggggggtaattaaattaggggggggcgggaaaaccacaccatggtgggggacagaaaaaaaaaagacgggggggagacgggaatcccggaccggaaccagagggggaaccaaggtgccccaaagggaggccaaaaagggcccgggggggaaacgggcaaagctgattggggggggaaaagggggtcggccaaaaagggacaaaaaaaaccacccgggagaaaaaggggaaaagccggggggggccaaggggggggcaaagggaaattaaaggcaaagcgcccgcggcccaattggggagcgaaaaccgggcagggcggggggataaaagaaccggtcaacgggcgggaagaggggggccgc

SEQ ID NO: 23421 - DNA, 246 bp, Zea mays
  Clone ID: cC-zmle189047g01d1
ataaaaaaaacaaaaaaaaaaaacaaaaaaaaagggacggcataactataaaaaaaagagacctaaattcaattaactgcccaatatttcacaccttcgggaccgggaaaaccaagtctttacccaccttaaaaaacttgcaaaacagccaaaatttcgccagttgccaaaataaaaaaaaggggaaaaccgatcgtttctcccaagagttgcacatccaaaatgccaatgggaccccccctgaaa

SEQ ID NO: 23422 - DNA, 394 bp, Zea mays
  Clone ID: cC-zmle189047g02a1
ataacatttttgtgaatgtcatgtaaggcacatcacggagtgactgtaactgttgtattgagcggaacatttgccaaatgaaacactaaagcaacacgccgcgaaacactgaagatcgaaaccaatccaacagccgaaatacagaataaaaccgataacccaccaaaaccacgcaaggaaaacaagggaacaacactaccatacattacatgaaagaaaaacatgaaaagccacaaaacaaacaacgaaagcaaccttctccttaacataaatcccaaatgggggaagacatcgcctgggatttgcacccacgcgtacgaccacgcctcccaaaacccccgggtccacccgggaaacccggaccggaccctgcaggcctcccagccttccctat

SEQ ID NO: 23423 - DNA, 531 bp, Zea mays
  Clone ID: cC-zmle189047g03a1
aaaacaaaacatttttgttttctaaagcaaggctaagcatcaaaaatctttttcgtaaaagggtatcaaggaagggaaatcaattggcaaggaaggaaatgcaccaacggtttagcacacaactcctatcacctaatgcaacaaacaaggtgataaagattttaaaacacaaggaggtggcaactacaccgggacttgcctgaataacactaggttagtgttgttagacgacatccacttggcgattatcttttgttttgatacttgtgtcgtttatccatcttcagattagttcatcagcttcatcctgcggattaacccgcgcttggggtcgacttgggtcttcttccgcatcacgcgattaattaacgtacctgaatggaatgcattatgcacatgaatgcatatcgacaaaaatattacaaacctaaatagtgctacgcgatagcgaataaaacacctagcggcgaggggttgtaccgttttattcggaaacactagttatcagcatatggctaagcgcaataatta

SEQ ID NO: 23424 - DNA, 463 bp, Zea mays
  Clone ID: cC-zmle189047g04a1
tttttttttttttttttttttttttttttttttaaataggggttttttattttataaaaaagaaacttaatgttatatacgtaaaaccaaaaacaaagcgaataaaccaaaaaaacacggcccaaaaagtaacaaataaaatacataaaacaaaggcgaaaaaaccccataactggggcacaccaacccaaaaacactcccaaaaggcaagggggggagggggcttattagaaaaaaaaaaaaaaagggaggggggggaataaacaaaatcccatcacaaaaaaagaaaaaaccatctggataggaaacaaacaccaccaaaaaaggaaaaaagggcaaaaaaaaaaaaaggttgcgccaaacataatacaactgcgaaggaataaaagtaaacgacaaaggagaaaactccgaaacaaaaacgtgcttatacagggcacgacccccaaacaattgaatccgc

SEQ ID NO: 23425 - DNA, 362 bp, Zea mays
  Clone ID: cC-zmle189047g05a1
ggccccccccaaaaattcaaggtcctacccttggcccgtgtaaaaaacattttttcacccctaaaaaccggacctggaacaatgggcttaaaaaacaaatggggggggaaaaagggccatcattcttaacacctcaaaaaaaccccaattattttttccccccccccccctcccaaattaattgggcccccttttccaaccccccccagcccggtccttggaaccttaagaagaggggaacttggggaccgccttggcgcccccagaaacggcgttttttgttagttcgcccgggaggaccaagcccccccaggtctgaaactcccaagagggggcggggggtttttttttattgccccccc

SEQ ID NO: 23426 - DNA, 93 bp, Zea mays
  Clone ID: cC-zmle189047g06a1
gtttgatgtttgcggccatcagcttggatcctttatagcgggcgcggtcgtccgcgatctaggactagcccatgtcgtccgcggactgcgtgg

SEQ ID NO: 23427 - DNA, 379 bp, Zea mays
  Clone ID: cC-zmle189047g07a1
aaaccgggggcagcttctcattggcgggaaaaatcttcaacatctaaatccgtacacaacaattgccaaccctgtgactgtgaagcaagcccatttcttccagtccccgcaactttagattccactctacactctttccagcatgcgaacactgtgtacgcaatggcccttttactcttctcctgcccccactggttggccttctttgaaccatgggttaagacccccttccaaatgggacacgttggtgtttcccttttggaccaacaagtccgcatgttttatggacccatgattgcttcccctcagggaaattttgcgtttggttcagggtccctcctgtagagcattccacaattttcttatgatctttcccaac

SEQ ID NO: 23428 - DNA, 454 bp, Zea mays
  Clone ID: cC-zmle189047g08a1
tttttcaaagtaaaaaaaaattaacagttccaagttacatcccaatccatccatgtgcagaggaattgcatgtatccacgatgctcgtcactgctgaaatggcatacctttgcacgcagagaggaggatcggaggcggagctatattatatatatgcatctttatgaatttgtattctacttgaagtagtaggggaggtcgagcacgtagaggaggaagtatgcccagagcacgccggagataccaccgaagaagaaccctccggtgaacttggcccagccgtcggcggtctgcagcttgtcggcctccttcttccggccggtgagcgtgagcgtgggcgccgtggacgggtcgccctcgttgaaggaggcgacgccgtacatggtgaggcagacgctgaggatggcgacaaggccggcggcgccgaacgcgcccgcctggccgtgcacgggcg

SEQ ID NO: 23429 - DNA, 485 bp, Zea mays
  Clone ID: cC-zmle189047g09a1
gaaaaaaaaaacagttcttttctggttttggtgctcccacgacaaaatcacctgagtagctctcgagcaaacacgaccatacatttattgcgaccgtacaaacattgtaacaaaaggcagcagcgagctagtatagctccacaagaaaacatccccatcctcttcctttcttagtagggctccactggtgccctgaactttgctccggcgtagaccgcggcatcaccgagctcttcctcgatcctgagcagctggttgtatttggccaggcgctcagaccggcaaggagctcccgtcttgatttggcccgtagacaggccaactgagaggtcagcaatgaaggtgtcctctgtctcgccactcctgtggcttgccatcactccccatccggcgcgcttggacatcctgacagcttcgatactctcggtcacagacccgatttggttcaccttcaagaggagagcattgcaggtcttctcattgat

SEQ ID NO: 23430 - DNA, 312 bp, Zea mays
  Clone ID: cC-zmle189047g10a1
ttttattttttttttttttcgctcaagaatgaagatggaaagacaggccacgtccacgttcgttgatcaaccaaccacgtgctttatgtttacaacacacgcacgcacgcacgccgtggatacggaaacggacgctagctagctagcttcagtcggaccgcatgcggttgagctggttgagcgccggctggaggatgttgaaaagcacccagccgatggcgggcgcgacgactatgagcaggaggaggccgcggctgtcgtcggcgggcgcggcggcggcgattgccgcgaggtcctgcaccacggcggcgg

SEQ ID NO: 23431 - DNA, 432 bp, Zea mays
  Clone ID: cC-zmle189047g11a1
ggggagagattcattatagtttcgtttggattttataaggagtcggacatgcttttttgatgacatgaaaccgatgaaattctttatcaactattgagtgaacaacccactcatcagttcatgccttcacacagcgattggactgcgacgaagcaggcaaaacggtgaacaacgaattttttttaaagaaaacgggcatgtatctctatctatcagtcctttgcctcttcctaccaccacataaacaagccccacaaatgaaggaattcacatctgctagctgcgaccttgagacaaacaaacggagggagttatggtttggatcaaatcacacgggtcagtcagatcacgcggggacctacacctactgcctcatttttttcgagctggagtccgggcacttgttgtgctttatgtgatccgctttcgcag

SEQ ID NO: 23432 - DNA, 489 bp, Zea mays
  Clone ID: cC-zmle189047g11d1
attttgggtttaccacgcgtccgcgaagactatgaccaggaagacgaggcggaccacactgttgactcttttgcggaagctgcggcggcctttactacgcgagcgagttctggatcggctgcgacatctgcgaccggtggttccacggcaagtgcgtgcggatcacccctgcgaaagcggatcacataaagcactacaagtgcccggactgcagctcgaagaatatgaggcattaggtgtacgtccccgcgcgatctgactgacccgtgtgatctgatccaaaccataactccctccgtttgtctgtttcaaggtcgcagctagcagatgtgaattccttcatttgtggggcttgtttatgtggtggtaggaagaggcaaaggactgatatatagagatacatgaccgagttctttgatatatatatgactgccaccgctttgcctgctgttgctcacacttacactgtgcgtgacggcatgaactgat

SEQ ID NO: 23433 - DNA, 416 bp, Zea mays
  Clone ID: cC-zmle189047g12a1
gggaccatcaccggatctcttttatttttcttccatggggcacaacagggggtgcttttttttccaatcaccattgcaaccataaaagatttacagggttttataacattggtggtaacccctaaacccgccgccaagaaaccccccaaaacctgtttaacttatgtacaactacaaaactgtgcagtttttaaaagtttttgcaccctggggcgaagggttttataagggccgggcggtcttgatcatggatgagccacttgggaaagaaaggaaatgcctgacaagggacattcccaattgatttggagctatcgcaaacatggcgaatgagaatagactgaaaccgccgggtgaaagggtctagcccaaaaatcctcgccacatccatttggggaccctgaaaaagggttcaa

SEQ ID NO: 23434 - DNA, 470 bp, Zea mays
  Clone ID: cC-zmle189047g12d1
atcacgcgtaccctccaactgaataatgaaagcgtacacacattcttcgaagcctttttcatggtgccgagatggatgtggcgaggatttcttggctcgaccctttcatccgtcgatctcatactattctcattctacatgtttgcgatagctccaaatcaattgcgaatgaaccttgtcaggcatctcctctctgacccaactggctcatccatgatcaagacctacctgaccttataaaaccattggcaccaggctgcaagaactcttagaaactgtacagttttgtagttgtacataagttagagaggatctggggggttacttggcggaggatctaggggttagcaacaatgctataatacactgtaaatcttttatggtcgctatggtgattggatagagaagcacaccgtgttgcgcacgatggaagaatgataagagcgatcacgtgatggtcaaagaactaa

SEQ ID NO: 23435 - DNA, 533 bp, Zea mays
  Clone ID: cC-zmle189047h01a1
ggcggcgggggcggctttgtccgcctggagggcgtacgcggcggcgggcgaggagagcgacgtggtggtggtgggcggcgggcccggagggtacgtggcggcgatcaaggccgcgcagctggggctcaagaccacctgcatcgagaagaggggcaccctcggcgggacctgcctcaacgtcggatgcatcccatccaaggctcttttgcattcatcacatatgtatcatgaagcaaagagttcttttgcacaccatggagttaagttttcaaatctggaagtggacctcccagccatgatggctcagaaagacaaagctgtggcaggactaacaaagggaattgaagggctctttaaaaagaacaaggtgacttatgttaaaggctttggaaaactgtcatccccctcagaagtgtcagttgatttgattgatggtggtagcaccattgtcaaaggaaaaaaccttaatattgcaactgggtctgatgtaaaatcactttcaggaataacaattgatgaaaagaaagttgttt

SEQ ID NO: 23436 - DNA, 323 bp, Zea mays
  Clone ID: cC-zmle189047h01d1
ggataagggaccatcaaaaggctcttgggcattaaaagtaaaaactagactgagagaattattgggatgggtaaaccaatcctaggaaccccaaaaccccgcttggatagacaacctagaggggcaataaacaggttggcccccaaaaacaaaatgacaatggggggcctttttcccaaaagacccaaacttacccaaaactttggggttgggccacaaaaaatgagaaatcttttggggggggccttataaaaggtttccacgcaaccctccttaagggcgccactcacgaaagggtttgcctgggttgttcaaacaacccc

SEQ ID NO: 23437 - DNA, 99 bp, Zea mays
  Clone ID: cC-zmle189047h03a1
atataacggtgccaatagcagtccttttcacgggtagacttgtttctttagggagttgtaagtttcgacttttaccaaaaaaataatacacagtacttg

SEQ ID NO: 23438 - DNA, 302 bp, Zea mays
  Clone ID: cC-zmle189047h04a1
acatgcaggggtgcatatatatatatatagctagaattattgagacgacacgtttcatttcctgcgcgggcggtactgcatgtggtggcacaagacgacgggccctggcggggtatagctagctagaattataggagggcatcctccttgtgcgtctcgatgaccacctcggaggtggggtacgcagcgcaggtgaacacccaaccgtcggcgacctggttgtcgttgaggaaactctggtcggactggtcgacggagccagagaccaccttgccggcgcaggaggagcaggaccccgcacg

SEQ ID NO: 23439 - DNA, 259 bp, Zea mays
  Clone ID: cC-zmle189047h05a1
ccaacattaaccagttttattgactgggtatacttcacaagaacgaacatgacgttacaagtcttagggtacatcactatcaagccggaacaaacacaggcctgtttacacagcatgggaagaagcaggtgcaggtgcagggcagcagtatgaacactgctttgtgttcatgtgtggcatcgccctctcaggcacggatggcgatccctccctgcccaggaaattacctaccggtgcctgtaggctatacacatctgaa

SEQ ID NO: 23440 - DNA, 120 bp, Zea mays
  Clone ID: cC-zmle189047h06a1
ttttaaatgaacatttaaatataagaagagacttggtaataaaaggacacaaggatcatcatgcacatctcaaatcatgccaccaccgtaccagcagccaaattacaatatactgtaatt

SEQ ID NO: 23441 - DNA, 386 bp, Zea mays
  Clone ID: cC-zmle189047h07a1
ggtgtgttgggtttttttttttttttcttgttcttttttgagtttgttttccaaaaggaaaacaataatgggggcgggggtcaagaatctgtgaaaccccaaaaaaaccccccccccgcaccgggggaaaaggggaaaagaaaacccggagggccccaagcccccaaagagggaagagaaaccccagggaaaggaacaacccccaggggtccgccgatctggggcgcaaaacggggccctggggaacccgcggtaaggggcccaaaaagggcacggaaaaagaggaaacaattggccccaaagaaccggggccccccggcccggggggaccccccccccacccggggggccgcacctaagaccaaaaacattttgggggaaagggg

SEQ ID NO: 23442 - DNA, 456 bp, Zea mays
  Clone ID: cC-zmle189047h09a1
aatcgataattgatgatgtattgaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaaaaaggccacagaggaaggctctccaccgtgttctccacaaatgcccaccttcaagttaggcctagctttgcggcccctctctgtagcaagctttaccagctcgcccactcccctctggtccaggacctcgaaggggtcatgttggagaatgccctgagc

SEQ ID NO: 23443 - DNA, 436 bp, Zea mays
  Clone ID: cC-zmle189047h10a1
ttttggtttaatggaaatcctttgaaaaaatgaggttaacaaactagctctgaatgatgcatccaataaggtaaaaaaaagttgaacaggttacatcccaatccatccatgtgcagagcagaggaattacatttatacacggcgctgatcaccggtggagtgaaatgaaacaaggaccacaccacctacataccatgcagctagagaggaggatcggccggagctatatatatacgcatctttgatgatttctacttgaagaagtaggggaggtcgagcacgtacaggagaaagtaggcccagagcacagcctgagatgccgccgaataataatcccccggtgaacttggcccaaccgtctgaggtctgcagcttgtgggcctccttcttccttccagtgagcgtgagcgagggcgcccctgacgggtccccctcg

SEQ ID NO: 23444 - DNA, 511 bp, Zea mays
  unsure at all n locations
  Clone ID: cC-zmle189047h11a1
gcagcaccaagaagcaccattttttccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtatccgtcgccgccaccgtagccgccgccaccgtcgtagccgccaccgccatcacggtgcccgccaccgtcgtagccgncgtcttcacggtcaccaccgtacccaccgccgtcgtcttcacgggcgncgtgggactgggcctcgttgacggtgatgt

SEQ ID NO: 23445 - DNA, 566 bp, Zea mays
  Clone ID: cC-zmle189047h11d1
gtggacccacccgtccgggttggcttctcctccccctccggttcgggttcgggttcgtgttgttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacagcggtggcggcggctaccgtggcggcggccgctacagtggtggtggcggcggctactgcggtggcaaccgtggcggcggctacggcaactcccacgggaactggaggaactg

SEQ ID NO: 23446 - DNA, 456 bp, Zea mays
  Clone ID: cC-zmle189047h12a1
aatcatcaccatactgtttaagtttccccatgcttcaatgtctcgctggggctgatgacttaagaagatggactcacttgctcgaaggctggaagagaatttatgggatcaaaacatgatcggaccttggaactaaaaactccaaccaagaaaacggaaaccaaatacacaacggggctcatgaactggacgagcaaaagcacatgccatagatgctgtattactgacatactggtctactcgccttgcaaaactacggcctttatcctgcgtctctcgctggcttaaagccatttgaagagaatgccaccatgggcggcgaaaaagggggcgaagacaagggattcaaccgccataagcttgatgaggatgttgagggaagggccacacctgtccttgagaggatctccaatggtgtcaccaatgacagccgccttgtgagggtcagaacctttt

SEQ ID NO: 23447 - DNA, 494 bp, Zea mays
  Clone ID: cC-zmle189047h12d1
cgggcgctctgatatctacactgctgatgctctgactttttatttattcttcgggcttattgtcgctgctttgctcgcgtgctgaatctcgccaatgaccatgaagagtgtgggcagagctccgctccagatggtggaggaagtccgtcggccgttcaacaacatccatgggctcatggaaggcaccccagatcctgattacgcaacttgtgtcccgatctgaccggatgcatccatcatggagatgatccccccaggtgctcttgttatgctcacaccactgatcgttgggattctatttggggttgagaccctctctggagtccttgctgtcgcccttgtctgtggggctgagattgccatctctgcatccaacactggcggggcctgggacaacgccaagaagtacattgtgggtgcagtataacagctgtgccgacccttggcccaaaaggcactgaccctcacaatgtggctgatattgctgacaccat

SEQ ID NO: 23448 - DNA, 470 bp, Zea mays
  Clone ID: cC-zmle189048a01a1
ttttatagtatgtagtaatctataatacttaattacacgcacgcgcgctatctctcgatcgtgaagaagagagattgctagctttattccggtccgatgatgatggaggcacatatatatacatagatccttggttctacaatacgttgacagtaatctgtatatatgcttcgtgtagtggttttggttggttcttattgacttcaccgccgtcgtcgtcgtggtggatgacgacgagtcgccgccgtcgccgacgccatgatcagaacaggaacgccgtctgcgcgaacgctggcagggacgacgcgccctcaaggtgccggtactgcttgccgccgtgcgcgcggggcagcgcccgggcgaggtcccaggacgccgccttcctgaccttgcgggtccggtgctgctgctgcactcctcgcagatgtcgccgagcgaggggcgccactgctgcggcgcacccgcagcag

SEQ ID NO: 23449 - DNA, 445 bp, Zea mays
  Clone ID: cC-zmle189048a01d1
ccggaattcccgggtcgacccatcgcgtccgacatcacatacggtagcctaacacttatcggctgaccactcatctccagcggatgcctgccgatcagatctcgacagcgacaccgtcgggctacagaggttataccgagccggcgactactgcatcatcataaatatgtacactatactatactactacgtacctaccgataagcacccgagcaatgtgaatgcgtccagtactatatatctggtgcgctgcatatacatatatgttcctgatcattctcccattgtgaatgcaagctgcaccctcatatactaccacttcgcattcctaacactgagctttcgatatgctacaccagaagaggagggccaacagggccgaccagctgctgggggctgctgcgggtgcgccgcagcagtggcgcccctcgctcggcgacatctg

SEQ ID NO: 23450 - DNA, 466 bp, Zea mays
  Clone ID: cC-zmle189048a02a1
tcgtctcggccacgttctgggtctcctgcctcatgctgctcgcctacgtgctgcgctccgacgccttaagcgacacgtggaggggcttctctgccgacgccttcaagtacgtgctgcccaccgtgaagctcgccacgccgtccgccgtcatggtctgcttggagtactgggcattcgagctcctggtcctgatcgccggattgcttcccaactccacagtgagcacgtgtctcatcgccatgtgctccagcacggaggcgatcgcgtacatgatcacgttcggctttagcgccgccgggagcacgcgggtgtcgaacgagatcggcgcgaggaacgtggagagggccaagaacgcggtgtctgtgacgatgaaactgtcggtgttgctggccgtcatcttcgtgctgctgctggcgctcgggcacggtctgtgggctcgcctcttcagcgggagcgccaccatcgc

SEQ ID NO: 23451 - DNA, 530 bp, Zea mays
  Clone ID: cC-zmle189048a02d1
ccggaattcccgggtcgacccatcgcgtccggccacgcgtacggccacgcgtacggcgggcgcccttttgctgtcaatttgggccagcagaaataagctatatgccagaacactagactacattgagcatgatctgacctatttcctgcggcaatccgtctaaaatgatcgcactgtagcgtgctcttaatctacccaaagcaaggggcccatcagacctagagtgcgtctgctacgcgacgtagctggccttctcgtgcttcatggcatcagggagcttggaccagtcgacgcggacggtgacgaccagcagctagcaggcctgtgacttgaggccgcagatgagccccgtgcacaggcccctgatgcgcaggtcgagctcgaaggcgaacagtatggccatcgacatgccgactatgtctaacggctccagggtggtgaccgacgccaggtgctgccaacctgatgccctagacactcccgacagcacgccctgcacggagttcaagtcgatggagatcaccatgagc

SEQ ID NO: 23452 - DNA, 441 bp, Zea mays
  unsure at all n locations
  Clone ID: cC-zmle189048a03a1
aagagaaatccacactttactttcagattctaaatcctatatactcacttacaaccaaattctctacataatcagattcttagaaaagaccgttagaaaaaaaaagctgaaccttttggacaactgaaaccaagccggatatatgatttttttactcaagctatatatgggtattggcaagtaataagtatacatcgtatctgcaaccggggctgtaaagggggggagtaaagagggaaaattgtatgccaatcagaatctaggttttatgacgaacggcatcttatccacgaacgggggatcagaatacttcccggtcaggatctgcgaggcgatatggaaattcgcagcttccgtgtaatgtatcccatcccagttgacgaattcagtagntgtcgctgcacccttttgcggtgaccatcttaccatccagagacaccg

SEQ ID NO: 23453 - DNA, 611 bp, Zea mays
  Clone ID: cC-zmle189048a03d1
cccacgcgtccgcccacgcgtccgggtctcaagaaactgtatgaccaaggtgctaggaagttctggattcacaacacgggccccctcggttgcttgcctcaaaacattgccctcttcggcaaagacccatcccaactggacgagctccactgtgtggcgaagcacaaccgtgccgcaaagcttttcaacttacagctgcacgcactttgcacgaagctgagggcagaattcgatggagccagcatcacttacgtggacatccacacgatcaaatacagcctgatcgccaactactctcgatacgggttcgagcacgccactcaggcgtgctgtggatacggaggcccacccctgaactacgatggtaacgtaccatgtggacacacggtgtctctggatggtaagatggtcaccgcaaaagggtgcagcgacactactgaattcgtcaactgggatgggatacattacacggaagctgcgaatttccatatcgcctcgcagatcctgaccgggaagtattctgatcctccgttcgtggataagatgccgttcgtataaaacctagattctgattggcatacaattttccctctttactcacccactttaca

SEQ ID NO: 23454 - DNA, 395 bp, Zea mays
  Clone ID: cC-zmle189048a04a1
cacaacgttacaacatatatatatcatatatgcggggaccggtacaaagcctctccaaaagctccatcaacaagggtggttagcagccgggactataaacgacaccaccccatccgggttgatagaaaaaccattactggaaaattgaaccccgcagcactaccggtagttgcggtaaacgggagtggacatgccccactctgcatatttcaccaggtgttctggggggaggcacacgggtttgccaaaccaagctcgtaggctctcgcaaccacggctgccaagatgtgcgcacagatctttctgatactcgggaagggtgagaagatggaccccttctaaaagaagaactgtgtggccggaacaactaactctttcgaggcagggagaaacat

SEQ ID NO: 23455 - DNA, 508 bp, Zea mays
  Clone ID: cC-zmle189048a04d1
cccaggcgttcgtgcacgcgctcgtgaacatacactaaagaaatcatggtggccatgtcttacttcaacgataggcctatcataccttcactgacaaacgcatcctcgcattgtgaacgcactgctgaacacgcacatgcatggactcacggccgctcaatgtttgccagcggcatgacatttgcccctgcggcgtacgtaagaccgactacatgagcctgcgcagggcgcacaatgcgtacattaacactggactagaactactacttgagatctctgtagccgaccttgttactacgacttgcttctggacgtctctaaagcgctagctgatcaagccacactggacaacctccagctgggctacctcttgctacccttcaccagcagtctactgatctctgagcacatcgctgcattcgtggctgtagctgcctacgagctcggtgtggatacgcgtctgcctcaactactagaactgaggcagcatgctgatgactgcctgcac

SEQ ID NO: 23456 - DNA, 227 bp, Zea mays
  Clone ID: cC-zmle189048a05a1
tttttcttatttttcattttttttttttttgtaggttgtggtttactactactacggatcttccagcatcctgtcgggcgtttggttcggtcagctctctgtcggagctgcatgggacctggcacgcggtggccgaggtcgccacccacgggctcggcgaggacgacgacccgcggatggcgtgcccgcagaggactacgccgtcgctaggagacaacgggaggagc

SEQ ID NO: 23457 - DNA, 65 bp, Zea mays
  Clone ID: cC-zmle189048a05d1
attttgggtcgactccacgctttcgcggacgcgtgggttccaactttagatctaataaataaaaa

SEQ ID NO: 23458 - DNA, 308 bp, Zea mays
  Clone ID: cC-zmle189048a06a1
agaagcaattgctccttcccaaattatgcattccagcagtacattccactgcaatatacaacaggatgtttctcttccaccatctaatccaacattaaatttaaagtctgtatcttggcctcgaggcattgctctgcaaggtattagttcctacaaaaattcgcaattcccaataggaaaagggagccgtccttttggcaactgccctattacctactacctacatatacagctcaaactgctggtctccttggaaaaaaaacacctatctgagcaccccacgcgtccgtccacgcgtccgcccacgc

SEQ ID NO: 23459 - DNA, 308 bp, Zea mays
  Clone ID: cC-zmle189048a06d1
ggatattcatacaaacctacatactgtacataccgtgtgattattcaaataaggagctatgctcgatccagtgcgagtaacaattccgtaatctgtaatgatgcatgatgttgccatcacaaaaaattacactattgttatggacctacctttagttgtccgaccaaaggaaatggcgatgaacggcgagttaatccacaagtttgatttctacaaagaaaggatagggtaggcattctttctcgcttttgcaaaagatgacaaactcatcccatggttttaactacctcatttcttcatataacaat

SEQ ID NO: 23460 - DNA, 541 bp, Zea mays
  Clone ID: cC-zmle189048a07a1
cccccgttcaagaggatatatttaaatatgtttggcacgtccaacttcactcacaaatgtaagataaacaaggactaacaccaacaaggcactgcaacgctatttgaaccatcagaaacacttcggctgcaggggctagcgcagaaaacttaagcccatcaactgattataccagctcaacgtaatccgctcatcgaatcagtcgtcttcccagacctggcatcagaccaagctttggctattgtgcgcttcatatcctcgtcgccctcctcgtacatgttcttcattaagtccataattcctgacatcggatctttttccttgtccatgtttggcttgaacttgtcttccttgaagtgcaagtctaaccagttgcctttagaacccttgaaaagagtaacaacaaccctggttggtttcaccacaaccttacatttctcaggaacaatctccttgttcagctttggtatagcacaccggtaattcttgcctttgacatcatgaaactttatatccactgatgttggcttgaaagtagtct

SEQ ID NO: 23461 - DNA, 581 bp, Zea mays
  unsure at all n locations
  Clone ID: cC-zmle189048a07d1
ctcgagaacggctggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctgagaaatgtaagggttgtggtgaaaccaaccagngttgttgttactctcttaagggttctaaaggcaactggttagactngcacttcaaggaagacaagttcaagccaaacatgggacagggaaaagatccgatgtcaggaattatgg

SEQ ID NO: 23462 - DNA, 412 bp, Zea mays
  Clone ID: cC-zmle189048a08a1
aaaacccagggccttccccttgggtggctttcccctttcccaaggcgggggctaaccctttcccaaccccctaaaaaagggggtaacccgaaccacaaacgggaaaaaaatcggaaacgggggctgctaaaacggaccgggggattttggttttttacccttgggcaaccggtcccaggaatgggccgggcaaggccgggggggagcccaaacaaggggggggcacccccggcagggggcccagcaaccggggcggggggtcccggcccgaagcggggcttggggggggcccgcccctgcgggggacaaataggattgccggggtggcgggggccccccccacgggcctgcgggggggggaacccccccccggggggcacctggataagccccgggggttgggccaccccct

SEQ ID NO: 23463 - DNA, 567 bp, Zea mays
  Clone ID: cC-zmle189048a08d1
ttcttgggttgacccacgcgtccgagaacgtcgctggcggcaagtacggggctaacggcgggcgctgtcactgctcgaagcgcaggaagcaccgcgtgaagcgcacgatccgcgtgccggcgatcagccccaaagtggcggacatccccgccgacgagtactcgtggcgcaagtacggccagaaacccatcaaggggtcgccctacccacgcggctactacaagtgcagcacggtgcgcggctgccccgcccggaagcacgtggagcgcgaccccgccgacccgtcgatgctgatcgtcacctacgagggcgagcaccgacacagtcccgcctccggccaggacccgccgccgccgtcgctcgcgccgctgccggagctgcccagccattgatttggcttcctgcctgctctgtcctgtcaattactagtagctgttgtcataagttataaaatcaaaatcgccagttcagttttagcagctccgttttccgatttttttctcttctgtcgatcgcgttagcagctttatgaagggattaggaaagtgttagcatcagacttggaga

SEQ ID NO: 23464 - DNA, 588 bp, Zea mays
  Clone ID: cC-zmle189048a09a1
tttttacagtctacaaacattataatgtcagcattgcaccatatggtcacaaaaacaccgttttacaccgttttgggctgtattgtattatttgtacagcgtaatttaaatataattatagataagctgctatagatagagatagtcccattatggggccatgacggcatgcaaacagttagcaagtcgggtcgcacaaggtctcatcaaccacaaccttgcactgacgtctcacaagcactaaggacgcgaaaatataaacactggatggaagcggattaagttgctagcagcttcggtgtgtcaattccaagcgggtcgtcaatgacagtggtcaaacatcaggtccacagcatcatcagtctctccagaacggcacttttctcttcgtctgcttgaagcccttcattaaatctgaatatagaccttccaccctgttctctgtctccttagtgaatgaccatattctggtaatagtatagttcatcttgacccattcatcagctataacttgaaccttctcgatagctgaatgcaaaacttcgatcctttctgtcgtgtactttgctactgatgatatatcagaat

SEQ ID NO: 23465 - DNA, 524 bp, Zea mays
  Clone ID: cC-zmle189048a09d1
gggtttgaccacgcgtccgcccacgcgtccgcagacgcgtccgccgttcctgtgccgctttggtcgtcgcagccgcgctcctcgcagtcatcttcgccctcccgcgtgaccacgtccgggagtgcgccgctccgatcgcttctgtctccagtgccggggatgatgacggcggtttccgcgaggagctgcggttggaggtcgagcagcttaagcagcagctggcgcggcttgaatctctttgggatggtaaatcgaaagctgtggatgataaacttgattctttagaggaggataatggccgtgtaatgagagcagtggcactcgatgtccagtctctgatcaatgagcgggaaaatatcaggattcaggaatcattatgcagctcatattttggtaacagtatcaaggaaatggaatatgaggtccacattctaaaagatgggtcacgaaagatgaattctgatatttcatcagtagcaaaggacacgacagacaaggtcgaagttttgcattcacctatcgag

SEQ ID NO: 23466 - DNA, 288 bp, Zea mays
  Clone ID: cC-zmle189048a10a1
ttttccaaaaccagcatggatccagcgtccaggggcaccgttcacatttattctcagcatagacaagcagcaaagttggtctgcgaccaaaggccattgggacgaccctcgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctaggtgag

SEQ ID NO: 23467 - DNA, 301 bp, Zea mays
  Clone ID: cC-zmle189048a10d1
cggaattcctgggctcacctaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgagggtcgtcccaatggcctttggtcgcagaccaactttgctgcttgtctatgctgagaataaatgtgaacggtgcccctggacgctggatccatgctggttttggaaaa

SEQ ID NO: 23468 - DNA, 231 bp, Zea mays
  Clone ID: cC-zmle189048a11a1
gggacattggccattcattaaatatggggcaaggacaacatgctggccacctatccaaaaagaaaaaaaccaagggacaccacccttacatacctaaaccactttcattgggggtaccactataccaaactttcactcaaggaaaaagaaaccgaatgccccgctttttttggacaaaaaagggaaacaaaaagtcccaaaggggaaaaccaaccaggggcggaaccctgg

SEQ ID NO: 23469 - DNA, 230 bp, Zea mays
  Clone ID: cC-zmle189048a11d1
cccctagtttgtttatacctttggtactttttgtttcccttctctgaacaaagaaagagcggcatgcagcttcctcttccttgagaggaaggcaggtatagtggccacaacaatgatagtggcgatgctagctgatggctgacttacttcgattctttctttcttgcttgcttgcttgctcgcttgcttgccccctatcctaatgaatggactatgtgcctttaataatt

SEQ ID NO: 23470 - DNA, 484 bp, Zea mays
  Clone ID: cC-zmle189048a12a1
gtcgacatgttgttcgtgtcaattaaactttcttaattttaactaaaattataaaataattttattgtaacattataaaaggagattcaaagatctgatataaattttatactataaatattaaaatttcttatatcaaagttaaaaatgtttgactccttaaaaataaaaatggccaacatttatggacgagagtattttatagaggtagtaggtataatgaatttaagaaaaagctctgcacagagttgaaaaactgggggagaaagatttctgacataagaacatagtaagaacaaaaatgaccaacatttatggacgagagtgttttattaaggtagtaggtataaagaatttaagaaaaatctctgcacagagtacagatactagcggagaaagatttcggacataatgaggtattgaggaaaaaaatataaagaaaccgttttgctcccaaaactcttcgaggacaagaaaaaccatg

SEQ ID NO: 23471 - DNA, 474 bp, Zea mays
  Clone ID: cC-zmle189048a12d1
tggactaagcggtttgttgtcagtcttgagtgtgctgcagttgctggctggcccagctgctgccgagagttatcgtcagttggtgcggtgtgtccgcttaaactttatttgtggttggttggtacttttgtggtggttatttttttggacctcgtgatagttggacggttcaatgttatcgcggctactggcaaaccttaagtgatacggttttcttcttttcggtattcgtttttgcatactgctggctcgcatttttgtttttgagcttgcgattcttttgttatttccaactttttgtctgtttggaggccattcttatttgattgtttacaccaattttttggctgtcttgtttttgtggcttttaagatttttataaacctccacccaaaatagctagccatttttgttggtcctgggtttttttggccttcaaaaagttttgtagcaaaacggttttttaattttttt

SEQ ID NO: 23472 - DNA, 433 bp, Zea mays
  Clone ID: cC-zmle189048b01a1
atccatgttctaacgaagatttcaccaccatcctgtaaaacaacttttaacacaatgcacccccatctttcacaaccaacctatatgaggtaaaaaaaaaaatagtacaaaccaaccggagaataatcgaaataatacgaatcacacccaggttcaccgggacagattagcacccctttcctacagataaacttaggagtgaaccgacttgagcctgggaatatagttgcctgccacgaacaacgcaagccccgatagcacggccgccgcgatcaggatgtactgccgcagtctccttctgcccctgttacgtaacggcgccggcatgggctgcaccctgttcagctgcttgattgccgctgcgggcctatacagcctcttgggagccgccgccggttgaggagcctcaacttccctcgggttgtccgatgcg

SEQ ID NO: 23473 - DNA, 560 bp, Zea mays
  Clone ID: cC-zmle189048b01d1
aattccgcaagcagtatgttgagtcaaacaaggttagcacactaaagagattagggacccatgatggacggaaacttggccctgatgaggaccctccagtcatatcaagcagaagaccaagcagcatctatccattgtctgcctcaagcccgggagtggccactttagcttcaataccagcacctgtggtagctgctccagctgcagtctctgccaaagaggactcatttcctgttttggaagccccccagaccagcaagcgcaccaagtcaaaagcatctgatatctgtgcccagaccgagaacaactctgttatagtatcggaggcagaggctttggaacagactttgaaagagaaagctcgtctattggaggaacaattggagttagctaggaaggcagaggagttgctacggaaggaggaggaattaagcaaagagagggctgccgctgagaaggagcggcttatgatggagcagaaggctaaggccaagaggtcgcaggagaggaagaggcggaaagccgagaaggacatggagaaagccgagttcaaagcgcgc

SEQ ID NO: 23474 - DNA, 341 bp, Zea mays
  Clone ID: cC-zmle189048b02a1
ttttaaaccacacaagatagttactaagttaatcgcagattcagttcacggaagaacagaacggtatacattggtcagacgaagaaaccaacaaatctactggagcaacagggaggaagaaggatgacaatctcacggaccagcagaacggcgccgcaagcgcgatcaggtcacgcgatgacaaacaccctgagctcccccctgtccccgcgggtgacgcgcgtgtcgtcgtcgaggtaggtcacctcgaactcgccgctcccggtgttggacggcggccggaggttgtccgggatgcggggcacctccagcggaggaagctgcgacaggttgcccttggt

SEQ ID NO: 23475 - DNA, 341 bp, Zea mays
  Clone ID: cC-zmle189048b02d1
accaagggctacctgtcgcagcttcctccgctggaggtgccccgcatcccggacaacctccggccgccgtccaacaccgggagcggcgagttcgaggtgacctacctcgacgacgacacgcgcgttacccgcggtgacaggggggagctcagggtgtttgtcatcgcgtgacctgatcgcgcttgcggcgccgttctgctggtccgtgagattgtcatccttcttcctccctgttgctccagtagatttgttggtttcttcgtctgaccaatgtataccgttctgttcttccgtgaactgaatctgcgattaacttagtaactatcttgtgtggtttaaaa

SEQ ID NO: 23476 - DNA, 534 bp, Zea mays
  unsure at all n locations
  Clone ID: cC-zmle189048b03a1
ctgaatattcagttaagaccattccaaggctccttttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgtccaaaaaatatcatattcgtaaagcagaaacataaatgtactcccattaatgtggaataggcggaactgaattagtcaattcaagttgacattgtcaatttatccagaacttctctcttttcctcggtgaaacaagaatctgttttgctcaaaccaaaggcaaggagcgnctactttagcctttatttcttt

SEQ ID NO: 23477 - DNA, 593 bp, Zea mays
  Clone ID: cC-zmle189048b03d1
aaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagacttaggtctatatcatatctaaatagaagggaaatcaaaaagacgggagtggtgattacattggatgaatccctcaggaagacatatcacaaaaga

SEQ ID NO: 23478 - DNA, 578 bp, Zea mays
  unsure at all n locations
  Clone ID: cC-zmle189048b04a1
ttttatagacacaccacatatatactatatcagtagagagagaaaaaacgcagagtaggaaaatgtccatgcagagacacacacaccacacatcgatcaccaaacacgcgtacgaagtaccatgcacacacatcatcagtaactacacatgatatacatagacgggcaatcaaacccccgtgacttcgttcgccctccatgcatgctccttctggtcctggggagcagcctacgtacgcaagtagatcgatcgagcagcagcccgatcagccgaagaagtggtgcttcttcttcccctcgccgcggcggccggactcctcctccttcccggcgtcctccgccgcgtctttggcctccttcttgtccgtggtgctcgtggaacgcgaagccgccgctgcccagggcagccaccgncgccacgccctcctngatcttgtgcccgggcgcgtgctccgggtccttcttcgcctcgtgcctctcgtactgcatccgtcggtccggtcgatcatgcatgcacatggtcgtacgaaagtgtcacagtgacacgaagacatgcgtgacagtccggacgcgtgggt

SEQ ID NO: 23479 - DNA, 563 bp, Zea mays
  Clone ID: cC-zmle189048b04d1
gactgtcacgcatgttcttcgtgtcactgtgacaactttcgtgacgaccatgtgcatgcatgatcgaccggaccgacggatgcagtacgagaggctcgaggcgaagaaggacccggagcacgctcagcggcacaagatcgaggagggcgtggcggcggtggctgccctgggcagcggcggcttcgcgttccacgagcaccacgacaagaaggaggccaaagacgcggcggaggacgccggggaggaggaggagtccggccgtcgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcatggtacttcgtacgcgtgtttggtgatcgatgtgtggtgtgtgtgtctctgcatggacattttcctactctggcgtttttctctctctactgatatagtatatatgtggtgtgtctat

SEQ ID NO: 23480 - DNA, 402 bp, Zea mays
  Clone ID: cC-zmle189048b05a1
ttttgcattaaggcctgcttgcactactctttataccttttgtcatttcaactgaacaatgttgtaacatccatcatccaaggtaacagcaatgccacatgaacacatagacagttgtacagatatgtttacagattctattcttccagcccaggttttaacaaacataaaacagaccaagcccgccatgaattgcggaaatttaatgcactcactgaccggaacaatattagctgaacatatacataccctacacctcccttgtgaaccaaaaattgtgaagcaaggcatctgtcaaaacaaaagcttgcattatcaagctcatatatcaacatcacctccggagcttgctgaatcagcatcactaccatcgctgtcactgctgctgctcccacttccact

SEQ ID NO: 23481 - DNA, 402 bp, Zea mays
  Clone ID: cC-zmle189048b05d1
agtggaagtgggagcagcagcagtgacagcgatggtagtgatgctgattcagcaagctccggaggtgatgttgatatatgagcttgataatgcaagcttttgttttgacagatgccttgcttcacaatttttggttcacaagggaggtgtagggtatgtatatgttcagctaatattgttccggtcagtgagtgcattaaatttccgcaattcatggcgggcttggtctgttttatgtttgttaaaacctgggctggaagaatagaatctgtaaacatatctgtacaactgtctatgtgttcatgtggcattgctgttaccttggatgatggatgttacaacattgttcagttgaaatgacaaaaggtataaagagtagtgcaagcaggccttaatgcaaaa

SEQ ID NO: 23482 - DNA, 527 bp, Zea mays
  Clone ID: cC-zmle189048b07a1
ttttgaacatactctggtaaagtttgaaatcaaacaaaaatcgtttgacacatagtaagagttacatttattacaagtcctgatatactcaaaatgcataacttattacaaaagcaggacggtaggaaccctccaaagcttatacactagcctaactagtcttcctccagaactggaaacgccctccagccacaggaacacttagagtactcctcatcacctttgttgcagagaagagattctagatccttatacctaacctttagttagatagctccatccacttgatgagcaggcactggagtagacttcttcaagtaccacctcatctaggtgttcttcgaagctgtcggtacgcgcgcgagattaaccggggatgacgcagttcaaagggtcgacggtgaagcggtctgcgacaacgttctgcggcagcgagaccctgttcgcgactaagttgatctcaaatttcacaaggaccataattaccaccattttattcatttcaccggctgatgcattggagcttc

SEQ ID NO: 23483 - DNA, 618 bp, Zea mays
  Clone ID: cC-zmle189048b07d1
cccacgcgtccgcccttctaccccttgctcctcagccaggcttgttagccgagcccctccaactagcgtgctagacctttgacgccgtttccccgtcgtccaagctccaccatgcccacacgtccgtcctgctcctccatgcacacgcccatgcatccttatctccctggaaacttcactcgtgtacggctccctggtgataatattcagcgatgcttcgccagggcaccgttcccctgcgcgctcgctggacgccgtcgcacatgctccctgctcggcctccccggcgtgctgctccctcgccttggtgcccctgcgagctccttctctctggcccggtttccagctcgggcctcgctagatgccgatgccgcttttctgacctcgtctcgatactcaatcgctgcagcacgccatgccgtgtgtgctgcactgtcatcattcgctatcctcatcttttgctaattttctcgtcgtttctcgtctacaaccttgtcagctcctgcgtgtcgtgcgcgtcttgtgttcgggtcgagccccaggattttgaggaaaaggaagctccaatgcattgggcggtgaaatgaataaatggattttgaagaaaggaagctcaat

SEQ ID NO: 23484 - DNA, 528 bp, Zea mays
  Clone ID: cC-zmle189048b10a1
aaagacaccggcaatatattcattggtacaagattaaatacgtgaacatagtaagttacatcacacgtgggcagcgtgtacatttctccgggagagcatttagcacacaaacattactggtgaaagttacattggacaacatttaaaaataaacttattcttgctactatggtattgaacttctgcagatcaagggtccaaaacctctcagtattatatgacaaccactttgtgaaatatgattgacactacaagtacaaaacttttcaacaaagaacaaggatacattgtcaacagtttagcaagcgaacatgtctgaagctgtttgaattaggccaaagataccaatagatatcacttataaaaaggggatctgcaatcctcacttactcgaagaacttaagaatgtactgtagttaaaactggagaactcttacatgacgatctcaggcttcagaatgcttgacttgatctctctgtgtgggagaacaacaccgccattactggataccttgtcacacacatgaa

SEQ ID NO: 23485 - DNA, 330 bp, Zea mays
  Clone ID: cC-zmle189048b10d1
acccacgcgtccggaacagcattatcgggtggcactcaactgttggacaatgggcacggatagagaatatgaccatcctgggcgaggatgttcatgtgtgtgacgaggcatacacagatgccgggcttgttctcccacacatagagatcaagactagcattctgaagcctgagatcgtcatgttagagttttccagttgtaactacagcacattcttaagttcttctagtaacagaggattgcatataccctctttataaatgatatctatagtgatctgtggcctaattcaaacaggttcatacatgtgcgcttgctaaactgttgaca

SEQ ID NO: 23486 - DNA, 481 bp, Zea mays
  Clone ID: cC-zmle189048b11d1
gaattccgggtcgacccacgcgtacggaaggcgccccttcctgccctcacatgcgctcctcccttcccgacaccgaccgacccctcgtccgctaggctgcctcccaccgccatagccgcagccgccaccgccacgtcgtcctgttcttccttcgagggtccgagcgacgaccgcacctgcgtatccgctgaagaggtggcggcgggcgcaggggctacaggcatcgacgaccgggagaccgctgattgcggggtgggcgccatctgtcctgacaggatagcagtacaggagaccaccataggcacgggttgcgaccacgcctacagagcgaccgggagatcgaggtgggcaggctacaaggataaccgtttaaggcccaatggccagaatgcatccgaaaccctaaggggcaactggtttcccacagctggaaaccaggtggtcaatagaataggcgaaatggtggctggaaagtttcaag

SEQ ID NO: 23487 - DNA, 575 bp, Zea mays
  unsure at all n locations
  Clone ID: cC-zmle189048b12a1
ctactccgagctgttcaggacgctttgctggcgagcacccaccacaccagttgctaggactacatgaatggatcatatactagctcgttaagcctccatgatgtcagtgtcgacgatggacaatcagctcttgataacagcagtagaacctctagtccttttgatatcctgactcctcaagatgttatccctatcgaaacggcaaggtctagattcttggacctcgttgttgaaagctttatctgtgagcatgttactgagttggtggaatgctctagctctgactgcagccaggtggatggcaaatcaagcaagagaaagcagcaggaggttcgatacgagggtgacccaagggttgctttgccattgatgtatatagcaaacctgtacgaaaccttgataagtgatgtcaatgtgcgtcttgcggcactgattgggttccgtgagaaaactataggtctagctcttgaagcttcangtggcttgtacaggaaactgatccagaggttcccaaagagaggccactgcagcttcagaggagggagttagcgacttctcatgcaaccaggacaaag

SEQ ID NO: 23488 - DNA, 240 bp, Zea mays
  Clone ID: cC-zmle189048b12d1
aactcaaaagaaaacttaaccattacgctagagacccttttacaaataaccctgttacaaataagactacaattgctacatcatcagattcatatacacattgatcaagtgcaccgcgcattcctagcctcttggcacctcactctgagcagaactttgatgttgccctcaaatatggggagccacacttatcacagaactttgccgggctgtcttaaccattacgcttagagacccttt

SEQ ID NO: 23489 - DNA, 388 bp, Zea mays
  Clone ID: cC-zmle189048c01a1
gggccccctattttttttccttttattaccggaaaaaactgaatttacacccaaaattacaaacaccatttttgaggcatcactaccagcttggggcccgggcatatgttgcattcagggagtctatgatttcagggctttaaaacatttggacccccgggttaggaactttaaaggacggggcccggaaaaaccccttttttttgaaaaaatcttggcgtttggggctgccccccgcccccctgggtaacaaaaggggcaattccaactcgacaaggggtttttgttctaatttacaaaagggggatccctcatatgcccaaatttttatgggctgggatgggacctttgaaacaaaggaggaatttccctttccaaaaccaccaaa

SEQ ID NO: 23490 - DNA, 601 bp, Zea mays
  Clone ID: cC-zmle189048c01d1
ccacgcatccgcaaaacggctccaacattccgacctaaagtcctcgaaatgggtggaaagaaacaattcccttacatggtggatccaaacacaggggtcgccatgtatgaatccgatgacatcataaaatatctagctgatacatatggcgatggaactgttccaattatgctatcacttggtctgttgacagcaattacagcagggcttgctactcttggtcgtattggaaagggaaattcctacattgcttcaaaagtcccatcccagcccatagagatatgggcatatgagggatctcccttctgtaaattagtacgagagacacttgtcgagttggaattgccacatctgctacacagctgcgcacgtggcagccccaaacgacaagaatttttcaagaaaaaggggcttttccaggcgccgtacatcgaagatcctaacacgggagtccagatgtttgaaagcgctgaaatcatagactacctgaatgcaacatatgccctgtacccatgctcgtagtgatgcatcagaaatggtgattgcaatgttgcgtgtagattcaggtctttccgtaataaagggaaagaaatagtgggcc

SEQ ID NO: 23491 - DNA, 405 bp, Zea mays
  Clone ID: cC-zmle189048c02a1
ccccaaggggaaataaaaaaaaccccccaaaaaacccccggaaaaaaaaaaaaaaaaaaaaggggggaaaaaaaaagggggggggggccccccaaaccttagggaaaaaaaaaaaaccccccccaaaaaaaaaaaaccccccaaacccgggtaaaaaaatcccccggggccaaaaaaaaaagggggggtttggcccccccccccccaaaaggggggggggggggggccccccccccccaaaaaaaaaaaaaaaccaaacccccccccaaagggggttggggggaaaaaaaaacccccggggaccccaaaccccaagaggggaaaaataaaaagggccgggggcctaaaaaaaaaagaaaaggggcaagggccccaaaaggccaccaaggaaacccaaaagggggg

SEQ ID NO: 23492 - DNA, 510 bp, Zea mays
  unsure at all n locations
  Clone ID: cC-zmle189048c02d1
gtatggaattcgtttccttgaattgcttggacgtgatgagaacgcctttgaccacctgtactgtgtggcctttcggttgcttgatgctcagtggcttgtgaaacgtgcctcctatatggaattcaatgttagcatattgagtacattgatccttctctttctgttttaagacactggcattcttaatttcttacttctttggctttgttgtaccaggaggtcttgaaatcaacaagaactcagctggagcgggaactggttctagatgatgtgctggaggtgaaggacctgccgtcctacactatgctggatgagtaagctaaagccgagctgttgaacttggacgctggagaattgactaagctggtctgatggctaatagttatctagcgtatgctgatgtctgatcctaaatgcttatgcggcccacatgccattttacattgccgcatatnttttttcttgttgtatactgaagtcttatgaagtgtttatatatgattcctttgt

SEQ ID NO: 23493 - DNA, 429 bp, Zea mays
  Clone ID: cC-zmle189048c03a1
tttttttttttttttttttttttttttttttttttttttttttttttttttttttttttttttttttttttttttttttttttttttttttttttttttttttttttggggggaaaaaaaagggggcattttggccatttggtaaaggggggcccctcaaaaaaaaaaaaaattaaaaagggggacccttttttggaaaaaaaatggggggttaaaaatttttgggccccgttccccaaaaaaaatttggggggggaaaaaaaaactttgcccaattgggggccccttttgtttttccaaccaaaagtggaattgggggggggggcccttcccaaaaaaaagggggaaaaaaaaaaccccccccccccgggaagcggggggtcaccccggaaaaccgggccgggccccggggggggaccaacttttcct

SEQ ID NO: 23494 - DNA, 487 bp, Zea mays
  Clone ID: cC-zmle189048c03d1
cttcctgaattcccgggtcgacccatcgcgtccgcggacgcgtgggttgtactgctacgccattgtctcgagcatggaccacgccagcagctgcagcttgggatggagaagcgaaaggggtcagtgattgtgcttaggtttttcatctctctcctaatcttttttgtgtaactggagcaggaaatgctgaaacctcaagcttctgtccaaacgatgtactcctatttagtattattgattgattgagaggccgatcgataacaaatgaacaaatagaacactgttcatgacgcaaaaaaaaaaaaaaaaaaaaaaaaaaaaaaaaaaaaaaaaaaaaaaaaaaaaaaaaaaaaaaaaaaaaaataaaaaaaaaaaaaataaaataaaaaaaataaaaaaaaaaaaaaaaaaaggggcggcctttttaagggacccaagtttacttccccttgcttgcaacggtttagcctttttttggggcccccta

SEQ ID NO: 23495 - DNA, 452 bp, Zea mays
  Clone ID: cC-zmle189048c05a1
gttggagataactctgctaagagcagagaaggaaacccttttacattacatctgagacaggccaatacgcctgtcaacaaaatccctcaaaaatggaaaaaaacaagaggggaaaccctggatagatatcatccagtaatgtcctagagcctactgacggtatccacttttgtttacagggactgggggaggtctgtacagcatgtttttgccgttgttccgagccaccaggtttgcgcaacaacttccgggcgctctgctgctgttcgtacgacccggcgtatgacagtcctgctcttcgtctaacgcgacgctactccttgatgtcttgatcttcttgtagggcgtctctttcttgcgcagatcttccaggcatcgcacttcagacatgcacgcgaaggactgggacttgccgtcgtagtatctggaaagccctttcttgacagggagct

SEQ ID NO: 23496 - DNA, 592 bp, Zea mays
  Clone ID: cC-zmle189048c05d1
ggaagcagcgagaggagccgaggaagaatatatccatcctaacatccacacaccagacagacacacataccttattctgcgccgtttcttggcctccggaaatctcctcccccaagttgcaagcatgggcgggttcagcctcagcggcgctacaggtctcgcggcgtaccgcgaggaagacgacgaggagctgttcgagacgtcgtcttcgatctccggcgactccgacgacgagggccaccagctctccgatggagaggggggcgcctatgatttgtcatctgtgatggcacagctccctgtcaagaaagggctatccagatactacgacggcaagtcccagtccttcgcgtgcatgtctgaagtgcgatgcctggaagatctgcgcaagaaagagacgccctacaagaagatcaagacatcaaggagtagcgtcgcgttagacgaagagcaggactgtcatacgccgggtcgtacgaacagcagcatagcgcccggaagttgttgcgcaaacctggtggctcggaacaacggcacaaacatgctgtacagaccttccccagtccctgtaaacataagtggatacccgcag

SEQ ID NO: 23497 - DNA, 429 bp, Zea mays
  Clone ID: cC-zmle189048c06a1
agtgagaaaatttcaatcttctgattatagctggtccaacaagcacaaagtagccatcaaaactttaacaagtcgagtttaacacatgagtctcaagttctgaacaaaaagctaaagcgcataaattaggccttctaatgaaggacccatttctttgatgtaggaagttctccacagcagcacagtggcctcttcaacggtacttgatgaaaccaatgtccttggcgttgctgcggaagcactgcctgcagcacatgagcccgtacttcctgatcagaccgtgagggttcgcgcagacccggcagacgcgggagccagggccgtagttcttagggtgcgagttccaaacgttggagtgacccatcgcgtcgtgctccttgctcctcctcttccttccgtcacggcggcggcggcgcgaggaagaaaaag

SEQ ID NO: 23498 - DNA, 429 bp, Zea mays
  Clone ID: cC-zmle189048c06d1
ctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttaaactcgacttgttaaagttctgatggctactttgtgcttgttggaccagctataatcagaagattgaaattttctcact

SEQ ID NO: 23499 - DNA, 423 bp, Zea mays
  Clone ID: cC-zmle189048c07a1
tatcctctaccgcggtcgcccttttttttttttttttttttttttcatggaaatgggacgcttatgaaaagggttttggatgaatatgtcaacggtgacaaatgaccttttacgtcagatcaccctttgtcttcattcttacccaatttccatccgctgatctaacctcttgacacagcacagaaaatatccccagatcaaaactaacattcatagctgttttagaattagacccaaaaacctaaacaattttttcctgagcggcactccaaagagatgagggtcacttgaagccttttgcatccggcaagggcttgcccttaaaaggctcctggtcctccatcatgggattgaccccctccttttgggccccatcagagagggtaatcttggtccactccccacgcgttcgaggacgcttgg

SEQ ID NO: 23500 - DNA, 238 bp, Zea mays
  Clone ID: cC-zmle189048c08a1
ttttggagaagccgtagtcgcagtaagctacttacaagaatgcttgcactcatcttcggcgtcacgcggaaattcattgtactgaagatggcactgataacatatctggcatttatcactaagtgttctacgattggtccgtggtccgtactaaccgaacctgtccttttactgtcgtatagtggaggatcgagatggatcagtgtctgcctaatttgggcatatgccattgaccact

SEQ ID NO: 23501 - DNA, 81 bp, Zea mays
  Clone ID: cC-zmle189048c08d1
attaatttttttttttttttttttttttctttttttcattttcttctcagggtaggggttatttacaataatcctaatcaa

SEQ ID NO: 23502 - DNA, 404 bp, Zea mays
  Clone ID: cC-zmle189048c09a1
gcaggcctcgactccaaaaacatatttccacagtattcaccaattgtcatggatacataccaaagtaaattgattcgaaagcgtacatctggttatatatatatcacggtttctgaagcagactgcggcccggggcgacagccgacagtggcaggcccacgcaccctactcggactcctcgacggcggccttcacccggagcagcacgaacccgacggcgacgccgactagcacgaggccgttcatggtggcggcgatcctgaagatctcggcggcgtcgttcatctgggcgccgaacgcgccgccgcgccgattcctgcccgcggggctgagcgacgccacgaccttggcgaaggagtagtcggcggtcttgcgcaccccgagcatgttcaccttgttgagcc

SEQ ID NO: 23503 - DNA, 379 bp, Zea mays
  Clone ID: cC-zmle189048c09d1
gggtcgacccacgcgttcgacaccaccacctcgccggccacactcgtctttctcactagccacagaccacaggcacaggcaggctctggagctcagtccacccatcgcaggggatggcgttgtcgttcgccgtggcaacggtcccgtcgctggcggtcccggcggtcaagaagcggtccggcggcgtcacgtacgtggagggcatgaacgcctacagcggcctcaaggggctcaacaaggtgaacatgctcggggtgcgcatgaccgtcgactactccttctccaaggtcgtggcgtagctcatccccgcgggcaggaagcggtgcggcggcgctttcggcgcccatatgaacgacgccgccgagatcttcaggatcgc

SEQ ID NO: 23504 - DNA, 561 bp, Zea mays
  unsure at all n locations
  Clone ID: cC-zmle189048c10a1
ctccagcccgaccctgcgcgggctcgaacgcacaacattttttgctcttattatttagtttccaatacaataatatatgcatgcgataattaacatgtctacatatatacagaacatgccagatagaaattatacatatatgcattagggacgatgggcatttgcatacactctcaaatgccaataatttatttgttaatctaggacatcataaggctatatcgttcctctcaacctccaatgctatttcatttctccttgtgaatggaagtgtgaacggtggattgtactgtgcgacttccaccaccgaatcatctttcactctaaatgtggtatctttacggagagattcgcgcaatttagactccctctggtttatatcatcatcagtaaccaaacctgaaaaggctgcaacggcaactattttgctgggcacctgcttgataatcacagaaggatcttttgggcgaggcaaattggaaccatacttcgctggcatcacaaatgacattttccatttattngtaccagctgacttttatgtatcactgggtcgtcatg

SEQ ID NO: 23505 - DNA, 351 bp, Zea mays
  Clone ID: cC-zmle189048c10d1
ccacgcgtgctcccacgcgtccgtcatatttattcggtaagaatactgttttctgagcaaatggaaatgacaacacctgtgtttactcggaagggtgagtcaaacggccaatcaatggacatgacgaccccagtgataacaaaaaagtcagctggtacaaataaatggaaaatgtcatttgtgatgccagcgaagtatggttccaatttgcctcgcccaaaagatccttctgtgattatcaaggaggtgcccagcaaaatagttgccgttgcagtctttttaggtttggttactgatgatgatataaaccagagggagtcttaattgcgcgaatttttccgtaatgatcca

SEQ ID NO: 23506 - DNA, 536 bp, Zea mays
  Clone ID: cC-zmle189048c11a1
ttttatctcaacatgggttttgtttattaattagatgtcttaatttacaatgtcctcactaacactctaaatataaacaacactgaaggacagaacgtccatttcatcctgcacctaaaaaacctttctcccgaaaaaagagggatcaggtacaacagatgagtctggtgctcctgagataccaccctagagtatcataagcagatgacacgtctgtgattatgacttcataggcaatgttgagaggaaaacatatgatccaccaatatcacaatagtattgatgtgcagagctttcagcaatgaggtggccatttgtttgaccaacacttgttggccgtcccgttgtccatccctgcgctcttaatgaggttctgtagcttctgagggaggtcattctctactatgagctgttttggtcgaggatgatgctcatagacaacctttatgagtttcagcagagtcaagcgggcaatagcttctcgatggtcaagtcttgcaatgagcaatgttgttaaaccattggtagccattgct

SEQ ID NO: 23507 - DNA, 539 bp, Zea mays
  Clone ID: cC-zmle189048c11d1
agaacaagcagccgaaaatggaatcatccctcacttgatgaaattagtcatgtcagactcacctctgcggcagtatgccctgcctttgctgtgtgatatggctcatgcttctcgcaactctagagagcagacgagggttcatggaggactagatgtgtacttaaatctgctggaggatgatgcatgggcatgcacggcattagattctattgctgattgtttggctcatgataatgatcacagaaaagtggaacaagcactgttgaaaaaagaggccattcagaaattaatgaagttcttccaagattgcccagaacagtattttggccatatattggacgctttcttgaagataatcacgaaatcttctaggctaaatacagcaatggctaccaatggtttaacaacattgctcattgcaagacttgaccatcgagaagctattgcccgcttgactctgctgaaactcataaaggttgtctatgagcatcatcctcgaccacaacagctcatagaggagaatgacctccctcagaagc

SEQ ID NO: 23508 - DNA, 476 bp, Zea mays
  Clone ID: cC-zmle189048c12a1
ctgtaatggctcagtatagttttagtttcagtacttaccagtcaatgaattggatgatgtaagagtaagacgaatggctctacaccaaagaatgaatgtcaaaatcccgtccaaatagcgctgactcatgaaaactttcgccagcgaagtatcatagcatgtctacctatcaccagtctgttagtgctactggctagagttttgttccagcttctccaactaggttacgagcttgaaaatttctgcaactgctcgatcacgacactgatatcatcagtcgagcccctggaaatcgatgtctcggtgagcatcctgcaggcagccatgcgagaggccttgtcattgctgatgcaaagaggtcgtgcaaggtctaccgcctcctgattgtcgatcttatcccagaggccatcagatgcaagtatcaagaactggcactgctggtcaaccaggatccgtcttgtgtctgggtcaaccac

SEQ ID NO: 23509 - DNA, 348 bp, Zea mays
  Clone ID: cC-zmle189048c12d1
cccacgcgttcgccaagaccaccagcaggactcgcgaggagagctcgcccggaaagaaaaaaaaaccctagcccggcccgggccttcgcctcgcgatgtcttgcacggtggccatcccgagctcgccagtcttctcgccctcacgccgtccactctcctgcaaggccgcctccgcctcaccggagcccaccgtccccgactttaccgcggtgcccgcgcccgccgccgccgtcggcttgccgatccgacccttcgcgcttcgcgcgctgctgctggaggaggtcttcccgttttcgccgtcccagttctaccctcagtcgtaagggtggctttggtaccatgcggggc

SEQ ID NO: 23510 - DNA, 430 bp, Zea mays
  Clone ID: cC-zmle189048d01a1
aaaagacttaagtttttaccgattgattgattgatgtgtaacatctggaaaccaggtacctaaacatggtacatggcacataaacccgttccattgattgaacgatggatgtcatcattatggccctttattggggggtactcatatatatgggggcgcagacctcctgggctgtttctaaaaaaaaaaaaggtgcataaacgggtacctgggccacaaatccccaaggggtcgaacgaaatacttctaatggggaaatggcacaaagcggatccgacaaatacctgggaggaaacactattaacagtcttttaaaaggcgggagcctacccctggggctgcctcacattggggacgcggtcattcaagggcccaccctttgatttggcttgaacagccttacaggcattccacttgggcccgacctttt

SEQ ID NO: 23511 - DNA, 488 bp, Zea mays
  Clone ID: cC-zmle189048d01d1
ccggaattcccgggtcgacccatcgcgtccgactacgcgtagatcacacgcgacgatgggtctgttggaggagcgggtggatgatgcttgtaaggcgatgacactgtctgtcagcacgagcactgccaacaggctaagactgtactgtctctacaggcaagccacggtgggagatgtgaataccgatcgttcgggcttattctacctatcggacagggctcatcgaaagacctggaaggctgtagcttgcaaatctcacgacgagtacaggtaggactacctatactaagtgaagctgctgcaggaggaggctgccgcctcttaaaagtctcttaatagtgttgccaaacagctatttgtcagatgagctttgtgccatttcctcattagaagtatatcattcgatccattgcggatctgtgaaccatgtacctgtttatgtaacttgctattttttcgaaagagcgcaggaggactgcgcacccata

SEQ ID NO: 23512 - DNA, 493 bp, Zea mays
  Clone ID: cC-zmle189048d02a1
gcagcaccaagaagcaccattttttccttaagattaacttagaataaagcctgacgggggtaacagcatccatcgatccgcagtccatgctgattgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgatcagttcctccagttcccgtcggagttgccgtagccgccgccacggttgccaccgccgtagccgccgccaccaccaccgtagccgccggcggcaccgtagccgccgtcaccgccgtagccgccaccgacatcacggagcccgccaccgccgtagacgtcgcctccacggtcaccaccgtacccaccggcgtcgcctccacggacgccgcgggactggg

SEQ ID NO: 23513 - DNA, 469 bp, Zea mays
  Clone ID: cC-zmle189048d02d1
ctcttccgtaattcccgggcggaccaacgcttccatgtgagatggcttgtgctaactctacgcatctgcttcaattcaatgaggttctacagggttctagctcctaagggagcggatcgtgactgcgcaatctgatgcctaataccgatagcttagttacaggactaggatgctccactgacgcatgctcagtcaagaacgccttcagcacctacagagaggcacttatgtcaataacatccttcgacgtgacacgcaaagggcacacggattatgatgaataaccttctccacttaagaggcgatgacggaacgccatagaggtcatgaacccatgggagctggactgtcgcaccatgaccgacaacgaggcccaatacagatgagaccgttgtggctgcagcggtgggtacggtggcggccgtggatgctgcggctacggcggtggcgggcgccgtgatggcggtgg

SEQ ID NO: 23514 - DNA, 298 bp, Zea mays
  Clone ID: cC-zmle189048d03d1
aagaagccaccggtcaagggtacgccaaaacggcaaacatctctcggccaccacaatttagaaatgtaaatcgtgccactaagtcggggcacatgacaaaagaccctataacgaataatacaatcttccatcacctcaaagtcgactactgacctacattgctcgacaacatctatcacaccaagacaaagatcggatgcaacacccaactagcattcaactcctagccactcgaatactgaatattctgagcgatagttaggccaagtagaggatgaaacgtgtttctgcgcttgtt

SEQ ID NO: 23515 - DNA, 353 bp, Zea mays
  Clone ID: cC-zmle189048d04a1
gacggaatgagaagtgtgtgtatcacacagctacctacatgtgtagctagtagctaggtacaaaagatacatgacatggctccacaattttttacaaatatatatgcatacccaatcatctgacccaacagcaagcactgcactaatagcttatgtatgtatgtatgtggctccatgcttcaattctctctctatatatgttacaattaattacctcaataataatctcctctccctccaatgctgcttggtgtgtgtggtaccatcttccatgcatgtatgttcccaacctatacatacacctactaataatcttatcttaccagctaaatatatatatgcggacgcgtggg

SEQ ID NO: 23516 - DNA, 353 bp, Zea mays
  Clone ID: cC-zmle189048d04d1
cccacgcgtccgcatatatatatttagctggtaagataagattattagtaggtgtatgtataggttgggaacatacatgcatggaagatggtaccacacacaccaagcagcattggagggagaggagattattattgaggtaattaattgtaacatatatagagagagaattgaagcatggagccacatacatacatacataagctattagtgcagtgcttgctgttgggtcagatgattgggtatgcatatatatttgtaaaaaattgtggagccatgtcatgtatcttttgtacctagctactagctacacatgtaggtagctgtgtgatacacacacttctcattccgtc

SEQ ID NO: 23517 - DNA, 310 bp, Zea mays
  Clone ID: cC-zmle189048d05a1
tctggagcggccgccctactcaaccagtcttgttttttttattacacaagataccaagagcacggggcgcgcactgtctttaattcgcgcagagcctaaattgaaaaggatattaacgcccgtctatgagggctgcccacctataaacataggtgcttggcactactatagggatacatggatcaagggtggtgaagggtgtagagagtgtggatattgcttaaaacattaacccacgtcctggtgatgtttcatcactaggggcaggcggcgtcacgaaggccaccctcagaataacaacgccaggatt

SEQ ID NO: 23518 - DNA, 492 bp, Zea mays
  Clone ID: cC-zmle189048d06a1
gacgctgaaggtacgctatagataataattacactattacgcaggtacatttgtgacaccctagcccccttagacaaaagaacagaagaagcacctccgagagaacgttcagggacgctaccaagacgcctcaacaataggcaggcaatcatgtatggtactacgacaccaagacgacatactccagctaaggtacttgactcggcgaaaccaactgaaacagcggcaccacggcgcctgtcgccctactattgcagctatcctacaacatgtctgatatacgcaaaagactcgggttttttctccccacccagcatccttcaattggtcatgctcaagctcaattagcttcagcgtccttctctcgacctgacctgatctatgccgatttctgaggctgctgctgctgctgtcgctggccctgctgctgtgcctggggcgcctgctgctgaacctgcagctgctggatctggagcatctgggagttcatct

SEQ ID NO: 23519 - DNA, 544 bp, Zea mays
  Clone ID: cC-zmle189048d06d1
gcttatttattatatctggtgtaccaaaatttgttccagcaaatgcggcctcgaggctaggatttcaggatcagaaagtagcactagtgaatgatttgtgccatgatgccgtgctattggttgattttatttccttaaggtgcataacaagtttgcagtgcaaccattaccggctcatgttaaactcgataaagcttaggcaatgtttggtgccactgtctacttgtcaatggtcatgttgtgaattatgatcttttaggtacttgctcacccttcatttggtgtttctttctttctttctgtctttctttcaagtcttcaggttcagcaagtcaagttacatgcttacttttgaaatctatattcgaggtttcagtctccggagaactgatacagtgacgatgcattagtgcctgctgcattatatagttttttctacatttttctacattctttcttataacgtgaactgattcatgtggatgttctgtgcagccctgaacgaagcgttaaccgccgaggtccaacgtctgaaactcgcgac

SEQ ID NO: 23520 - DNA, 70 bp, Zea mays
  Clone ID: cC-zmle189048d08a1
ttttttttttttttttttttttttattttattttatttttttagaatttttttttttttattattttttt

SEQ ID NO: 23521 - DNA, 352 bp, Zea mays
  Clone ID: cC-zmle189048d08d1
attcccggtttacccacgcgtccgcaaatataagcatataacattgtttttctctaatagttgatattagttgttgagttaatttagactataataaaggaatagggttagtagcatttcaaccaccgtacattaagacctatcaacagagtgcttgcatgttgtatatctatatgtatagattcacatataggctataagcttgttcatatttatagggtagcattcatggttcaaaagtgatggctttcctgatagtgatagggtgcacacaaggctaatacctttctggtggtgatgataactcttgcttgttgagttcacttgtacgtaggttttaatccttttaatt

SEQ ID NO: 23522 - DNA, 470 bp, Zea mays
  Clone ID: cC-zmle189048d09a1
ttttagaggagcaacaggagctatatgtccattggaaccaagatggatgcaatgtacacgtacgcacgcacacacgttacaaagtcaccacctgcacctgccggccggcggcgcgatcgaggctgctgagtctgatcttaacaacggcgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgccttcagcttcagccccgccgtcgccttgcggttcgcggacggcgccagcccgaaccgtcccgcgaacagcatcagcgtcgtcgtcgtcaccatgatcaggttggtggcggagccgatgtagtcgcagcggatgccctgcgacgacgacctcttcctgcccaccc

SEQ ID NO: 23523 - DNA, 501 bp, Zea mays
  Clone ID: cC-zmle189048d09d1
cacgcacttgagctccaccgccactaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgttcgcgaaccgcaaggcgacggcggggctgaagctggaggcgcgcgactccggcctgcagacgggtgaccccgccgggttcaccctcgccgacacgcttggcctgcggcgccgtcggccacatcctcggcgtcggcatcgtgctcgggctcaagaacaccggcgccc

SEQ ID NO: 23524 - DNA, 504 bp, Zea mays
  unsure at all n locations
  Clone ID: cC-zmle189048d10a1
aggcacaaacacaaaccggctttattgtgagtctaaaaaacacgggtcccatcaagcgctcagagttccattacatggtatcagtgactttgctttattgtgatgttcaactccggataaaaacgtctcagttgaacacagacacccacaaaaagcttacatggacctagatacttgaaagtcataggatacagagtgtgctccacgtaattacatccatgggctggctgcctctcgtgcccgggcttggaagcgttcagctggacgcgacgaagccgatgctgaacccgaacgagatgcagctcagctcctcgttgtcgtccccgacaatcttcatgtagatcgtgtaggagcccggcggagtgaagcctggcagcgtctgctggtgggacagcacgaagtcgccggtcgctgggcangaagtctctccgcagatgtcacgggtctccgagtgcacgtagaagaagaaatacttgacgtcgataaccagcttccccttctcga

SEQ ID NO: 23525 - DNA, 413 bp, Zea mays
  Clone ID: cC-zmle189048d10d1
cccacgcgtccggcacgcaacaagtacgcaggcagcgcagcctcgagccgtcgccatggcgagcaagcacctcgtcctcgccgcatgcctcctcctcctcctgcccaccgcctcggtcgccaccgacgtcgactactgcagtaagaaggactacccggtgaaggtgagcggggtgcagatcctgcccgatccggtcgaacccggcaagcccgccactttcaagatctccgcttctactgataaaaccatcgagaaggggaagctggttatcgacgtcaagtatttcttcttctacgtgcactcggagacccgtgacatctgcggagagacttcctgcccagcgaccggcgacttcgtgctgtcccaccagcagacgctgccaggctttactccgccgggctcctacacgatct

SEQ ID NO: 23526 - DNA, 441 bp, Zea mays
  Clone ID: cC-zmle189048d11a1
gttcttcgaagatgatgatatgcaaaccatgctaaaatcaaatgcattaattccataagttctttttccctgatccgtgggcacttggctgtctgaccccaggttttggggttccctcctttggccacaaagcaagctcaccaaatccactccatataaacatgtattgatcatgattcattactatttttccggcattcagtgctattggccgtggccctatccactagcagtgcttgctgaacctcttctgtttacagcggtgatcttcagcatctgtcggagcatctggttctcgttctggagggtggaaagcctctcttccatttacgagttcttgttctgcagatctctcaccttcacctccagatccgttcaataagccttcttcctttctatagcctgtcgagctgacaccctgttcctcagtaaccttctgag

SEQ ID NO: 23527 - DNA, 497 bp, Zea mays
  Clone ID: cC-zmle189048d11d1
tgagttgcagggatggagagcgacgatgagataaggattgtgccggagctgggcctggagttgccgggagcctgcacgtcgggcagggaggctggccctggcgctgcgggcgcataccgcgcccttgcccagtcgtccacggagcatgccagcgcgcgccgccgtgtccgtagacacgccgacaaggagcactagcgcctcaaaaggttactgaggaacagggtgtcagctcaacaggcttcacagaggaagaaggctcattttactgatctggaggtgaaggtgatagatctggacaataataactcggagatggaagagaggctcttcccctttcaaaacagaaccagatgcttccacagatactgaagaacaccgctgtaaacagaatagggtcaggaagcactgcttggggagagggccacgggccatagcgctgattgtcggaaaaatagcagtgaatcatgatacatatatgcctatatggagtggatttg

SEQ ID NO: 23528 - DNA, 516 bp, Zea mays
  Clone ID: cC-zmle189048d12a1
gtaattcgagtaacaatcggacaatagatccaaacgaaacgattatccatgcaaccaaaataacaaagtcaagactaaaccaacccctagtataggagcagctaaaactccaacaaaccaagttaacaaagtcattacactctagatagggtaggattcaagcaaaaactggcagcacttccgaaacatcagaaacattaacgttcagctggagacgacgccatcattcaatgatagattagccagctgctgctcagtagaaacattgctctgctggagatgctgggcagagcggatgacctccatggcttcagcaaccttggctttcagagcatctggcgactccagcaggtgaagaaccttcgtctgatccatcttcaaaagcatgccagtgaccttggcagcctgctcacgttccagctgttcaacaagaggatacaggttctcaccaagcataagtctctgctgatctggtgaggcgttagcaagtgcagtggcttgcgccccaattggaac

SEQ ID NO: 23529 - DNA, 485 bp, Zea mays
  Clone ID: cC-zmle189048e01a1
gactagcaatttcggatatatagttcgaattcagatgtctcaacaaaactatggcaaaaacacctgctggttcatctcaacatgaggtctgctatggcttgtgtgagcgctacaggtgtgcggtgcgccaccaggcacaaagctccaaaacccttgcagcgttttaagatctcggcttctctttcttctccttgaagagggcgaggagggaaacgccagagaccttcacgaccttgaaacggacgccgggaatatctcccacagcatggcccttacgaccgaatccagcaatcagcacctcatcgttctcctcgatgtagttcaagcaaccatcgtttggcacaaaggcagcaatcttcttcccgttcttcaccagctggacacgagcgcacttacggatagcagagttaggctgcttagcctcaatgccgatcttctcaaggacgattccctttgcgtgagatgacccagcaaatggtttcttc

SEQ ID NO: 23530 - DNA, 513 bp, Zea mays
  Clone ID: cC-zmle189048e01d1
cccacgcgtccgatctcggcaacgagtggaagaaaccatttgctgggtcatctcacgcaaagggaatcgtccttgagaagatcggcattgaggctaagcagcctaactctgctatccgtaagtgcgctcgtgtccagctggtgaagaacgggaagaagattgctgcctttgtgccaaacgatggttgcttgaactacatcgaggagaacgatgaggtgctgattgctggattcggtcgtaagggccatgctgtgggagatattcccggcgtccgtttcaaggtcgtgaaggtctctggcgtttccctcctcgccctcttcaaggagaagaaagagaagccgagatcttaaaacgctgcaagggttttggagctttgtgcctggtggcgcaccgcacacctgtagcgctcacacaagccatagcagacctcatgttgagatgaaccagcaggtgtttttgccatagttttgttgagacatctgaattcgaactatatatccgaaattgctagtc

SEQ ID NO: 23531 - DNA, 415 bp, Zea mays
  Clone ID: cC-zmle189048e02a1
ttttttttttttttttttttttttttttttttttttttttgttttttttttttttttttttttttattatctctttcttaaatgggaaggaacaccccctcccccaggagaaaaaaaaaaaaaaaaactcgcccccaaaaaaaaaaaaaaaaaaacccaggaccaaaaaaaaaaagaacccccccaaccccagaaagggaacgggggggccaccccccccccaaaaaaaaggggggaaaaaaaatcccctgctttggccacggggagaaaaaaaaaattcccctttccggaaaaacgggacaaaaaaaaaaaccccccgccgggaaggggcgaaaaaaaaaaaccccgggggaaggcccctaaacaaaaaagagcccccgcagaaaaaaaacccttaaaaagggggacgggcccc

SEQ ID NO: 23532 - DNA, 602 bp, Zea mays
  Clone ID: cC-zmle189048e02d1
cccacgcgtccgcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtgtccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggattttttttcttcaattgttaactgtacgcgaatggaagcgacagatcattcgtaggttgtgagggcttcaaagatcatctgctgctgtacattgtttgttgctgtcttggtgacatacatgtcttggtgtttctcaactggaggactggtgttaacct

SEQ ID NO: 23533 - DNA, 545 bp, Zea mays
  unsure at all n locations
  Clone ID: cC-zmle189048e03a1
atgtgcaagatctcatttatattgcacaaacgatgttcccacaaacccagcacttatctaagcttattgtgagttcgacaagatgacaacacttgcagcgatgaagaagcgcatgaacaacttccattgatcaagctaatacttctatgatgctaatgcgctattcactgccacaggcaaaagacagcgtagagagaataaaatgcagagtcgatgcctctcttttgctttcttattgactgctcaagtttgctcagaaatggcaagggtattcctagccactagtaactaattgttctcagggtttcggacacgattcttggcgcaagctccattgcttgcgcaatgcttctcacctcagcgatcattgccacaacgtcgttgagtttgttaatagcagaaccgactccaactccagcagctcctgcagttactgccattggtgcagtcaccgagcttaaccctgacgagcacatcactggaatactaacagcccgagagatggagtatgctgcggcgagtgttggtgtngccttttcaatcaa

SEQ ID NO: 23534 - DNA, 561 bp, Zea mays
  Clone ID: cC-zmle189048e03d1
gggtggacccacccgtccgcccacgcgtccgcccacgcgtccggccaggctccctgcgacttttccaggccccgtccttcgctgcggccaagtgccagccggtgggtggccgggcatccgcgcggcgagcgccacggccactgttcgccgtgcgcgcctcggctgctgacgccgtcaacagggatgccgtgctcaaggccttccgcgagaacagggctctcatgataatttccggtcttcagaactttgacaggagcagtgttgcatctgttgtcacagctgcagataagggaggcgcaacacatgttgacatagcatgtgacaaggacttattaaagcttgccatggatcttaccaaccttgcgatctgtgtctcatctgtagatccttcagcgttccattctgcagtacaagcaggagctaaaatggttgagattggaaactatgattctttttatgagatgggcattgagttctcctctgagcagatactgaagctaacaagggaaacatggaagatgctttcagacatcaccttatcagtaacagtttctcacacac

SEQ ID NO: 23535 - DNA, 488 bp, Zea mays
  Clone ID: cC-zmle189048e04a1
tttttacaaacattcaggtcacacacgtactgtaataataatgatatttataacagagacaggatcatcgaaaacacacacaacaacgacaacaacatgcgatggacgacgagatgcattgcatgcatggacatatatataatactacatcatatatatcaacgtacgtacgtatatatactagcttggacaaattatttagcctgcagatggatcgatgggcgtgatcagaagcactggaagcccgaggggacgcgcctgccgcagtagttgacgaggaggctgaggttgatgggcaggttgaggttgatgcccaggacgttggccctgaggacggtgcagaggcacaccgccgcctccaggtccgccagcccctggatcagcgtgcagcacggcgtcctgggcggcgtccccagggtcgcgttgatcagcccgttcagcaagttggcgcacacgcccagcttcagcgcgtccacggggcaacgacc

SEQ ID NO: 23536 - DNA, 531 bp, Zea mays
  Clone ID: cC-zmle189048e04d1
cggacgcgtgggcggcggcggatctggcggcgggccgacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatcgatccatctgcaggctaaataatttgtccaagctagtatatatacgtacgtacgttgatatatatgatgtagtattatatatatgtccatgcatgcaatgcatctcgtcgtccatcgcatgttgctgtcgttgctgtgtgtgtattcgatgatcctgtctctgctataaatatcattattattacagcacgtgtgtgacctgaatgtttggaaaaa

SEQ ID NO: 23537 - DNA, 525 bp, Zea mays
  Clone ID: cC-zmle189048e05a1
tttttgtatcaacaactgcatgacttgcattatcagccacaaggggggctcgctgagttaacacagtgcattaacacattaacaagggctaaggcgctaagctgaccaagtgaacacaacgactgttcttttgacctctaccaacaactgcatgccatgccacacggtctacacatcgaacaaaacccgttcccctaacagcaaacactggtctagtacactgtacacctctgctctcaccacagcaaagggcaagggctgattcaccacagaagcagcacatctccccttacccatatggatgttaccactcacagtttgttacctcctctgcctttttggttcagccttaagctcaaaatttggtgaagtggcatatgcatttgaaagtctctttgaaccattttctttgaaacagtctgagcaaacaaagtgatctagctttttggcctgttcaatggtcatagccacacaagatggatggaaccagtgctcgcaagcatcgcactgcaccatgaggtcatc

SEQ ID NO: 23538 - DNA, 630 bp, Zea mays
  Clone ID: cC-zmle189048e05d1
ttcccgggtgcatttttagcttgcttgtgatgattgggttgtctattttctctcaaggtattgcaaatgtgagatgccgtacaaccccgatgacctcatggtgcagtgcgatgcttgcaagcactggttccatccatcttgtgtggctatgaccattgaacaggccaaaaagctagatcactttgtttgctcagactgtttcaaagaaaatggttcaaagagactttcaaatgcatatgccacttcaccaaattttgagcctaaggctgaaccaaaaaggcagaggaggtaacaaactgtgagtggtaacatccatatgggtaaggggagatgtgctgcttctgtggtgaatcagcccttgccctttgctgtggtgagagcagaggtgtacagtgtactagaccagtgtttgctgttaggggaacgggttttgttcgatgtgtagaccgtgtggcatggcatgcagctgttggtagaggtcaaaagaacagtcgttgtgttcacttggcagcttagcgccttagcccttgttaatgtgttaatgcactgtgttaactcagcgagccccccttggggctgataatgcaagtcatgccattgttgattcaaaaaaaaaaaaaagggcgggcg

SEQ ID NO: 23539 - DNA, 221 bp, Zea mays
  Clone ID: cC-zmle189048e06a1
tttttttttttttttttttttttttttttagaaaaggaatgaatgatcaaacgacgctggcaaaccaaattgtctttcacaggctacagcacatgttaaattatcggataaatttaaaccacccccaatttttttcccggtgtgcccacacatactaaaaggagggttctacgatattaatgacttttctacaacacggaaaagtctgattcaggccagtt

SEQ ID NO: 23540 - DNA, 140 bp, Zea mays
  Clone ID: cC-zmle189048e06d1
aactgagtcctttgaatgactgaacggtaggcccactatggcaaaaaaacttcactgtgcacataacgatgactatcctttgaaggatatttgttggaacccgagtactctgatctccacccaacgctaccagcagtaac

SEQ ID NO: 23541 - DNA, 571 bp, Zea mays
  Clone ID: cC-zmle189048e07a1
ggatcattcggtgaatatgggaaaatcattctcttttctctaaacataactgtccgacactccacctccaactcaacattttccccccttggttaccagaggccgaagcaacatcaacctcgagtcctcgacctgcaggtctcgtcgtcatctcccgtctgtcacgctacaaggttgaagtagacggtgtagaactcgtccctcaaggtgaacaatggctccaggaggaagctcctcctcacgcccctggcagcgaagctcatggggtggtaccgccgcagcggctcgccccgcgcgaagctggccgaccgccggaaccaggcgccgtcgccgcgcttctgctgggcaccaccggcacagcccacctgcaccttctcgccgccgccgaccaagaagcaccccggcctggacgcgagctcgagcgacaccgagccgggcgcaccggcgagccccggcacgacgttgaacgcggcgcccgagctcttctccgcggccaccgtgagcctgtccgtgaccaccatccccggcatgtccagcggctcgagcatcgcggcggcgcccgcgccggcgc

SEQ ID NO: 23542 - DNA, 280 bp, Zea mays
  Clone ID: cC-zmle189048e07d1
ttcctgggttgacccacgcgtccgcatgggttctctccatctgttctgatggacaatggagatcgcgtactcggactactacgagcgaacgctgatgagcggtgagctaaacatccaaaggggcctggaccctggagagaatatcttcatgctgccccaccgcccaggcagatccaatgcgatcagctaccatgggtgtggaactcatgaccaatcgtacaggtgctggtatggcacatgggatagacatcgctctacaagctgggagagtacatttact

SEQ ID NO: 23543 - DNA, 437 bp, Zea mays
  Clone ID: cC-zmle189048e08a1
ttttccttcacatcatatagtattcccccaattacgatcctacaaacacaaactgcacatccgaaccagccgattcaaaaaaagaggttaagctatcaacgttgcaatctgcacaagtccccatcacatcagatcacttcccgacggccgccagtggcgcgccgacgcccttcccgcggagcttgacctcgagagcgcgctccatcttggcaagcacggcctgggccggcgccgccttgccgctctcgtactcctgcagtcctgcaccacctgcgcgcgctcgttgatgcgcttcgccagctctgcctggctccatcccttggccacgcgcgccttctgaatggccgcgcgcaccttcacagccacccgctccaccgccgtgggctccgtcgtctcgtccagcttacgcgctggcgccaccgtcgtggagtgcttgt

SEQ ID NO: 23544 - DNA, 607 bp, Zea mays
  Clone ID: cC-zmle189048e08d1
acccacgcgtccgcggacgcgtgggcagcgtgctcgagattataagcacaaggaaatacaaggaaataagagtacagagatgccaactggtaggctgagcggcaacatcacccaggactgggagccggtggttctgcgccgtacgaagccgaaggcggcggacctcaagtcgtcgaaggcggtgaaccaggcgctgcggtcgggcgcggccgtggagacggtgcgcaagtcagcggcgggcatgaacaagcactccacgacggtggcgcccgcgcgtaagctggacgagacgacggagcccacggcggtggagcgggtggctgtggaggtgcgcgcggccattcagaaggcgcgcgtggccaagggatggagccaggcagaactggcgaagcgcatcaacgagcgcgcgcaggtggtgcaggactgcaggagtacgaaagcggcaaggcggcgccggcccaggccgtgctttgccaagatggaacgcgctcttcgaggtcaagctccgcgggaagggcgtcggcgcgccactggcggcccgcgggaagtgatctgatgtgatggggacttgtgccgattgcaacgttgatagcttaaccctcttttt

SEQ ID NO: 23545 - DNA, 402 bp, Zea mays
  Clone ID: cC-zmle189048e09a1
ttttggctttgcatctgcgtaatatgaatcatggaatgctctggatcgtatctgggactgcacagtatacatctcgctcggtaatcgaatggagagacaccatgcttaaaaggcgttgagataagcacatgtctatagtcttctctggtatcatggttgctagggaacttgatgcgaggcttgcccatgctgaaatcgaggactctggacctcatgttgtacttgatcaccccgtcacacagcagaatgcggatgtagcgctgaaggcctgacccgatcaaccaaaatgcgtactccgacagctcagcccgctcgcagtgatcgactagatcctgaaactcagcgaagaccatatggcaggcctcgactgtccaggcgaactcagcctgacggtcgagcatg

SEQ ID NO: 23546 - DNA, 512 bp, Zea mays
  Clone ID: cC-zmle189048e09d1
cccacgcgttcggacgagaagccgccacaaacatggctatcactgagttcttacccctggacatactgcctgtggaggagcgagggttcacttgcctaaagaagccgggacttatcactgtcagggaccctgcgacactagcgcagcaagagcaacctgcgcaggatgacgaggcccaggtgccaagcatgctcacgtcacaggacgcggacaggcatgcgacgaaggaggacgggcaggccctgttcgttgctcctttgccggagagcaagaacatgagccgcgagttcagcgggcagtggctgagcatcaccacgctgcacgtccgcatctacgctgcgtacatcaacccggtgaccaacgcgttctaccagacgctgatggacaagctgacgctcatgctctacccccagcaccagttcgcctggaccgacgaggcctgccagaaggtcttcaacgagtaccaggacctcctcgatcactacgagggggctgagctgcccaagacacac

SEQ ID NO: 23547 - DNA, 592 bp, Zea mays
  unsure at all n locations
  Clone ID: cC-zmle189048e10a1
ttttaagatcaaatgctctatttgtatttattttaaactaaaattaattaagagatcaaacgactcgtgaataaacatttatatagccattaccaatctataggcaagtggaagagttgcaacaaatttccagagacagtgtacattgttccctaatttcaacgattctacaatttaagcctttttttaatgatgactcctattagaatcacgagcctagacttgtcgtcatctcttttgatgtgtgttcgtacgttgctcatcgattctgaagttttgtcgcctgcttcgtcttatccgctgccttcctttgcctcgtcttcctctttggactttgctgcctcggccgccgcctctaccttcttctttgcctctgcttccaccttcgccttggccgcctactccttggcctgcttcagagccttcacaagactctccaagcacgcgttggcgtccctcttcttcttcttggacatggacatcaggttctctgccacatctgccggcgacatgtcggtctcctcgagcagctgccctatctggtcgaatagctcgtggctctcgacgtncaggtagttcttggcgagcacct

SEQ ID NO: 23548 - DNA, 569 bp, Zea mays
  Clone ID: cC-zmle189048e10d1
cacccgtctacgttcgacacgctcgccatggatcccgacgacaaggaggctgtcgtcgacgacctggaggcgttccgggaggccaaggactactacaccaaggtcggcaaggcgtggaagcgagggtacctgctctatggtcccccgggcaccggcaagtccaccatgatcgcggccatggctaacttgctcgactacgacgtctacgacctcgaactcacggcggtcaacaacaacaccgacctgcggaagctattcatcgagaccaccgggaaatccatcatcgtcgtcgaggacatcgactgctccgtcgacctcaccggcaagcgcaaggacaagaagcaggcggacaaaaaatccgaacgcgaggccgacgacaagcccaagctgccgatggagcctgaaaaggacgaaggcagcaagattacgctttcagggatgctcaacttcatcgacggcctgtggtcggcatgcggcggcgagcgcatcatcatcttcaccaccaaccataaagacaagctggaaccggcgctgataccgcgaggcaggatggacaggcacatcgagat

SEQ ID NO: 23549 - DNA, 323 bp, Zea mays
  Clone ID: cC-zmle189048e11a1
cccacgcggaacggggaacccatggagagaacaagggacaaacccggaaaattcgaccggaacccaggaggggacccaactttcccaaaaggaggccgattaaaaaaggggggaaacaagggaaaaaaagtataccgagggaaaaaggaaacccgtcaaaaaataaaaaaaaaaactaagccggaacataaaagggaaaaaccggggggccaaaaggggggggcaaccccaaaaaaaaggggaggggcaaagggcacgtttacaaacgggaaaaccggagggccaaacggaataaaaaaaaaggcaaaaccccgggaaaaggg

SEQ ID NO: 23550 - DNA, 369 bp, Zea mays
  Clone ID: cC-zmle189048e11d1
cccacgcgtccgcggacgcgtgggaaaaaaaaaaaaatataaattaaaaaaaaaaaaaaaaaaaaaaaggagatggtaaaaaaaaaaaaaaaaataaaaattacaattttatatattggggcggccgttttaagggatccaatctttctcccccgtgcttgccattcaattttctttttattgtgccccctaaatcctattttctgggccgtagttttactacctttggattggaaaacccctggctttaccccccttaatttcctggcagttcttcccctttttcccagttggtttataggtaaaaaggccctcacttatcgcccttcccaccattagtctcccctgattggcacatgggcccccccc

SEQ ID NO: 23551 - DNA, 512 bp, Zea mays
  Clone ID: cC-zmle189048e12a1
cagaagtatccatgctactttttatataaattcggtcacataaaaagagactaactcaaaacaactcgcacattaactactcttcacggatcatagtgccagatacttactacctgactgtaagactaacaaacaggatacaagtatgccgcacacacaggcttctcgtacgatcatttttaggtgtaaatatgagaacgccaatctcatacatcagctacgattttggtagcaaggtacaggttacgtaggttctattggaacgtcaaactggaaatattcaggcacttatcgcaagaactcagctgtctaatttcactggcttcactttctccttgagaaactgccgaatgtgctctcgcttccagttatcaatccttatggtctccttctgttcacccttgttgtcaagcattatgagctttggtggcgaaccataagaattacgggtttccacatatgggaagtcggctttatcttcttcgaggaagccaacatcttctggataaata

SEQ ID NO: 23552 - DNA, 601 bp, Zea mays
  Clone ID: cC-zmle189048e12d1
gcctctagtcgtcgtcgtcgtcgtcgactcgtcgccgtggtgcttgcggcagctccggagtccaggcagcacgctagtcggggggcgcgggagaggagggatggatcggtcgtatctccccgtggcggcggcggcggccgttgccctggtcctcgtgtgctgctccggcctctgccgcggcgagcggctcggggcgagggagtgcgaggacctggggttcaccggcctcgccctctgctccgactgcaacgcgctctccgagttcgtcaaggaccaagagctggtggaggattgccataaatgttgcaccgaggattcagatgattctatcagcaagctcacattttctggtgcaattattgaggtgtgcatgaggaaactggtattttatccagaagttgttggcttccttcgaaaagataaagacgacttcccatatgtggaaacccgttattcttatggttcgccaccaaagctcataatgcttgacaacaagggtgaacagaaggagaccatactgattgataacctggagcgagagcacattcggcagtttctcagggagaaagtgaaggccgtgaaattagacagctgagttctt

SEQ ID NO: 23553 - DNA, 113 bp, Zea mays
  Clone ID: cC-zmle189048f01a1
ggattctaagggcatgtacaacccagatactgctgcacggtactccaagtataagatacaactaaaacataatataatacagtggtcatgtctaaaacatgtgtcttacgata

SEQ ID NO: 23554 - DNA, 525 bp, Zea mays
  unsure at all n locations
  Clone ID: cC-zmle189048f01d1
ggccacagcgaaaggtgagatattgcgtttgaggagacatattagtacaggtgggtctccgaacacccaagttctttcggaagcaggtgcagcgccaattagcagtcgagcactgaaacagcaacccatgaatgatcgtgttcaaaatatcaacggtgctgatgctgtaccgcctcgttcgcctaaacggatttataggaggaaacgcaaaccagcagcatgaggattatctgaatgccaagggctagattgagaactccatttttccaaccaaggctagattgagaactccatttttccaagggatttttaatttctcaagaaaaaagaactaatttctcttgggaaaatgaaaatcccttggtaaatagggaaaatggggttcacagactagccttaaaaacaaaagctggcgttctttttattcctctattattcaccttgttataacagcttgtgaactcccattcttcaaaaggtagacctncttacagtattatcttcggtggtgctggctctttcgtc

SEQ ID NO: 23555 - DNA, 235 bp, Zea mays
  unsure at all n locations
  Clone ID: cC-zmle189048f02a1
tnnttnntataaggacacatttttccacttccattttggaggggaaacccccctaaaaataaggggttcagggttttacaggggtggtatgggaaacacacacatgctttccatcacaacttttctttacatacaattggtaaacggaagaatatgaacccctccggggcccggggcccataaagaaaaaattaccggtggttgatctttaaaaacgggaggggcgggcccaaag

SEQ ID NO: 23556 - DNA, 609 bp, Zea mays
  Clone ID: cC-zmle189048f02d1
tcgacccacccgtccgaaaggcgcgatcttggaggttcccatgggcggatgcctctcgcttgaggagcaccggctccagagcaggccagctgaagctgctggagcagatggattgcggaagtctaaatctgattctaaagctgtagcatgtgttcttgctcctccaaaagatgtggtggacctgcaagtagaaggatatggaaatgtgaatattttcacatatgacgaattaagagcagccacaaaaaacttccggccagatcaaattcttggagagggtggatttggagttgattacaaaggtgtaattgatgaaaatgttagagcaggtttcccatcgagacaggttgctgtgaaagaactaaacccagagggctttcaaggggacaaggagtggcttgcagaagtcaactatcttgggcaacttagtcatccaaatcttgttgaattgattggctattgctgtgagggttcacatagacttgttgtctatgagtacatggcttgtggaagcctcgaaagcacctttttcgccgggtttgccttaatatgccatggtcaacacgcatgaagattgcttgtgtgctgcagggggctcgagacctttac

SEQ ID NO: 23557 - DNA, 380 bp, Zea mays
  Clone ID: cC-zmle189048f03a1
acggagtgaccttatttgctaaacatattgcactgaaagtaaacttccgacgacaccaagggaaaccaaaacggaatgtttggatcaggtaacagcaacagattaagcccggaaaagtcgatttacaccctcacttaggatgaaacccagcttgacttcgcctgctcggcggacaacgctttgatctcctgcaagttgtcacagcttccgaggaatatgccagacctatcttggatcttggttgggaccaaaacaagagcccgttctctgcctgtgaaggactggactcatggctgctcctttaagaaccacctgggtaaaacttcggacaagaaacggaactatccgtgggggttcttttcgtgagcaaggtacaaaaa

SEQ ID NO: 23558 - DNA, 358 bp, Zea mays
  Clone ID: cC-zmle189048f03d1
cccacgcgtccgagtcatgcccgcgcgctctatgcacttcatgcgcgtgatcaccagcagaccgatatgctgctagcgaggtaggtgtattcacagccagactggagcgtggagcggcggaagccatattgaccacagctgggacgcgcaccggacggacctgatgaccatcacgcggcacgtgctgaacgagcagagtcggaacccaaaatcccggtgcatcttgacatagctaactaccacatattgcttagggctaacttacacaacttgagaggaaaacatgtcaggctccaatagctcaatggactcgacgagcagagctaagagcccggaggggagcagaagaatcttcaac

SEQ ID NO: 23559 - DNA, 516 bp, Zea mays
  Clone ID: cC-zmle189048f04a1
tttttttttttttttttttttttttttttttttttttttttttttttttttttttttttttttttttttttttttttttttttttttttttttttttttttttttttatttttaatttgataatttttttttaaattataaaaaaaaaaatataaaaaatattaaatttttaaataagaaaaaaaaaaaaaaaaaaaaaaaaaaaaaataataaaaagcgaaaaaaaaaaaaatagctaaaaaaaaaaaaaaaaaaaaaaaaactttttttataaataaaaaaaaaaaaaaaaggaagaggttcccccctttccttttcaatatatgaaaaaaaaaaaaaaaaaaaattattaagtttaaaaaaaaaaaaaattattttttttctaaaaaaaaaaaaacaatttttttttttttttaaaaaaaaaaatttgaaaatgaggggttatttaaccaccttatttttggggggggaggagggcgcaaatatagaaggaaaaaaaggggtgtttattcctt

SEQ ID NO: 23560 - DNA, 569 bp, Zea mays
  Clone ID: cC-zmle189048f04d1
gttgaaatgttggagaagcaaaagaatgaggtcctggagaggatgagacggcaagttgggccaacggcaaagagaatttgtctgcggaggacattgacaggaccatggtgagctgtagacccgtacggctgtacctattagcagtatatatgtagtaggtgaaggtgaacacacaaaggccagagttgccctggttgacacagccattaatccggagcttcggtctcgtaggcggatagattgcctgtgatttccacttcataggttttgcccatttgcaacaacaaaaaaggaaaaggaaagaaagaaagttcgggcgaatagaggagtttgtatgtagaaagaaagtttagattgtttgactcttataatgcgagatgaagacttattttgggacagagggagtatattgcttctttaggctttctggtttggtgatatagggtgtaactgtatcatcactttcctgtgctttggaaaacggataaccaatttgtgatgtaaactttagatctgcagatgtccgctgtgcccatactgtagagattgcttaagatagaatacgttgt

SEQ ID NO: 23561 - DNA, 542 bp, Zea mays
  Clone ID: cC-zmle189048f05a1
tttttttttttttttttttttttttttttttttgtgtttggtttttttttttttttttttttgttctattttttttttttttttttttttttaaaaggacccgggggccacccccaaaaaacccgaccgggcccgggaggggaaccaaatttgctaaaaggggggggaataaaaactggggaaaaaaaaggaaaaaggggttccagggggaaaaatggtatccgggaaaaattccccccaaaaaacgaaacggaaccttaaagggaaaaaccgggggggcccaagggggggcccaaccccaaaaatggggggggggcgaaatgcccgttttcaaaaggggaaaccgggggggccacctagaaaaaaaaaacccccaaccccccgggaaagggggtttgaaataaactccccaagggggtttatttttcccccggaaaaagggcaaaagggggggccccccccaacggggccaaaaaaaaaaaaaaagctccccccctggttcccccacaaggaaaaaaacctgattggggggggaacggggg

SEQ ID NO: 23562 - DNA, 178 bp, Zea mays
  Clone ID: cC-zmle189048f05d1
aaaaaaaataaaaaaaacaaaaaacaaaaaaaaaaaaaaaaaaataaaaaaaataaaaaaaaaaaaataaaaaaaaggaaagggtataatttaaaaaaaaaaaagggggcggcccttttaatggtcccaagctattatcccggtgcatgccaagattatatccccttttattggggcc

SEQ ID NO: 23563 - DNA, 301 bp, Zea mays
  Clone ID: cC-zmle189048f06a1
agaaaaaagaacatgtttcttccatacccatttagttccaaacaacaaaactggatgcatattcatccgcttcctaataatggaaaatggggagagcacagaaaggtttttaaaacacaatagagcttggtcgggaacctaattcatccttttgatgagctcggtgatgtaattctcacgggtaccggcatcaccaccctccacatagggggtccttttttttttcagacctcccaggggggccttcagcttaaatggccaaaggaagttgttcgcctccttgaagtgtgcggacccgtgg

SEQ ID NO: 23564 - DNA, 290 bp, Zea mays
  Clone ID: cC-zmle189048f06d1
cacacttcaaggaggcgaacaacttcctttggccatttaagctgaaggcaccgctgggaggtctgaagaagaagaggaaccactatgtggagggtggtgatgccggtaaccgtgagaattacatcaacgagctcatcaaaaggatgaattaggttcacgatcaagctctattgtgttctaagaaactttctgtgctctcccaattttacattattaggaagcggatgaatatgcatgcagttttgttgtttggaactagatgtgtatggaagaaacatgatcttttttct

SEQ ID NO: 23565 - DNA, 400 bp, Zea mays
  Clone ID: cC-zmle189048f07a1
ggaagtagagtatatcacattgggacatcaaagatcactggtcacaccaccacacgttcacaaatatatatgcgcaaccatttcccccccaaaagccaaatccagctttgagttcgacaatccataaaccacgccacacttggcacgttcagctgcttttcttggcgaagagcccgccgaggccgccgaggttgaaccccccgccgctgccgctgacgtcaccgccggcagccttcttgccggcggtcgccttggcccgggaggcggcggccggctcggcgcccaccttgttgaggagcgggtccgtctccaccaattggcccttcttgaatatgaaaccgaagatggtctcgccgaggccctttttctacttggacggcgccgggccgcccctgctggc

SEQ ID NO: 23566 - DNA, 447 bp, Zea mays
  Clone ID: cC-zmle189048f08a1
acgatacagttctgaccttgttgaatgtaataaacccaaaaacaaaaattcaacagtgcgttacactccgatacaaatttaccgtagccaaaccacagattagaaatcaagtcggcatttggaggcaagaaaacaaaaattacaacacttttttggtctattttacaccccatgagcacaggcattttacacaacatgcaggccgccggccccgatgaggaaatgaattgagtgcacaggagactacactgaccttgggggatgcgtttacaagccagccatgagatatatagcgctatcgccctgctgcagggaaatctgcgtggccataaaacctcgtcgtacttgacttcgttcccaagcagtgcgatccaatcacaaatgacaccatcaaaggaagattccaacagagggcgcacccttatctcttctttggtgtccttttga

SEQ ID NO: 23567 - DNA, 386 bp, Zea mays
  Clone ID: cC-zmle189048f08d1
gggttgacccacgcgtccggtcgaaccgaagagcgatcaaggtcaaaaggacaccaaagaagagataagggtgcgccctctgttggaatcttcctttgatggtgtcatttgtgattggatcgcactgcttgggaacgaagtcaagtacgacgaggttttatggccacgcagatttccctgcagcagggcgatagcgctatatatctcatggctggcttgtaaacgcatccaccaaggtcagtgtagtctcctgtgcactcaattcatttcctcatcggggccggcggcctgcatgttgtgtaatatgcctgtgctcatggggtgtaaaatagaacaaaaaagtgttgcaatttttgttttcttgcctccaaatgccgacttgattt

SEQ ID NO: 23568 - DNA, 223 bp, Zea mays
  Clone ID: cC-zmle189048f09a1
gttataagcacaaatcttttaaaatgcagtcacctgaaacatagaagtgtttaactccattaacacaaagagatggaaaatacaatccctatttaagccgtcttcggcttgggcttaagtcgcttgagctgtgagtacaggaaaactccggcaagtgcaatcgcagtaccgagagagttgataggagaaacaggtgtcctgaagaacagcactgatgttacaa

SEQ ID NO: 23569 - DNA, 223 bp, Zea mays
  Clone ID: cC-zmle189048f09d1
ttgtaacatcagtgctgttcttcaggacacctgtttctcctatcaactctctcggtactgcgattgcacttgccggagttttcctgtactcacagctcaagcgacttaagcccaagccgaagacggcttaaatagggattgtattttccatctctttgtgttaatggagttaaacacttctatgtttcaggtgactgcattttaaaagatttgtgcttattac

SEQ ID NO: 23570 - DNA, 435 bp, Zea mays
  Clone ID: cC-zmle189048f11a1
tttttgtttttttccgatgagggtcgtcgataccagacggtatggttagtaggacaatgaaacaacctcaaaactataacctgtcagcgtcattagcagtgccattttgcatgaacgagaatattgtcaataaacccggaaacacactaaacatccacataaaccccgcaagccaccatgtccacactaacagacaccagcatcacaaaaggcaaactccaaaattaaacgttcagtaaaccaccacaatccatggaaaccccctgttaaaatggttcttagcgccaaaccaggcatttccgactcattgagccagtgacaccataatgacatcgataccctcttaaatgcctttaaacccagacatggttaccatactgtagcacgttttcaggagcttccaacatatacccttggcactccggcctaggggtc

SEQ ID NO: 23571 - DNA, 339 bp, Zea mays
  Clone ID: cC-zmle189048f12a1
gttccttctgcacccttctaccaactccatccgtatcttacatacaaaccaaccacgcgatcaaaacaagccccgcagaccgaccacgccagccccaacgaccaagcccgcccaaataaccaatcccaaaaccttaccctccccccccacacccccttcctccctccctttgccatccccacgacctccatccaagggaagagcaacaccaaagggaaaccaaagagaaacagggaccccaacacacactcaacacccgagcggcccccttcaccttcaaagtccagaactctcctgctgacccagaaccgcccgaccgccacccgccgccggaccagc

SEQ ID NO: 23572 - DNA, 351 bp, Zea mays
  Clone ID: cC-zmle189048f12d1
agagaaaaaaaaaaactcgtccactcgggtgtagagtgtgtgacggagtctttttttttttttggtttcccttttctttttctctcccctttgatggaaatcttgcgatacggaaagggagggaggaaggaaatatacggcaggaaaggaaagtattaggagaggttatagatgcaggcttcgtcatttgggatagcatagtacatgttcctggcatgatatgccagcctgattgatttttatacgagatacagaataagttaaaataaaaatggatatggcacaaagtgtgcccttgttaaaaaaaaaaaataaaaaaataaaaaaatagttaaatgcatctagaggggt

SEQ ID NO: 23573 - DNA, 524 bp, Zea mays
  Clone ID: cC-zmle189048g01a1
ttttatatatatagcatcaaaattatgtaatgaagagtagcactgattattgttacatgacgaaggttgagcatccatggaggctagattatagacagacaccctgattttacacgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggagcagacgacggcgaaggaggaggcgcggcggccgatgggcggcaagccctgaggcgccaccgccagagctgacgaggagatcat

SEQ ID NO: 23574 - DNA, 545 bp, Zea mays
  Clone ID: cC-zmle189048g01d1
cccacgcgtccgagcgactcagcgcgcgagagcagcacacacgcagctagctaggagcagcagcagcggcggcggcgacggcggcctacatgatctcctcgtcagctctggcggcggcgcctcagggcctgccgcccctcggtcgacgcgcctcctgcttcgccgtcgtctgctccaagaacaggatcaagaccgacaagccctacgggattgggggtggcctgaccgtcgacgctgacgccaacgggcgaaagggcaagggcacgggcgtgtaccagttcgtcgacatgtacggcgcgaacgcctacggatacagcccaatgtacaacgaggacgactggccttccaccggcgacgtctacttccgaggaaccactgggcttctgatctgggccgacaccctcgctgggatcctcggcggcggcgccctactcgtctacgactgcagcgccctgtacggctaaggacatgcaatgcatgcgcttcttgcgatgcgtcgagtacaatcaaggtgtctgcctataatctagcctgcatggatgctc

SEQ ID NO: 23575 - DNA, 435 bp, Zea mays
  Clone ID: cC-zmle189048g02a1
cactcattaaaagtgggacgccgaaaatttattgaagcgcccacacacggacacggcacgggttttggagctcggcgacgatgtgtaaggtattttagtgcaccccggacgacaactactttaaaaaagagggtgcagaaacagggagcttccccaggggcagcctgagcgcaagagcctgcagcgccaggagcaccttggtgacctggtccttggtgtccgggtcaacaaggttgcctccactttcaaacttggtgggggggtggggcgccctggggaacacctcgggcttgttgacaaaggggaggtcgaggaaaaccccaacctggcggacgtggatctgggagcgggtggccccccgacccgcccgatgcgcttaggatggggggggccccccccgcgttcggactttttttacggacccgtgggtcgacc

SEQ ID NO: 23576 - DNA, 479 bp, Zea mays
  Clone ID: cC-zmle189048g02d1
tagaacttgtccggacgcgtggggggccgccgccatcctcagcgcgtcgggcgggtcgggggggcagccgctcgcagtaccacgtccgccaggtcggcgtcttcctcgaccttcacttcgtcaacaagcccgaggtgttcaccagggcgcaccagccgcccagcatgttcgacgacgacggcaacctcgtcgacccggacaccaaggaccaggtcaccaaggtgctcctggcgctgcaggctctcgcgctcaggctgcacctggggaagctcgctgttgctgcacactcttcttgaacgtcgtcgtcgtcgggggtgcactaaactacactacacatcgtcgccgagctccaaatgccgtgccgtgtccgtgtgtgcgcgcttcaataaattctcggcgtccaacttttaatgagtgaaaaaataaatacttaacgtgatgattagattgagggccgtaagattaaaaaaaagggcggc

SEQ ID NO: 23577 - DNA, 378 bp, Zea mays
  Clone ID: cC-zmle189048g03a1
ttttggaacaatacttttttcttttcatttcaattgctcattcaggtcattgctcacactgacactgccacccatggtgatgcgtgacacattattactcaatcatcgccgctaaatgactcaactagctagctagccagcggctatactacagcacatagattgttcagtgggggacaccgcctgcagcagagaacgggcatggagtccgctgctgcaggccgcacatcaccgtcagatgctgcgctatgtgcgccgccaacagccccgcgacctggccgatttgctgctgctgctggaagatggactggaggaccaagccgaagatcgcctggtaccggagctgctgctccacctgcctgagctgctggccacact

SEQ ID NO: 23578 - DNA, 422 bp, Zea mays
  Clone ID: cC-zmle189048g04a1
aaagaaataataaggatgcacgttcccttgaattcttctgctcccataatggtattaggttagctctaatgaatagcacatgtgggcttgggaagccagccactgcacttactaccccaacaacaccacccttgggaactggaaggtacccaactattccactactgtacaggccccgggcactcaacgcatcacgccacaagaccgagatccatcactcaacccggaagggcgcccacctaccgacccatgacgtcggacatcaccattgaaggcaagacagccatctgcacatgttcggtcatcgcatgataaactgcacacaatgcctcaaggcgatgcgaaacacctggctcttcaaaatgattcaactggctcagtactgagatggcacaatgatgtatcaccggccaccgaacccg

SEQ ID NO: 23579 - DNA, 305 bp, Zea mays
  Clone ID: cC-zmle189048g04d1
cccacgcgtccgcccacgcgtccgcggacgcgtgggtgtgtttgcaaacaataataaatggtcaatttggactggtgatacttatcttacatccctttttagatccttactatgttctatagttgtagactcgtatttgctaatgtgagttttacattttaggcgggatcaatagaaggcaaggtggttgaaataggactcacttctacttcattgatcaatccagaaaagctccctgtcatagtacccaactcttttgtctccagtcagatgatagttaacagatcacgagctaattggcgagc

SEQ ID NO: 23580 - DNA, 495 bp, Zea mays
  Clone ID: cC-zmle189048g05a1
ggttagcaaataacaatataacatgaaagtatgccatgtttgccggcacaagcgccagcatgcaacgcacgctttgaaagttccacaactcaaactcaacaaaaggactcgttccattatttagacatcagacacctatcatgttaacagaaaacactaccgaatacatatggcctagaatccacacggcctcgcatggtggtggtggacacaaattagctcctcttgttggcgtagctgtcaggctcatcgtccttgaagagatcatccatgatttcatcattcttgttaccgtcaccaggtgtgccggcagagaacccatcagcgccactggaaccacccattgcgccaaagctaccagcaggtgttttcaccaaaaccactgtcagcaaagttactgctgccaaagctgtcgctacctccagcagcaaaactgccttcagccccacctgcaactccataatcaccaccaccaccatagccaccaccagccct

SEQ ID NO: 23581 - DNA, 606 bp, Zea mays
  unsure at all n locations
  Clone ID: cC-zmle189048g05d1
cccacgcgtccgcccacgcgtccggctatggtggtggtagcggtggctatggcggcggcggcagtggtgactatggtggcggcagcggtggatatggtggcaactacggcgacagggctggtggtggctatggtggtggtggtgattatggagttgcaggtggggctgaaggcagttttgctgctggaggtagcgacagctttggcagcagtaactttgctgacagtggttttggtgaaaaccctgctggtagctttggcgcaatgggtggttccagtggcgctgatgggttctctgccggcacacctggtgacggtaacaagaatgatgaaatcatggatgatctcttcaaggacgatgagcctgacagctacgccaacaagaggagctaatttgtgtccaccaccaccatgcgaggccgtgtggattctaagccatatgtattcggtagtgttttctgttaacatgataggtgtctgatgtctaaataatggaacgagtccttttgttgagtttgagttgtggaactttcaaagcgtgcgttgcatgctggcgcttgtgccggcaaacatggcatactntcatgtatatngnntattgctaacc

SEQ ID NO: 23582 - DNA, 403 bp, Zea mays
  Clone ID: cC-zmle189048g06a1
ttttgtttttggtatgaggaatccaaaggaactgcgattagaagcacttggggaccatgtgatctcaccagatgtcagttgagctcacataagataatctcagcaagtacgcctattaattaaccaccattttcgcaatgccgtagtactgcaacactaacaaaaagaagtatatttgcttcctgcgtcattaactattccccggcccggttgaggccaagtataggaacagaccgatacttgtgaaataccaaaatacttacttacatatacatttaaatagaataaaaaaataaatcagagaaaatatcatcattaaactaaacatttcaggccttgtttgtttactaggtggattgaagtgtaacttaaactgattattagcatgtttgctcggacgcgt

SEQ ID NO: 23583 - DNA, 393 bp, Zea mays
  Clone ID: cC-zmle189048g06d1
agcaaacatgctataatcagtttaagttacacttcaatccacctagtaaacaaacaaggcctgaaatgtttagtttaatgatgatattttctctgatttatttttttattctatttaaatgtatatgtaagtaagtattctggtatttcacaagtatcggtctgttcctatacttggcctcaaccgggccggggaatagttaatgacgcaggaagcaaatatacttctttttgttagtgctgcagtactacggcattgcgaaaatggtggttaattaataggcgtacttgctgagattatcttatctgagctcaactgacatctggtgagatcacatggtccccaagtgcttctaatcggagttcctttggattcctcaaaacaaaaacaaat

SEQ ID NO: 23584 - DNA, 322 bp, Zea mays
  Clone ID: cC-zmle189048g07a1
ttttaggtattagtatggcaaagaagacggattcaagccactagcttattgtccacacacgtacacgaactgaatgggggcacgtaccataaggagatacgatgaccctgcacagccaggcaaccaccggcatacattaagcacacaggcaagcacgaacgggcgtggatgccgcgccgccgggcggttcaactaaccctggcgaggaagctatccctgcgctcgaggacctctccggcgcaagcgacgatgctctctaagaccctggaggcgcgcaccacgaatacagggccgacgtggtgaccatggaagagggggagga

SEQ ID NO: 23585 - DNA, 310 bp, Zea mays
  Clone ID: cC-zmle189048g07d1
ctcccctgcaacaaatggtatgtcatcgccatcgtgatgctgaaccgctagttgtctcctgacgactagctcgacgaccttcagtggtggagttggagatgccagcaacatataggacagagaggtacaagtaggtgcccaacttgctctcgttggccgtggcggtggtgagatgctccggtggtgtcgagggagatacaggagccatttataagcagaataagtctatgtaaccctcactttcaaaaccgtttgtttaacctattcagctttgcaaaactagacaaataatgccatagatagttttagt

SEQ ID NO: 23586 - DNA, 463 bp, Zea mays
  Clone ID: cC-zmle189048g08a1
ttgttttttttttttttttttttttttttttttttttttttttaattttttctttatttttacctttttgtaaagggcccaccctatacatcaaaaaaaaaaagttgattgggaaaagacccatagtggaccaaattgaaggggcccaaaacctgaagcccttaaccaacatgcgggaccccccaaaaccgactgatgtactgacctggaaaccccgtataccaacaaactcatcaagccttgatcgggggccccatttgctcaaaccgaccacccctgtaacgtactaaacaccgcagaaggtttattccaaacagcccccgaggggggttgttcaccgggctaacattcggagaaaaaataagaccgaagaacttgtttgcaaaaacggctctggaatggaccccggatactcccgaagaaaagctttatcccaaggaaaacccgcaccttgcacaggaaa

SEQ ID NO: 23587 - DNA, 349 bp, Zea mays
  Clone ID: cC-zmle189048g08d1
tttttgggtttacccacgcgtccgcgtggatgctgcttttggagattcagaagaccggcatgtgaaagaggaaactgaagatcagccaacctcaatgaatgcattcgaactgatttcactaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcaaaagaaaaaatacaagatgcggatggagaacccgaaagcaggtagaaagggccaattgaatgttgcacctgaggtcttccaaattgcc

SEQ ID NO: 23588 - DNA, 538 bp, Zea mays
  unsure at all n locations
  Clone ID: cC-zmle189048g09a1
gaaaccggcaaaaggtggtaaatcacctagtcaattgattagacaaacatcagagtgtgacctcggtgcaaacgcaccagtatccagaatccagagcccctatatggctagcagaaaaggcctgatggccagcgcgaaccaaaactccagtttgacatacaaaatatgtcatcttacataaaaatatcgatgtatcatctctctgtgctgcttctgtgcttagtgccgcctcaccttagactcactcctcgcaaggatcatgccagagagcttgtcaacctcgtaaaggagtccagcggaaaacaggaagcatgttgtgatacagacacggtggacagtgccggctacaataagagctacaagttgtgctacaacaactgcaccccacccagttctatctccactagcttcttgatagtttccaataaaggtgaggagtagcaggaataggaaggagcagacgaatccaccggcaatggtcatgagctccgacgaggcgaacttggccctgtacatctncagcagcgacagcgtcact

SEQ ID NO: 23589 - DNA, 564 bp, Zea mays
  Clone ID: cC-zmle189048g09d1
cccacgcgtccgcccacgcgtccgctctccatcccggcgacgactggcgacagccgctgccggcctactccaggtccccaggtctacgtcggacccttcgccgcggcgaacaccaccagatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagctgttgtagcacaacttgtagctcttattgtagccggcactgtccaccgtgtctgtatcacaacatgcttcctgttttccgctggactcctttacgaggctgacaagctctctggcatgatccttgcgaggagtgagtctaaagtgaggcggcactaagcacagaagcaggacagagagatgatcctcgatattgttatgctagatgacatattttgcatgtcaaactggagttttg

SEQ ID NO: 23590 - DNA, 406 bp, Zea mays
  Clone ID: cC-zmle189048g10a1
gtggtctttatgttctaggctgctgttgtggcagttcactgaaatggaggtggcatccatcactttgtaaccatacaacccgatctccttgcatattggacaagccgcggctaggtcagggctgcatttgaccgatagctcgtcaccgcactaccttcacaagcaatactgcgcccttcgtacccgagcttggacaccggactctttaaagccagacgattagctgatcaccaggtgcatttccccaagggtggcctaaagccactgcgccaaatcggcacacggaatcatatccaaagattctgggctgagctggcatatgccaaacctgaatgcccccgtacggccccggggttacccctggcatggattgccagtcctgattgtaaaagataccgttagaacc

SEQ ID NO: 23591 - DNA, 363 bp, Zea mays
  Clone ID: cC-zmle189048g10d1
cccacacgtccggggacttatgtcaccacaaacagaaactaaagcaagtgttggatttaaagctggggtgaaggattataaattgacttactacaccccggagtacgaaaccatggatactgatatcttggcagcattccgagtaactcctcagcttggggtcccgcctgaagaagcacgagcatgagaaactgcggaatcttctactggtacatggacaactgattggactgatggacttaccaatcttgatcgtcacaaatgactatgctatcacatcgagcccgttcctggggaccgagatcaatatatctgtgatgtaagttatccattatacctatttgaagagggttctgatgctaa

SEQ ID NO: 23592 - DNA, 149 bp, Zea mays
  Clone ID: cC-zmle189048g12d1
acccgtccggtccacatcctgccaagcaaaccatcaggatgtttgcctggtttcttctaccgattgggggtgatcttggggaggagggcaccgctctcccacaactgatgcccactcatataagccttgccggaggctcgcagcggacg

SEQ ID NO: 23593 - DNA, 363 bp, Zea mays
  Clone ID: cC-zmle189048h01a1
atgtaaatgggacgtttatgagaaaggtaatggatgaatatgtcacgattacaatgcgataatacataagattacactcgcgtacaaccttccccaattcccataccatgaccaaaactctcgacacagcacagaaaataaccccagatcaaaactaacattcatagctgttttagaattagacccaaaaacctaaacaactctttcctgagcgggactccaaagagatgaggctcacttgaagcattttgcatccagcaaggcctcgccctcaaaaggctcctggtcctcgatcatggcattgacccgctccttctgggcctcatcagagaggtcaaccttggtccactccccacgcgttcg

SEQ ID NO: 23594 - DNA, 386 bp, Zea mays
  Clone ID: cC-zmle189048h01d1
cggacgcgtggggagtggaccaaggttgacctctctgatgaggcccagaaggagcgggtcaatgccatgatcgaggaccaggagccttttgagggcgaggccttgctggatgcaaaatgcttcaagtgagcctcatctctttggagtgccgctcaggaaagagttgtttaggtttttgggtctaattctaaaacagctatgaatgttagttttgatctggggttattttctgtgctgtgtcgagagttttggtcatggtatgggaatcggggaaggttgtacgcgagtgtaatcttatgtattatcgcattgtaatcgtgacatattcatccattacctttctcataaacgtcccatttacataaaataaaagaaaatcataagac

SEQ ID NO: 23595 - DNA, 575 bp, Zea mays
  Clone ID: cC-zmle189048h02d1
cccgcacgtacatgagtgggacggacggcatctgtatagcatttccgagactcgatccgacgagggccttcggttgcatagtctgactgcaagccagacaaagatggaatccgtaatacttcagcttcccgtgtccctgcacctgcatatgcaatcaacacgcttgagggaatttcatgtaacatggcttaaggaccaatgtaccttgtacctgagatccatctgccgcatacggctatggcggctgctaaagctgccatgaaagcacctgatgcattctatgcgctccgtctccttgaatcaactggaatcgatgtggttcctggatctggatttggccaagttcctggaacatggcacgctagatgcacgatcctgccgcatgaagataaaatccccgcggtgatcacccgcttcaaggcttttcatgaagcgttcatggctgagtaccgtgactgaactgttacagtggctgagtaccaccgtgtagaccgaatcatattaaagctcccccctctatctgaatctgtgcgtgtgtgtgaactgatctctgaatggacgaacaatggactctg

SEQ ID NO: 23596 - DNA, 305 bp, Zea mays
  Clone ID: cC-zmle189048h03a1
gtgctcaatattactgtcaacccctagtgctgttaccaaagagaatagggcggtcggcgtcctggacaaccacaacgagggcgagagggacgctatgcacggcctcaagaagctcgaccgaagaaaaaaaccagaaaacaaggccaccatcaacaacaacaaggccaagccaccaaaggaccaaaagggaagaaaacggccggatggatggaaggatggatacccgaaacccgatcgtgcatagcatggtgtaccattcaataactgccggcggcacgccttgaaacggagccgaaaacggaaca

SEQ ID NO: 23597 - DNA, 540 bp, Zea mays
  Clone ID: cC-zmle189048h03d1
ctcattcagtcgatggaacctcatgttgaagaagaggtacttattgatctgaaggccaaaatccgtgctcatgatccgtcagagtctgaagatattgagggaggcatccggaattctctcttgtggctgcgtgatgaattgcgaactctttcatgcacttacaagtgccgtcatgatgctgctgcagatttgattcatttgtatgcttatacaaagtgcttcttccgagtccgggattataagacagtaaaatctccaccagttcatatcagtccgcttgacttaggccccaaatatgctgataaactgggaccaggctttcaggagtactgcaagacatacccagaaaattattgcttagcccagcttatctattggtatagccagaattcagaacctgaatctagattaacaagagctagaaaaggttgcatgtcgttgccagatgtctcatccttctatgtgaagtctgcaaaaccatcacaagagcgagcttatggaaacagaactgtgagattcatgttatcgcgcatggaaaag

SEQ ID NO: 23598 - DNA, 298 bp, Zea mays
  Clone ID: cC-zmle189048h04a1
ttttgctcattcttctctcgtctcgtttcatagcgggagcaaacaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgc

SEQ ID NO: 23599 - DNA, 299 bp, Zea mays
  Clone ID: cC-zmle189048h04d1
gcggctacggcggtcggcgcgagggtggtggcggcggctactgtaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaaa

SEQ ID NO: 23600 - DNA, 496 bp, Zea mays
  Clone ID: cC-zmle189048h05a1
gtatagggccagccttcgcccttttcactttttttttttttcgactagcaacttcggatatatgggtcgaattcaaatgtctcaacaaaactatggccaaaacacctgctgggtcatctcaacatgaggtctgctatggcttgtgtgagcgctacaggtgtgcggtgcgccaccaggcccaaagctccaaaacccttgcagcgttttaagatctcggcttctcttccttctccttgaaaagggcgaggagggaaactccagaaacccttacgaccttttaacggacgccgggaatattctccacatgaagggccctacgaccgaatccagcaaatagagccttatcaccatcctcgatgtagctcaagcaaccatcgtttggcacaaaggcagcaatttaattcccgttctttaccagctggacacgagcgcacttacggatagcaaagttaggccgcttagcctctatgccgaatcttttaaggacgaatccctt

SEQ ID NO: 23601 - DNA, 394 bp, Zea mays
  Clone ID: cC-zmle189048h06a1
ggaagaaattcataaccatttattcggatgtggtgcacgaggcaacacgtacggcgctgccaccgctgacaatagaaaatacaacgacgacgaactcatgaacacgaactgctctgctgagcacactaaaaccaaaactagattattggttcgtcattattactcccggccagccaccggccgaccgatggatgctctactcgatgcccagcctcttcttcatcccgcagacgaagtcgtagaccttctcgggcgggtagaggttcttggcgacgctggggcgctcggcgcagcgcttggcccaggcggccagccttgggcactccttcttcacgctgacgccgccgaagcggtcgtaggcgaggaaccaggaccggacgcctgggtcgacccg

SEQ ID NO: 23602 - DNA, 405 bp, Zea mays
  Clone ID: cC-zmle189048h06d1
gtcctggttcctcgcctacgaccgcttcggcggcgtcagcgtgtagaaggagtgcccgaggctggccgcctgggccaagcgctgcgccgagcgccccagcgtcgccaagaacctctacccgcccgagaaggtctacgacttcgtctgcgggatgaagaagaggctgggcatcgagtagagcatccatcggtcggccggtggctggccgggagtaataatgacgaaccaataatctagttttggttttagtgtgctcagcagagcagttcgtgttcatgagttcgacgacgatgaattttctattgtcagcggtggcagcgccggacgtgttgcctcgtgcaccacatccgaataaatggttatgaatttcttcaaagaaaaataacacttttaacctatccatgg

SEQ ID NO: 23603 - DNA, 383 bp, Zea mays
  Clone ID: cC-zmle189048h07a1
acaaaagaatcatttccttagacatgttaaaagaaaaaaaaaagagaaacagatggctctaaaagaagtaagaacaggggaaaaaaaagaaaacctcaaatgactaacagagagcaaaccactcttctacctatccttttcgtttacttgtttcttaattccctgtctctctgtatgtatacccccatcatctaccatggaaggcttccagtggccgggtctgcgaacgccttctgcacgaaatccttaagcccggtgtcgaacacttcgcagaaccggcgcggccagacctccggctccaccggcctagtccccagccccggcgccctgtccctggacccgacgttctcctcgtcccgacagtcggcgacgtaggtcgcgac

SEQ ID NO: 23604 - DNA, 274 bp, Zea mays
  Clone ID: cC-zmle189048h07d1
gggttgacccacgcgtccgctgggaggtgttcaaggacaagttctccgggcgcgtcgcgagtgggtggtgttcatcgacgtcgacgagttcctgcactggcccggcaaccagacgaccctgccagacatcctgcggagctactcgaacaggccgcgggtgggcgagctgaggacagcctgccacagcttcgggccctcggggcggaccagaatccccaagcaaggcgtgacgacgggctacacctgtcggctcgccgcgccggagcgtctcaag

SEQ ID NO: 23605 - DNA, 419 bp, Zea mays
  Clone ID: cC-zmle189048h08a1
tttgaaccggattgctgatgtaatttatctgaacaggaaacgatttcggccgctgtccatcgcataccgacaggacctattttagaacgtttcactgtaacttgcacataccgtgctaccaggtcccagatcgaccacgccggtcatgtcgatctcaggttagcctttcatgcctggacgcgcagaggatccgtgtctgatcgtagaactgctggtgggcattcatctatctcatccacacttcgttgcttatttttcatcgtcagacccaaacttgtagtatgaatccctggcacggttcatcggtgttggaatatgaatctctaatatactaacatagaccaaacatactttcgtcaatacgctcataaacagtattgcagagccgacgatctgatcgaagcctacacttgtggctt

SEQ ID NO: 23606 - DNA, 275 bp, Zea mays
  Clone ID: cC-zmle189048h08d1
cacggatgaggggctccgacatcgaatacttgaccaagccgaatctgactgtggcaaacaaagatccgcggtctagaggcgatggcagctatttcaggcatccgaactcaaaagattgaaacgctcatgctgatgtgcttattccaggagacaaggcgcgatataggctaatcggtggtgacagtaaccaacatgctagcatggatccactagcaacagattacgactgcttggtgcaacggttgctgatgagtacctctcgggaagatactccc

SEQ ID NO: 23607 - DNA, 555 bp, Zea mays
  unsure at all n locations
  Clone ID: cC-zmle189048h10a1
gaatggaacacgcaattttatttcatatccagcacaacattattacaacggcaggcgatatagcgaaaatgagcatatacgcacagctttattgtaggacactcggatcttcctaggtacaaacaattcgtattctcttctatgcaagggtcggcggtacccatatgtaaccgtgggtctgcacgtatccaactctcgcgctcaattcgtcggcttccttgggtccccggctgccaggttcatacgggagggccttcagcttgccgtcgtcaatgtcatgcagcaaaggagtgaagatcttccaagcagcctgtagctcatctctgcgaacaaagtgctgctgatcacctcttattgtatccaagataaggcgttcatatgcctcaggaattttgacattttggtaccgcatgccatatgacagatcaagttcactttgatcagtagccatttctaacccatgcttcttaacagttagtntcatgtacatggcttctgatggtctgaggcgtataacaaactcatgtcttccttgcttcttgcttctaaaaatgt

SEQ ID NO: 23608 - DNA, 575 bp, Zea mays
  Clone ID: cC-zmle189048h10d1
caattcaaggatgtccctggtgacatttttagaagcaagaagcaaggaagaaatgagtttgttatacgcctccaaccatcaaaagccatgtacatgaaactaactgttaagaagcctgggttagaaatggctactgaacaaagcgaacttgatctgtcatatgggatgcggtaccaaaatgtcaaaattcctgaggcatatgaacgccttatcttggatacaataagaggtgatcagcagcactttgttcgcagagatgagctacaggctgcttggaagatcttcactcctttgctgcatgacattgacgacggcaagctgaaggccctcccgtatgaacctggcaaccggggacccaaagaagccgactaattgagcgcgagagttggatacgcgcagacccacggttacatatgggtaccgccgacccttgcatagaagagaatacgaattgttcgcacctaggaagatccgagtgtcctacaataaagctgtgccgatatgctcattatcgctatattgcctgccgatgaactaatgttgtgctggatatgaaaaaaaatgcgggtccattc

SEQ ID NO: 23609 - DNA, 359 bp, Zea mays
  Clone ID: cC-zmle189048h11a1
gtctggcaacaaaaagcatcatgaccgattccataatgcccattgtaattgatccccagggattcaaatgcttttctgcccctaaaatttattaaagggcgactcgatctgtcaagaaataaattgcgaaacaatatgtacagttccggagaaaagcatcaagcattatattaacctgggcagttctttcttaaacagccaacagggcaaagtaccagtcaggccgttcaacgggtgcgaaaacctaaaccttggtaacaaaacaattccatcataattagcatgtcccccgattggagctcactattaccaatgagttccacatttccacggccacgatccattacggggcaaatccc

SEQ ID NO: 23610 - DNA, 342 bp, Zea mays
  Clone ID: cC-zmle189048h11d1
ggtgcgacccacgcgtacgcccacacgttcgagacgcgactcccaaggcacaatcgttaattatgttcaaacaattgttaagtcgttctgcgctgcttctattacgagcaacgttttatattctgcgcttgcataatgaatcgaagaaatcctgacaccaatcgaactgaagatcctgaaacgcacgttaataccgttgacgtccgcttcacccagctcgatttttagtcttgtaatactaatcgctccatgagtcctgtagtgtgcaaaaatttatgtcgctgcttcccaaattaacatgctggttcggctctacccgtgaatctcctattttgaaaaggt

SEQ ID NO: 23611 - DNA, 459 bp, Zea mays
  Clone ID: cC-zmle189048h12a1
ggaaatataacttcttatttctaggaggccacatacatcagccaaaaaacttcattattgaatgacaactaataagcaatctaaaagagggcaccgtcaatgatgtgtcgttggtagaaggctgctgggtttgtcaaagcaagttggacaaagggcagcaactgttgcagttgtaaaagggttgcggggttagccacaaactgctggtagaacggaagcaattgttgatgtgtcaagaaggaagcgtggcttgttgtatctagctggccaaacggtagtagtacctgctgctggaaataagcagaggggttcagcgcggcgaattggttaaatggaagaaattgcggctgctgagagtaggcagtagctagctggctgaatggcagtagttgacgttgctgcaaataagcagcagggttcagtgttgacagttggttgaatggaagaaattgctgctgc

SEQ ID NO: 23612 - DNA, 588 bp, Zea mays
  Clone ID: cC-zmle189048h12d1
ccggaaaactcgggtcgacccacccgtccgcaacaagcaacataaaaagtggaatacagttacaacaatagatttacaatggcggccaagatatttttcatccttgtgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggcttcaacaagcaattgcaacaagccaacttaccctttatcacccctgttcttttaacaatcgccagccctatctttggtgcagtcattggtacaaaccatccaggcacaacagctggagcaacctttgctaccagtgatcagccaagtttgctctggcaaaccttttctccctatcttcagcaacaacaatttttttccatttcacccaactgtctacactgaaccctgttgtttatttgcagcaccatcaactactaccattcagccagctagctactgcctactttaagcagcaacaattttttccatttaaccaattctgcccactgaaccccttt

SEQ ID NO: 23613 - DNA, 258 bp, Zea mays
  Clone ID: cC-zmle189052a01a1
aattcataaggaaatttctttttgtccaaaaagggggaaaaaaaatgatcgaagcaaaaataaaagccgaaaaaaaagggccccaaaacaaaaaaagggggccctggaaggaaggtaaaaaaaaaaaaaaaccgggggcccaaaaaggccgcactccatagcaagaccgggggtgcaaaagaaactgagaggaaaaaaaaagggggtggagggggggaccctggggctcccaaaaacaaaaaaaaaaccctggggaaa

SEQ ID NO: 23614 - DNA, 285 bp, Zea mays
  Clone ID: cC-zmle189052a01d1
gccgtgctgctgcaaggccgccgccgcccgtggaagcgctccgcaatgcgggacggtcggtggtggcagcagcagcacccggagggggctgctaggcgtggccctgggagcctctgccttggggctggccgcgtttgacgccgtcgccgccgggttgccgccggaggagaagcccaagctctgcgacgccgcctgcgaaggcgagctcgaaaatgtgcctatggtaactacagaatccggactgcagtacaaggatatcaaagtgggcgaagggcctagcccacc

SEQ ID NO: 23615 - DNA, 373 bp, Zea mays
  Clone ID: cC-zmle189052a02a1
agaatctaaaaatgtacttgattaattctgggaagccacatgcgtcatgcaaaaaactttatttttgaactatgacggataagctaacgaaaagagggcactatcaaggaagggatgcaggtataacactggtggcgaagtcaaagatagggcctagaatggcacctattgttgcgcaaggcataagggactatatataggtattccgtgctagtcgaaggcctacgaatgttgtagtgacatgaaagcagtcgggctcacattagagtggttcgttaatggaaggaatcgatgatgatctgaataagcacgagcaatgaatgcttcctgataggctcatggaataaactggtggcggtgaggaacggctact

SEQ ID NO: 23616 - DNA, 607 bp, Zea mays
  Clone ID: cC-zmle189052a02d1
tccgcaattcccgggtcgacccacgcgtacggagaccaactagcaacataaaaagcacaatagtgtaccaacaatggcagccaaaatattttgcttccttatgctccttggtctttctgcaagtgatgctaccgcgaccattttcccacaatgctgacaagctcctatagcttaccttcttcccccatacctatcaccagcggcgtcttcagtatatgaaaacccaattgttcaaccctacaggatccaacaggcaatcgcaacaggcatgttaccattatcacccttgttcctacaacaaccgacagccctattacagaagttacctttggtgcatttgtgtggcacaaaacatcatggcacaacaactacaacaacttgtgctagcaaaccttgctgcatactctcagcaaacatcagtttcttccattcaaccaactggctgcattgaactctgctgcttatttgcgacaacagctaccattcagccagctagctgctgcctacccccaccaatttctttcattcaaccaactagcagcattgaactctgctgcttattacagcagcaacaactactaccattcagccagctaactgatgtgag

SEQ ID NO: 23617 - DNA, 529 bp, Zea mays
  Clone ID: cC-zmle189052a03a1
gctgaactgtctgaacttggttacaagaacaccttggttggcacacacagtttgcacttcaaatttatctagaaccttttcatacataattgacacaacactggcaagtggcaacaagcacacgccatcacacagaaattcaggatcagcaagtaaacactggttacttagaacatagaccaccaacttctttttgtgtctacatgtgccgcagtggtagtctgggacctacggtacaattgcctcctaacattgccagcaggattggtgaagcacaaaactagagctaaactgacaagacttacaactggagctgctgcaataaacagccatctatgacgcccatgtgctccatttggctgctgtgcagtatgctggtcatgtgtattagtctcattcattgtatcaccgcctgtattggaacctgcattaacctcaggttcataagttgcttgaacaacttcctgcggatgggtacgcttcaccccatggataccttcttcattgaccgcggcatgcttggacctct

SEQ ID NO: 23618 - DNA, 599 bp, Zea mays
  Clone ID: cC-zmle189052a03d1
gatgaaggagatgacaccatgcaggagcgccggcagcagtggcatgatatcgacccgagtggattgaatgagcaggaatctgaaggtgctgcatggacttggagaacagttggaagccaagacataaacaggactgatctgagagtcgacatggatggacgggaaatcaggagactttatattgggaaccccggagattatgaagatgcacgacagtgtgaaatgcttctcgagcaattcgctgatgaggataacaattccagacgaggagctccacctgcagcggaatcttgacatcgaaaatctttcgtctgcggtcatctacaaaggctatgagataaactgtggtgtgacctgtccagtctgcaaagatgacatgcctatcaccactgtatcaaaacagctaccatgcatgcatctatatcattcatcttgcatgttgccatggcttaattctaggaacacatgcccagtttgtcgttacgagctttctacaaatgactcggaatatgagaggttcaagcatgccgcggtcaatgaaggaagtattcatggtgtggagcgtacccatccgcacgaagttgttgaagaaacttatg

SEQ ID NO: 23619 - DNA, 538 bp, Zea mays
  Clone ID: cC-zmle189052a04a1
ttttgaacagaaacttatcctaacatccatacgcaatatcattaaataaataaaataatccatcgctgctcgaatgttcggctgcaagagcagctactgcgctgcagctctctgttcggctagctgatttagttgcactacagatgctgaaactagcagccgaacagtcggtcaacagaacatatataaacatctcaggcccttcaaaatggatgcattaccgatttccattccacaccctggtggtcaaaaatagggcactggcatttctccagcagttgaaataggagccgtcaaagtttaactgttatttgtgcacagctaaacacctaggcattccataccgacaccataagaacgaaaataatgagacgtggttgcaccctgttcaaacagggtgacccaaattgtctaaaatgttttttattaaactgcaaaacaatttttctcttcatggcaaaaggcatgtcaatgaactatgcagttgcttccttcaggtacgcgatgagatcagcacgctcctgcggcttcttcagcc

SEQ ID NO: 23620 - DNA, 546 bp, Zea mays
  Clone ID: cC-zmle189052a04d1
cccacgcgtgcgggcaaagcagaagttgcggctggcctcgtcctcctcttctccgtcgcggctcagatctctgcgtgcgtcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggaaacaaaaacaaggctgtagtctgggaagaagacactttgtatgagtacctgcttaaccctaaaaagtacattcctggaaccaagatggtcttccctgggctgaagaagccgcaggagcgtgctgatctcatcgcgtacctgaaggaagcaactgcatagttcattgacatgccttttgccatgaagagaaaaattgttttgcagtttaataaaaaacattttagacaatttgggtcaccctgtttgaacagggtgcaaccacgtctcattattttcgtcttatg

SEQ ID NO: 23621 - DNA, 440 bp, Zea mays
  Clone ID: cC-zmle189052a06a1
gcccaaacaatatgattctagttcattcaaattgtacacctccaaactgggctgacctctcaagatttcatcttcgtaattcggaagtaacacgattatcggtacctacacaaattgctttttaagagtccaatctggcactcaaataaaaagcaactttacatagtcagaaatgacattttgacatttaggaactagcactacgagttcattaaagaggttccaccagacaccgcagcggtggcctgcacacgtaacactagcacaggctgccataagtaataggatcattgccagacaccattcatattccataacattgatgaaatacggaccctatgctgtacattctgggaacaacaccatattgccttgttaggcctagttgccgaactgcaattctcgatcacttgactgggatttgccggacgcttgggtgc

SEQ ID NO: 23622 - DNA, 445 bp, Zea mays
  Clone ID: cC-zmle189052a06d1
gcaaatcctcgttaactgatctaggattgcagtttggcagataggcctaacattacaatatggtgttcttgacagaatggacagcatagcgtctgtatttcttcaatgttatggaatatgaatggtgtctggcaaagatcatattatttgcggtagcctgtgctttgttacgtgtgcaggccaccgctgcggcgtctggtggaacctctttactgaactcgtagtgctagttcctaaatgtcaaaatgtcatttctgactatgtaaagttgctttttatttgagtgccagattgtactcttaaaaaggaatttctgtaggtaccgataatcttgttacttccgaattgcgaagatgaaatctttgaaggtcagcaccgtttggatgtgtagaatttgaatgaactagaatcatatttgttgggcaaaaaaatatactttatcctt

SEQ ID NO: 23623 - DNA, 504 bp, Zea mays
  Clone ID: cC-zmle189052a08a1
gctaaaagttcagcattgctttggtatccatatctcaataaacaatgaacacacgtttcttggttgtctctatgtgaaacaagccaggtgagggcaaaatcagcccctccttccaagacactataaaataaacctggagccacgagtgttctcattttacaccatggggccaacatggatgaagtgggcgtgttcacagtccggtaaatgtttcgaataggttagctgctcgcgcactacacaaacaggtcaagccgacgtattgagcaaacaaacaaaagggcgtattcttatcagttgggacaatgctgatgcttgaagccccccttctctatgtccactcctataaagccgatgctctgataaatatgtacactcctagcaaaaagagccatgcctggattcgtaagccggttcaccaaactggatcgcgccatctcaaaagtgggctacctttgatggttgatgcaaccggagcgatgttgaaggccatcaacatgtgct

SEQ ID NO: 23624 - DNA, 586 bp, Zea mays
  Clone ID: cC-zmle189052a08d1
gtcctcctcccacgaggccggccccgcggcctcgtccggatctgcgcccgccgcggcgtcgccctactgcgcgctcctccgcgccgcgctcttcgggcccgacacgcccgaccgggtcgcgtcctcggccgccgcgtgctcgtcctcctcctcctccccggggctctcgcctgtgggcacccccgccaccgggaacatcttcagattcaagacggaggtgcgccggaacgccaagagggcgcttttttccggaggggaggaggaggaggacgccctgttccccggcattttcaccaccaggggcgcgggaccaaggaaggtcccgaggtctccctacagggtgctggatgcgcctgcgttgcacgacgacttctacctcaacctcgttgattggtcttcacataacggcctcgcttgtgtgttgggcaattgcgtttacctgtggaatgcatgcagcagcaaggtcaccaagctttgcgatttgggggtggatgacaaccgtcgttctgtggtgtgcgcgcagcgcggcactcaccttgcagaagaacacatcaggaaaagttcaatctgggagcactcgtgaaaa

SEQ ID NO: 23625 - DNA, 393 bp, Zea mays
  Clone ID: cC-zmle189052a09a1
ttttaacatccaaacgtcaggaaatttagtcttccaactagttaccacaacacattcatgctaatcaccatagccgatccatgctcacgagacatctaaggccttgttcggttattcccaatacacatggattggatgagattgaaaaaaattcttaaaaggttggactggttgggaatccaaactcatccaatcccactcaatccacatggattgggagcttaccgaaaagccttaatggggttagagagggaaatataagatctcgagcgccacacacctgagggccacctgacaagattagtcaccgttggcacaacccttgcagccgcaatggacacattctatcacttgctcctccctcagatgcttggggactcgcggacgcgtggg

SEQ ID NO: 23626 - DNA, 427 bp, Zea mays
  unsure at all n locations
  Clone ID: cC-zmle189052a09d1
cggaattctctcgggtcgacaccaccgcgtctcgcgtagtccccaagcattctganngggaggagcaagtgatagtaatgttgtccatttgcggctgcaggggtntgtgccatgcggtgacttaatcttgtcagtctgtcattcatgttgttgggccttcacgactcatcatcaccatcctaaccacattaagggcttttcggttagctctcaatccatgtggattgagtgggattggatgagtttgaatcccaaacaagtcaaactttttaagaatttttttcaatctcatccaatccatgtgtattgggaataaccgaacaaggccttagatgtctcgtgagcatggatcggctatggtgattagcatgaatgtgttgtggtaactagttggaagactaaatttcctgacgtttggatgttaaaa

SEQ ID NO: 23627 - DNA, 127 bp, Zea mays
  Clone ID: cC-zmle189052a10d1
tagtcctccagatcttgttgttcacaaaatctcgttatccccccgatgagccgtgttagaaaaatctgctaccgttggtataagaggtgtagtctcgactgtcttatgctagacttaccggtgcgta

SEQ ID NO: 23628 - DNA, 445 bp, Zea mays
  Clone ID: cC-zmle189052a11a1
agctcttacagcattcttgtattgcagaaggggaaatagcaacaaggtaccaaataaatagataaaagtgcacaggctaacagagctcaacagttcacacaataacagcaacgaccacaaacaaaacttgtaatgatgaaaactaggtattgctaaagcaggcgcaggatcgcatcatttcttcttggcagcagccttggtcaccttggcgccggttgggtccttcttctccacactcttgataactccaacagcaaccgtctgcctcatgtcacggacagcaaacctaccaaggggaggatacgctgagaatgtctccaccaccatgggcttggtgggtatcatcttcaccataccagcatcaccgttcttcaggaactttggctccttctcaagctccttgccagagcgcctgtcgatcttggtaatgagctcagcaaacttg

SEQ ID NO: 23629 - DNA, 585 bp, Zea mays
  Clone ID: cC-zmle189052a11d1
gtcgactccacgcgtccacccacgcgtccgccctgccaaggaggctgccagcttcacctcccaggtcatcatcatgaaccaccctgggcagattggcaacggctatgcccctgtgctggactgccacacctcccacatcgctgtcaagtttgctgagctcattaccaagatcgacaggcgctctggcaaggagcttgagaaggagccaaagttcctgaagaacggtgatgctggtatggtgaagatgatacccaccaagcccatggtggtggagacattctcagcgtatcctccccttggtaggtttgctgtccgtgacatgaggcagacggttgctgttggagttatcaagagtgtggagaagaaggacccaaccggcgccaaggtgaccaaggctgctgccaagagaaattgatgcaatcctgccccggttatagcaatacctagtttcatcattacaagtttgttggtggcccgtgcctttatttgtgtaaaccggagatctcttttaccctgcgcccttatatattttttggggcccgtgggggtttttcaccttctgcaatacagaatgctggaagagct

SEQ ID NO: 23630 - DNA, 426 bp, Zea mays
  Clone ID: cC-zmle189052a12a1
ttttactttgaaagatcctcgtttcaatacagcgacgagggcatataccatataacctgtaccaggctgtggctgaaacaaaacctatgtgctgcgtacagccctaggtatagctcgtttaccgagtataacggcaaccctgacacaaatacgacgattggctctcactgcccattatactaccccctttgttgatcatgctggggagcagtataactgcttacggtcttgcggtacatgccttaaggccctgtgacagtccgggcgatgaacttcccggctttaccagggccactgctgacagcacccataccaaaggttacatggcctgggccagaaccaattcctgaaccaactaaaccgaagctcttggcaatggcagtacccacaaaggcaacaccggaaccaacagaatgcattgtgata

SEQ ID NO: 23631 - DNA, 468 bp, Zea mays
  Clone ID: cC-zmle189052a12d1
attaagattgttggaatatctgcgcaaactccagcttatgctatcgataaaaagaataagcatcctaaccctcctatccagcaagatacggagaggtgccgcgcaacgtcttttacgttatgcggcgggtctccgccccacatttagacaacagtaggaggaggcagtcgctccccagcttgtccgagataacagtaatctaccggtcccagatcaaggccgctccgggagcattcctaatcccggtaggtgaccatatcatccaaccttcatgtgcggtcaccatcactatgccgggatcaactcgggtcttgatgtccccatcacgtactcaattaacgaaccgcggagaacagaacgacagcgaagttcagttcaagcactttatagaacaccgaaagaggagggcacttaaccttgttctccacctaattctacagggattttactccatatacgacacattac

SEQ ID NO: 23632 - DNA, 197 bp, Zea mays
  Clone ID: cC-zmle189052b01a1
ggggaacaagctggttcgttttcaaattcaaaaacccaagaggggcccggggggaaaaaacaagcccacccaaacttttcccaacaaggtgataaaacaaaccaaccctaaatagaccgggcatatgggggggtaaagcattggtttgaaccacccccttacagaataaaatttgaaaaaaaatatgatagctgctt

SEQ ID NO: 23633 - DNA, 368 bp, Zea mays
  Clone ID: cC-zmle189052b01d1
gcgacgtcgccctcttctttggcctctcaggtaccgggaagacgacgctgtcgacggatcacaacaggcttctgatcggcgacaacgagcactgctggagcgacaatggcgtgtccaacatcgagggcggctgctacgccaagtgcatcgacctggcgcaggagaaagaacctgatatttggaacgccatcaagtttggaactgtgctggagaacgtggtctttgatgagcatactcgtgaagtcgactacgccgacgactctgtcaccgagaacactcgggctgcctacccgatcgaggtccattcccaacgccaagataccatgcgtcggcccgcaccccaagaacgtgatcctcctggcgtgcga

SEQ ID NO: 23634 - DNA, 445 bp, Zea mays
  Clone ID: cC-zmle189052b02a1
ttttccatattatttgattttttttattttttcatactgatttttcggccctcactatttgaattattacctaagggttcaagttacaaggttttgatgtccttttcgaagaggccaccctttacaatgcacccaagcaaaactggttaactgaaacatatacccaaacttactactacacatcatcaacctgcttcaggctatgctcgtaatgactgccaatccattattaagcttttacgctctatgtgacctactacaactcataatctatcaccataggctgcctatagatagaacctgtgaccaacctggcttatctaaaccactaataggtacttggaaggctacaagaaacattctctatcaggtcaactttctctgaagtcaacactagtgccatgccgatgacacgatcaggggcctgtacttcccggacgcgagg

SEQ ID NO: 23635 - DNA, 428 bp, Zea mays
  Clone ID: cC-zmle189052b02d1
cggacaccaggcccgtcaccgggtcatgtgcttgtctctattggtgactttatgacatgcccacacgctggcgaatggttgttgccacctattgatcacttgttcaagactgatatctggaaggacgaatactgtgactatatatgggcagactattgtgctataggctgacatgctattgaactcttatagcccctacggctactgctaccaggtgtgtaaataccattctagattagagcatggagctgatgatatataatggaatgagaaacttggatggcctaaatagcatttgcttgggtgcattctgaagggtggcctattcaaaaaggacatctaaccttataacttgacccttctgaaatattcactagtgagggccggaaatcagggcggctgcattgatatagtttcaatttatctgg

SEQ ID NO: 23636 - DNA, 558 bp, Zea mays
  Clone ID: cC-zmle189052b03a1
ttttataagacagaaaaactctggttcacgagtaaatcccaaccagcatagcaatctacggctgaattaccaaatatagagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgtcaccacatgggactgaagcaaacttctccctgcccgcggcaatgagctcggtgatgtccttaccgctcagttgggacagcaggagttccatcttttcattgtcaacttcacagccaactgactccagaatggcagtcaaatcgtcagcggaggggctggcgttcccagcgaggacagcaagcaggtaggcagcaacaaacttcatcgtgctccgaggaaccggtcgact

SEQ ID NO: 23637 - DNA, 557 bp, Zea mays
  Clone ID: cC-zmle189052b03d1
agtccctctcctctcgaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattctaagcttgttttatgttggaaagtactggaaagactgctacttgtctctatatttggtaattcagccgcagattgctatgctggttgggattactcgtg

SEQ ID NO: 23638 - DNA, 587 bp, Zea mays
  Clone ID: cC-zmle189052b04a1
attgtataattaagttccttgccaaatcttcccaaaattacatcgcaatgcatacaagggaacttatttcccattaatatgcaccatctttttatttatatcctaaaaaatacatactaaataagaaatacgtttctacatatgcggtcagtaacgaaagtagtgtccggtagcagcatagaaggagcatcacggagaaagctttttgagccttatctgagcaccatgttgagggtgcagtgttatcacggtgtacggcgcgtgggtgtaggatggcgagagctcgaacgagaagcgttggaggatggtgcatagcgtcatcttggcttccagcaacgcaaagctctggccgatgcagattctaggcccccctccgaacggaaagaaagcagcctgatgcctggttgcgctggagatgccgttggcaaacctttctgggttgaactcgcttgcgtcttttccccaaatgtcaggatcatggtgaatgaagatgacgggtagaaggaggtcaactcctgcaggatatttgattccaccgagctccattttcttataagttcttcttgttagaaaagtttgccgtgggt

SEQ ID NO: 23639 - DNA, 518 bp, Zea mays
  Clone ID: cC-zmle189052b04d1
ctcaagaactgcgtttgggagcaactatcaagaagggaggagaattttcgagctgcaaggagaactagctgaacgcctcatccaatctgttcagacaatatttatcccaggctattggttcttgcccaccaaaaacaacagaaggatgagagcgatcgatgtagagatccgcaaaattctccgtgaaataattgggaagagagagaaggatactaaaaacagagaaacaaataacgacgacttgctgggcttattactggagtcaaacacaaggcaatcaaatggaaatgcaagcctgggattgacaacagaagatgtgattgaggaatgcaagttattttactttgcaggtatggagacaacatcagtccttcttacttggacacttattgtgctaagcatgcacccagaatggcaagagagagcaagagaagaggtttttgagccaactttggaagaacccacaccggattatgatagcttgagcccgcttaagactataaccatgattctacatg

SEQ ID NO: 23640 - DNA, 498 bp, Zea mays
  Clone ID: cC-zmle189052b05a1
cccgtggccgtggcaggccatcgttacagcaagccagttccgtcgccgtcactggcagccacatacagttcacgactgtgcgatactgcgatgccatgaacggagccacagttcaccacagctctttccaggccgacagcttttacacacacacaccaccgatggtgttttacatgtctgtgactcaaactcggctcaaccattggaaccataccacagctgcgtgggcacgaaggaatggaaatggaatctagtactatatactatagccggtcggtgacaatggaatacggcaatggccaggtgaacaaatcctggcacgcccaagaataggattgacagacagggacatggggagaagaagaagaaaaggatgcggttattttcgcagcaagcagtcacgcttggcttggattcgattggatgtccgcaaatggccccgcgctcggctccacatgcgcaggatccaatgccgatcacgggtcgtgctcgggcttg

SEQ ID NO: 23641 - DNA, 535 bp, Zea mays
  unsure at all n locations
  Clone ID: cC-zmle189052b05d1
agccaacagggagagggaggagaagatcctcaggggcaccaagcactctccgcatcctcccacctgggaccacgcgagcgacgccgccgacgccgacgccatcgacgacgcgtcctcagatgccagcgccagcgacgcggagctgtgctgcatctgcttcgaccaggcgtgcacgatggaggtgcaggactgcgggcaccagatgtgcgcgccgtgcacgctcgcgctgtgctgccacagcaagcccgacccggtgacgctagcgctgccgtcgccagcctgcccgttctgccgcggcagcatctcgcggctgctgctggtggcccgggcaagcagcgacgacgcagacaccgagaagtcggcggcagcggctgcggcagcggctgcctcctccccgcagctcgtccggcggcggtcccggcggtcgcacaacctcagcgacggcggcagcagcagcttcaggggctgtcgtccgccgtgccggttccttctccaagatcgggcgcgggtcgagccggacgatggncgacagcga

SEQ ID NO: 23642 - DNA, 470 bp, Zea mays
  Clone ID: cC-zmle189052b06a1
cctgaaagaaacgattatatatgtctttcatcatatataatgtatgtacatcgatagaatgacgacgagccaaacgattcgattgatctccgcaatactacgtacaatgcaatgcaaactcatcaccaccagattgcttgagctgaacaatacaatgaaggatcatcatcagtagacttcgacgttccattgctcgctcttcttgagctgcttcttgtagtccaaccagttgatcccgtccttggctgcaaggtcgagcatgatgtcgtcgatgcccttctccatgcccttgagcccgcacatggagacgtaggtgttgtccttcttgagcagctcccacagttcctccttgaactccgccatgcgcgtttggatgtacatgttttacccggacgcgttcgtctgctcccggctcaccgcgaagtccagccggaagttgtccggcgccatgtccttcatcttctccagct

SEQ ID NO: 23643 - DNA, 598 bp, Zea mays
  Clone ID: cC-zmle189052b06d1
cggacgcgtgggcggacgcgtgggcgtcaaaggagtctgctctaacttcctctgtgacttgaagccaggcgctgaggtgaagatcacagggccagtgggcaaggagatgctcatgcccaaagaccccaacgcaacaatcatcatgctcgcaacgggtaccggcatcgctccgttccgctccttcttgtggaagatgttcttcgaggagcacgaggactacaagtacaccgggctggcgtggctgttcctgggcgtcccgaccagcgacaccctgctgtacaaggaggagctggagaagatgaaggagatggcgccggacaacttccggctggacttcgcggtgagccgggagcagacgaacgcggccggggagaagatgtacatccagacgcgcatggcggagtacaaggaggagctgtgggagctgctcaagaaggacaacacctacgtctccatgtgcgggctcaagggcatggagaagggcatcgacgacattatgctcgacctcgcagccaaggacgggatcaactggttggactacaagaagcagctcaagatgagcgagcaatggaacgtcgaagtctactgatgatgatcc

SEQ ID NO: 23644 - DNA, 425 bp, Zea mays
  Clone ID: cC-zmle189052b07a1
atattcacagcatcttctctcttttttcaaatgcacaaggtaaattcgagggttaataattcatgaaacctgcatacaatcgcaatatacctggttttcttaaaataacctacagaggataagacagcctttacatattacgttacagaaaattttttcacacagatctaaaagatctcaatacccttatctcagcaccctattccgaccactatggaagccagaatttaacgtggagcaaaaacggattcttagtttaacgacagctctaaatttatttcaacggagaatataacttggaccaggccttttcgtgaactaggtgatttaaaccatacggttttagagcacctgacctgtctatctacaggattcaatcttagcttttgcacaaactttaccggttggaccatgaaaccctgctt

SEQ ID NO: 23645 - DNA, 741 bp, Zea mays
  unsure at all n locations
  Clone ID: cC-zmle189052b07d1
cggaattnctctgggtcgaccccaccgcgtaccgcgccaccgccgtcgcgcagtgccagctttgggcatcagatcacctgtacggaacgaatgtctggaagacggcttttatantgagtaaggacgaagtagggttactaacgcagcacattgtaatgtgagtggcacatatcttctgctcagttctacggtgcatgcgcatcttattgcttcacgtatttgtctggcaaacatgatgccggtatcttaccggagataatggccactcagaaatggccccgtttgcagtgaaatgagtaccctgcaagacttgttgcaaaatgccagacagaaccccaaccttcttctgctgaaagatatgctgtaacttgtacccctgtagcacagcaggggttcatcggtccataccggttgaagatttgtgcacgaaagttatagattgggatggctgtaagataagacaagatacaggttgcctcttaaagccgtcctggttttaaaatcactctaatttcgtcgaaaaaggccttggtctcgagtttagattctctcgttgaaataaattttgaagcctgacgttaaaaaaaaaaatccgcttttgcttcacgttaaattctgggctccataatggtcggactagggtgctgagattagggtattgagactttttagatctgtgtgaaaagattttctgtaacgtactttttgaaggctgtcttattctctgtgggtaatttaaaa

SEQ ID NO: 23646 - DNA, 558 bp, Zea mays
  Clone ID: cC-zmle189052b08a1
ggtggaagaacaaatcataccctatctgactcagcgccagatatactgtattacatgatcaaagtatacgtgccgtaaacaactatatactgtattacatgatcaaagtgttactgtatacgtgccgtaattacaatatggcttctagatgtacaatattttgggtgatgataccaacaatgtacacagtccgacaacagctaagttatccctatcgtacaactcagttcctctcgtagaactgaaacttcatcatttaaatccgttaggtgctaggattcaaaatcctgtttcgcatctgcatggatgcaaaaatcacatctgttttgacgtatcttttacgcttttttacgcgttggagtatcgtgtatctcccgattgctatacagtacagtgtcgctgatgatgggatggtgactggtgtctccattcatgctgcctggaggacttgctcttgctgcagcccctgctgcttcccacttcttgctgattcgtatgggagcgtgttcagcaccttcacccggaacatagccttcttatcggaaccaaactcaatga

SEQ ID NO: 23647 - DNA, 645 bp, Zea mays
  unsure at all n locations
  Clone ID: cC-zmle189052b08d1
tccggaattcccgggttaagctgccgactttctgacaaggcacatgacgagctttatcggtggtttgacgatgacgatgcgctggaacaagctatgggtggagaatggtacctcttcgcaacaagtgaagcaaacaacaatagcttgcagcagcccattcgtttaattagggatgagcagaggtcactctctgttggcagccggtcagatgctaatgactcagcttcttccctatcattgccctttccacagatatcagaaaggcatgctactatcacgtgcaagaataaggctttctatctgactgatctcgggagtgaacatggtacctggattaccgacaatgaaggtagacgttaccgcgtgccaccaaacttcccggttcgtttccatccttccgatgtcattgagtttggttccgataagaaggctatgttccgggtgaaggtgctgaacacgctcccatacgaatcagcaagaagtgggaagcagcaggggctgcagcaagagcaagtcctccaggcagcatgaatggagacaccagtcaccatcccatcatcagcgacactgtactgtatagcaatcgggagatacacgatactccaacgcgtanaanagcgtaaaagatacgtcanaacagatgtg

SEQ ID NO: 23648 - DNA, 226 bp, Zea mays
  Clone ID: cC-zmle189052b09a1
gaaccgaaccaacggagaccagataaaaggtaagtgacaagaacatgctgcagccacaagatcatagatctactagtttcagctggatacagcaccagaaattaagaatctaggcaaacggaaaatgggttccgattcaaccatagacaaagtaccaagaacagataaatttattacagagaagacactagacaatctgatggttcaccctgaatcgcacgagtcc

SEQ ID NO: 23649 - DNA, 572 bp, Zea mays
  Clone ID: cC-zmle189052b09d1
cccacgcgtccgcggacgcgtgggcggcggtcccttcggtactatgaagtgcccggcggaactggctcacggcgccaacgcggggctggacatcgcggtgcggctgctcgaacccatcaaggaggagttccccaccctctcctatgccgacttctaccagcttgccggagttgtggccgtcgaggtcaccggtgggcctgagatccccttccacccaggcagggaggacaagcctcagccgccacctgagggccgtcttcctgatgccaccaagggttctgaccacctgaggcaagtctttggcaagcagatgggtttgagtgatcaggacatcgttgccctctctggtggccacaccttgggaaggtgccacaaagagcggtctggttttgagggtgcctggactacgaaccctttggtctttgacaactcttactttaaggaacttctgagtggtgacaaggagggccttcttcagctcccaagtgacaaagccctgctgagcgaccctgtcttccgccctcttgtggaagaatatgctgcaaatgagaaggctttctttgatgactaca

SEQ ID NO: 23650 - DNA, 512 bp, Zea mays
  Clone ID: cC-zmle189052b10a1
ttttcttatgaaatcgatctatcaaaatattatttgagattgtaggccttaggggaactagcacccccgatcacattatcatacgatgccattataggcttcatgcgctaatagcagagccctgatagttacgggtccaacaaataaaatacaaaagcgcgacagcgatgaccaggaaagaacgcaaaagaaaacacgagaagccaacacaatctcacatctaatctcgcctctctagtttccttcgtgcagcctcctgcatatctagctgcaggccacgccatttcgctcacttgtactccaggatcatgttgttctctggggccaggccaacacaggccctcatgatgttctccagcatcgccctctgctttgccagagcgttcaccaccggtgtgccagggggaaccagtggtgccttggtgaggtagcttatgatggtggccaccgggtgaaaggagtggaacttgtccgttccctcaggttttagctggatcctggtgctgagctca

SEQ ID NO: 23651 - DNA, 547 bp, Zea mays
  Clone ID: cC-zmle189052b10d1
ttagacccacgcgtacgcctggctgagctcagcaccaggatccagctaaaacctgagggaacggacatgttccactcctttcacccggtgggcaccatcctaagctacctcaccaaggcaccactggttccccctggcacaccggtggtgaacgctctggcaaagcagagggcgatgctggagaacatcatgagggcctgtgttggcctggccccagagaacaacatgatcctggagtacaagtgagcgaaatggcgtggcctgcatctagatatgcaggaggctgcacgaaggaaactagagaggcgagattagatgtgagattgtgttggcttctcgtgttttcttttgcgttctttcctggtcatcgctgacgcgcttttgtattttatttgttggacccgtaactatcagggctctgctattagcgcatgaagcctataatggcatcctatgagaatgtgatcgggggtgctaggtcccctaaggcctacaatctcaaataatattttgatagatcgatttcataagacaaaacaaatgatag

SEQ ID NO: 23652 - DNA, 483 bp, Zea mays
  unsure at all n locations
  Clone ID: cC-zmle189052b11a1
acaaagaatactcgctccactgcaaatttatgatttctatgtctccataacaaattgggaatcctacatttcttccatattttgatattatcacgatgtttagcatatttctattgcaagggttttattcttgtattttctagatgataatcaataatacatgcgagtggatgtctaagtatatatgttattttacaattcagggaacacccttcctcttattacttcttcttccaccgaagatatgatgtttggattgcatgcattctgctggctacttgcttcatgtttgatcgctcagatggtaatgaacgaaggcacgaaagtgctaattgcagaaggtcaaccaagcattggtagatctcattttctggtaccaaattatttccttgaattgagttcctgcattcatctaggaggtgagagtcaatgactngaaagacttgatcccgaaagttattctccacaaagctgatgatgtcc

SEQ ID NO: 23653 - DNA, 396 bp, Zea mays
  Clone ID: cC-zmle189052b11d1
tttttagtctttatattctacgacgggaaccaatgatggatgaacataacaaattccacacccggcgcaaatttatcctggtgaatcatgaacccaacctcggggggggaaaatatgctagacatcgttgaaggcccgttaggtacatggagctgacagtcgacaatatatgtcccaccctatgccgatcctccaactgcctagaatccatgtgctattctccggctctagcaaccactgctcatgaggtgtcaccaccctatctttattttactggactcgcgcatgcccagacagccagtcagctttgctgcgcctgcttatccttcctggcctcctcgacatgctttttcttcgcctacaccgccgtcgtggtctcggcggcgggggcgacct

SEQ ID NO: 23654 - DNA, 442 bp, Zea mays
  unsure at all n locations
  Clone ID: cC-zmle189052b12a1
ttttcactaatcggagccggtaattagaccgagtcactgaactgaggtttgtacaagtacaaagacaggcaacaaaaaaaaaaagatcccgtatcacgttcctaaacacaaagctggcagtgagtgggctccccgatatctcaactaaacgggagctacagctagacttcaaaacagatcccgaagacgagacgagaccacagcacgccgactacagctcgtccttgtcgaaggacggctccgacccctccttggccgccggctccttctcttccacctccggctgctcctcggcctcgtcctcctcctccacggccgcgtcggggctcaggtccaggctcttgtgcaccgacttgtagatgctggacgcgaactccttggggtcggngagtgttgaacccgctctccataagggccgtctggtacaccagcctcgccgtct

SEQ ID NO: 23655 - DNA, 425 bp, Zea mays
  Clone ID: cC-zmle189052b12d1
cttgccttccttgacgagtacatttcaaggattttgccattgcagaaagacatcttctacctcacgggaagcagcaaagatcagctggagaagcctccgttcctggagaggctaaccaagaagaactacgaggtcatcttcttcaccgaccctatggacgagtacctgatgcagtacctgatggactacgaggacaggaagttccagaacgtgtccaaggagggcctgtagctgggcaaggactcgaggctcaaggacctcaaggagtcgttcaaggagctgacggagtggtggaagaaggccctggagagcgagagcgtggactctgtgaaggtcatcagccggctgcacgacaccccctgcgttgtcgtcacctccaagtacgggtggagcgccaacattgagaagatcatgccggcgcagac

SEQ ID NO: 23656 - DNA, 249 bp, Zea mays
  Clone ID: cC-zmle189052c01a1
ttttgaataattttaactttattactatttaaatatgggggagcaaggagaggtgaacgaaggaaaaggtgtgacgtacagtagtagagagagttcactgttggtgagaatagtgacaaatgaatcatctgacttagtctgaacaaggaaattataggcagaatatggggcaagagtattttgggagttttctagaatatgaaccatgcttaagggatgacatggttggatagggaataatttgataag

SEQ ID NO: 23657 - DNA, 523 bp, Zea mays
  unsure at all n locations
  Clone ID: cC-zmle189052c01d1
ttcttgggtcgtaccacacccacgcgtccgggcgagtgttgactggtgtaanccccctattctcccacttattttcgcctactacccctaatccccccaggtagcctataaatagaggggcaagggcctcctctcaagccaccccaagccatttcatggcaactgtctcccccccactccaactcccacacaagcacaaggatcgttcgtccacctgttcttagtttgtttgttcgttcgtccgattgttcgatcgttcgttcgatcgttcatggttcattcatccgttcgtccgttcgttcgtccaaataatctttgttcagccattatgctactaaaattctgatcgttcgttcgaccgttcgttcatagtccctattcatcgttcgttcatagtccctattcatcgttcattgttccgtcatagtccctattaatcgctcatattccctattcatcgtccatcgttcgttcatagtcccctattcattggtcataggccctattcatcgttcatcggttc

SEQ ID NO: 23658 - DNA, 457 bp, Zea mays
  Clone ID: cC-zmle189052c03a1
gaaacaactggtacattaactactcttcacgggtcatagggccagatacttactacctgactgtaagagtaacaaacaggatacaagtatgccgcacacacaggcttttcgcacgatcattttttaggtgtaaatatgagaacgccaatctgatacatcagctacgattttggaattaaggtacaggttacctaggttctattggaacgccaaactggaaatattcaggcccttatcgcaagaactcacctgtctaatctcactggcttcactttatgcttgagaaactgacgaatgggctctcgcttacagttatcaatccttatgggctccttctgttcacccttggtgacaagcattatgagctttggtggcgaaccatatgaataacgggtttccacatatgggaaggcgactttatcttcttcgaggaagccaacaacttctggatacaata

SEQ ID NO: 23659 - DNA, 521 bp, Zea mays
  Clone ID: cC-zmle189052c03d1
cggacgcgtgggagatatggatcggtcgtatctccccgtggcggcggcggccgtcgccctggtcctcgtgtgctgctccggcctctgccgcggcgagcggctcggggcgagggagtgcgaggacctggggttcaccggcctcgccctctgctccgactgcaacgcgctctccgagttcgtcaaggaccaagagctggtggaggattgccgtaaatgttgcaccgaggattcagatgattctatcagcaagctcacattttctggtgcaattattgaggtgtgcatgaggaaactggtattttatccacaagttgttggcttcctcgaagaagataaagacgacttcccatatgtggaaacccgttatttctatggttcgccaccaaagctcataatgcttgacaacaagggggaaccgaaggagaccataaggattgataactggaagcgagagcacattcggagtttctcaggagaaagtgaaccagtgaaatagacagctgagttcttgcgataagtgc

SEQ ID NO: 23660 - DNA, 385 bp, Zea mays
  Clone ID: cC-zmle189052c04a1
aggaaacccggaaactttagtagacagacccttcaggatgccgtgtttgttatgcaacggtaatgtacactacatgcgacgatcacatactcagactggtacagtacctgccatgaaacattaagaatacgaggaacaacgcggcctactagctaggtagctaaggcacttgggatttataacaatgaacggggggtataaacacgcaaaggatggatgcagggaaagaaggatggaatggccggacacacaggaggctttaggaagtatttcaatgcggccctgtagacatggacgcgaccgagactgtagcccttggcccgggaaaagggacacataacaacctttacagagctgatagtgcgtacgcatggaggacctggac

SEQ ID NO: 23661 - DNA, 213 bp, Zea mays
  Clone ID: cC-zmle189052c05a1
aaaaaaaaataaaataaaaaattatataattttttttaagtttttttataaaaaaaaaccggggaacccgagctttaaaaaaaacccaaaaaaaaaaaaaaaaagaaaagggaaacccaaagagtaaggtgaaaaaaaaaaacaaaggaaaaaactaacacaactagggcgacgaccaaaaaaagcaaaagaaaccccaaaaaaatccaaaaa

SEQ ID NO: 23662 - DNA, 299 bp, Zea mays
  Clone ID: cC-zmle189052c05d1
acaatacctcatatacaaatacaacacgacgcgagcaccctgtttaatgcttgagatcgatcagcacgtaatatgtccatgcatgcatggcagcaccgcaagatgccgtgtctacccctatatattagctagatacacatgcacgtacgtattaatacatctaatacgcacacgcactcgataattggtttccacgacatcgacaccgcaccgggtatcgctagttagactattattagctactgatcacccaggaggagacacgaggaatctagcattcatctaaaaaacgatcccca

SEQ ID NO: 23663 - DNA, 404 bp, Zea mays
  Clone ID: cC-zmle189052c06a1
tttttgaagatctcaaatttctctcttatttagacattctaaaatccagacacattgtaaaactatccatattcacgaccagataaaagctctcgatttcaaagagcgaagccttagttctctggagaccatgagacatctttagcctatatgtggttctaggattacacttatgtacacatgcatctgtcattgccatgttcctttgagcggcataactcatcactttctatcatacctccgaaccgttatttgggccggaggggttccttagacatcgagattttgccgtcacagcagcttcgattgaggcgtactctcccttttctttccagctgaacatgttacgatacttccctgaaacctgactccaaaagcttcgagggacgtctaagtcacctcat

SEQ ID NO: 23664 - DNA, 559 bp, Zea mays
  Clone ID: cC-zmle189052c06d1
ccggaattttcgggtcgacccacccgtccgaaaaggaaatcaaaacaaagtaaagtggggggaaaagcatggctttagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggctgggaagctcgccggcgctgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggccaggtcttatattttgtatggagaggaatactttcgttgattgctttttttgttctacctgagatgcactgtcttttgttagcaacacattaatcatagaggagggtatttgttcttaggaa

SEQ ID NO: 23665 - DNA, 350 bp, Zea mays
  Clone ID: cC-zmle189052c07a1
tcgtccttttttttttttttttatgtacgaatcatacgcccgtacatactaatgccagctcgtgtaacgtacgctaatctactaatcatgtgacaagaacctatcaagcaccaagctggcaaacacaacatactagcccatgcttgcagagcctattccggattaaaccgtgcagaaagggacttggtaatagctgcagacgccacaagcgtgggacttaatgacataatgaatccaatgacacaactaacattacagcgaaccatccggatggcctgacaccagtgcttcaggataaagctaagcacatggagcatacgtatttgacggacgagtacaagcagtcctga

SEQ ID NO: 23666 - DNA, 565 bp, Zea mays
  Clone ID: cC-zmle189052c07d1
cggaaatctcgggtcgacccacccgtccgcccacacgttcggcctagctctataactcgagtattgcttgctttccacaagaaacaaggcaaagcaccaacaatggccgccgactactagacctcgggcctcctgctgctcctggccgccgccttggctggcatgagcgccaacgccgccaccttcaccatcaccaacaactgcgggttcaccgtgtggcccgaggccaccccggtgggcgggggcacgcaactgaacccaggcgggacgtggaccgtcaacgtgccggccggcaccatctccggccgagtgtggggccgcaccggctgctccttcaacggcaacagctggagctgccagacgggccactgctgtggtgcgcttgactgcacgctgtctgggcagacaccgctgacgctggccgagtacaccatcggcggcagacaggacttctacaacatctctgtcattgacggctacaaacctcccatggccttctcctgcaacaacgaagtgcggttggtgtgcacggaccctgtatgccccgagcgtcccacacccccca

SEQ ID NO: 23667 - DNA, 259 bp, Zea mays
  Clone ID: cC-zmle189052c08a1
cttattgaaacaatggtcctttatggtcttgattaggcccggggggcggacccgaacttaccagggggagccagggcaggagccaagcttgccgaaaaagggggaacacacgcgccggagcgacggagggcacacagttattcgggtaaaagacagaggcgcaaatgccttcgcgcagagcgaacgcatccctgcaaggctcaggccaggcgggaatgcccaaagaggggcatagctgaaaccagtgggaaagcgccaa

SEQ ID NO: 23668 - DNA, 344 bp, Zea mays
  Clone ID: cC-zmle189052c08d1
aaaaaaaaaaaaaaaaataaaaaacaataaatacacatttacatttatgcaatagcagtaaagaaggaaaatgtgacgagaacattgaaaaattacgaaaacgggggggcccctatttagatttccgtttttgttctccttgtatcatgcgctttatgtcttataaagggctcccgtaaattgggtttattggccgaacttttataccgttgttacggggaaaaccttgtcgtttccctattataatgcgtttgcagctaattccctttttttccctgttgggttataacaaagaggtcccttttgatccccttctttcattggggtccctctttattggtcta

SEQ ID NO: 23669 - DNA, 475 bp, Zea mays
  Clone ID: cC-zmle189052c09d1
ggaattttcgggtcgacccacccgtccggactagttctagatccctcaacattatgaagttgaggataatattgagacaaacgaactgtgtcctacatttgcttcttctcagaataaccaaagcgctatctgcaatcaagtggcagaatcagtggcatcccatgaaaaggaaacacaaggtgaaactgaagaaatggaagaacagaagaacatccctcaacattatgaagttgaggataataatgagacaaatgaactgtctcctacatttgcttctcagaataacttcaattcgcaagttgagaaaggaatacaaatctacaatttagatacaccgccacaagatgaattgtcgatcgatccacccgataaagggaaaacagttgattcggagttattacctaacatcaaagcagaagatgctgttacagtggaagaggaaaagattggccagtctagctcatttaaaatacgt

SEQ ID NO: 23670 - DNA, 97 bp, Zea mays
  Clone ID: cC-zmle189052c10d1
gcactcaatatagcactcctgttcctgagggcatggtcactctgccctatgccggtcaaccgatcgctatcatagaggctcgtgcgcatatggaccg

SEQ ID NO: 23671 - DNA, 147 bp, Zea mays
  Clone ID: cC-zmle189052c11a1
gggaaaaaaaccaaaagtgtgggtccaaaacccacccacccctttacttgaacattgggtaacgaggaacaaaaatccgctgaaaaggggccaaatgcccaacagggcacaaattacaaccccttaaatttggggcccggggggcgc

SEQ ID NO: 23672 - DNA, 491 bp, Zea mays
  Clone ID: cC-zmle189052c12a1
aaaccaatagcataactgccatacaccactagttacataggcaacaaaattccaaccaacacaagcacaagggctccaagcaacaaaagaagataacagacacccttcctagttctgaaggccagcctttggcagaatcaagcctcacattgtacagccaaatcatctctgccccctacccaaagttttttttttcacaaatacatcatcacaggaccaaccacagtgaagtgtgcagaccacaaaaatccccacaggcggtgccggttactgggtccggccgtccgggtgatcaaccttccctggcctcctcctcctcctcttgcttggcttgctttgccccaacggagaaaaactcggtgatgacctcgagaggcatgcccttcgtctcgggcaccttgacgaacacgaacgcgagggctaggacgcacacgacggtgttcaccccaaagacgccggcgagcccgacgacgttcagcatcacggggaga

SEQ ID NO: 23673 - DNA, 488 bp, Zea mays
  unsure at all n locations
  Clone ID: cC-zmle189052c12d1
aattcttggtgcgacctcacccgttcggccatgacgaccttactgatgctcccaagcatgggcattgcgatgtggctcatggatatgtccggaaggaggtttgtcctgctcgcgactatcccaggcctaatagtcgcgctactcgtcctggtggtgtccaacatcgtggacgtgggggacttggcgcacgcgtcgctctccacggncagcgtcatagtctacttctgcttcttcgtcatgggggtcgggcccgtccccatcatcctctgcgcagagatcttccccaccacggtcctgggtgtctgcatcgccatctgctccctgggcttctggctctgtgacatcatcgtgacgtacactctccccgagatgctgaacgtcgtcgggctcgccggcatctttggagtgtacgccagcgtgtgcgtcctagcccttgcgttcgtgttcgtcaatgtgcccgagaccaaaggcatgcctctccaggtcat

SEQ ID NO: 23674 - DNA, 438 bp, Zea mays
  unsure at all n locations
  Clone ID: cC-zmle189052d01a1
gtcaccatcttcagttcttcttttcgttgaataaaatgtgtgtcgaggaatgaacagtccatttaagattttgcatgtgcagcagtagtaataaaaaaaatgtttttgctgttggtcaccgaatgaacagtccagctgctgaaatgttgcagagttctagcattgaatagaaactttggatgctgtcctcggaacttggggccgggtggtccaggctgaaatcctgataacgattaaccaaccaacatgtcgttcattatcctgttccccatcatcaacagcacgtttctgtactgtactctgtagtctgtaccagtagcagcatgcaggcctccttcatctgctgaactgaactgacagcagaatgctaaagaagacacgggcacggcagcagnctttctgttcatctgctgcccccaaccgtcgacagtcgcacgc

SEQ ID NO: 23675 - DNA, 420 bp, Zea mays
  Clone ID: cC-zmle189052d01d1
aattcccgggttgacgcacgcgtacggaagaatattctcctccggctccggtgaggataagagcactcatgccggacccagttgccactacacatagattactatggccgccagccaccgattgggacgccggagttgataacgccgacacccccgtccgcttgcactgcatgcaggcttgtcgatggcagcacggtggagtcacaggggaaggaggcctgtatatgcatgccaagaacgcccgactgcgttaactgtgaggttcttggcgtgcgactgtgctcaccgatggcggcagcagaagaacagaaaggctgctgtcgagcccgtgtcttatttagcattcatgctgacaggatatctcaacagatgaaagacgcctgagtgctgctactggtacacactacacagtgcagagca

SEQ ID NO: 23676 - DNA, 429 bp, Zea mays
  Clone ID: cC-zmle189052d02a1
aatgtacgaaatgaacgttccatagaaggtctcgacgaaggaaggaaacaatgtacgaaacgagccaacagaagacaaacggggaaacattcaatgcacaaggctggcccgtcccgacccataggggccgatcttgccacacctagttggagagtctagcttatccccgtatcactcgattcggcccacggaccttaccatatcatgcgaagatgcgatccagactctccttggcttagccatgcgtctagaacaaggcgacaacggcaccgatggcaccgacaagcatatcaccggctcctccaatagactgggcataggcagcgttggcggagctggaggtccagccggcagcggtgttagtctgggtaccagagggagagaccgtgctggaagcgggcctggaagtggaagcggcaccagaggcgc

SEQ ID NO: 23677 - DNA, 516 bp, Zea mays
  Clone ID: cC-zmle189052d02d1
ccagccgggacgaatctcgtggaccggtggttccgctcctttcttcttgtccatcctccccggtagcaacaccgccgccgttcctttggttgacttgggtcagcaggacagcaacgtctacgtctggaacgccaacgtccagcccggtcaggacattaccgtccgaatctcggactctcagggaattgtccagtactcttcccagatccccgtcattgctggatccgacaccagctgtgtcggtcaggccatcgctggtacttcggccggttccaccgtcgctgccactagcaccggtaccgcccccgtctctaccgtagctttctccgccgcctcggacgctgtctcttccgccgccgcttcgtcgtcctcggctgcctcttccggtgctggtggtgttgttggaggtgccacctctgccgtctcgtccgccgtcgcttccgctttcagcgccgcctcttcggtccgatcctcggactcttccgtcgtcagcagcgccactggtgccgctttcac

SEQ ID NO: 23678 - DNA, 517 bp, Zea mays
  Clone ID: cC-zmle189052d03a1
cacaaaacaatcgacttcacatgttagattatttgatctgtgctttgtcgatactagcgaaccaggtctgagcaacaagcagatcggagcactcagatttgagattaccactcagccctaaccaataaatcatcactaacaaacttgaacattttccagggcagcggacactagtttcaccaagcggtggtggctggaggggagtggtggagaagaccagatctaggacggggtggcggacgcttgccttatcctaactccgatgacgctgatgctccggctgaggttcctcgacggcgacgacggtgcttgaggaggtggtggtccagacatcgtcgatgacggcagtagatctaggacgacgcccgtcaacgaggaccatgactcggctgtccaagagagtggacggggctccaattcgtgagatgcagtaccgcctgcatcggcctcccatatcggggacagccaacttgctgcttttgacgctggaatgtggccggacgcgtgggtctacccg

SEQ ID NO: 23679 - DNA, 487 bp, Zea mays
  Clone ID: cC-zmle189052d03d1
cccacattccagcgtcgagagcagcaagttggctgtccacgatatgggaggccgatgcaggcggtactgcatctcacgaattggagccccgtccactctcttggacagccgagtcatggtcctcgttgacgggcgtcgtcctagatctactgccgtcatcgacgatgtctggaccaccaccacctcaagcaccgtcgtcgccgtcgaggaacctcagccggagcatcagcgtcatcggagttaggataaggcaagcgcccgccaccccgtcctagatctggtcttctccaccactcccctccagccaccaccgcttggtgaaactagtgtccgctgccctggaaaatgttcaagtttgttagtgatgatttattggttagggctgagtggtaatctcaaatctgagtgctccgatctgcttgttgctcagacctggttcgctagtatccgacaagcacagatcaaataatctaacatgtgaagtcca

SEQ ID NO: 23680 - DNA, 445 bp, Zea mays
  Clone ID: cC-zmle189052d04a1
ttttatcaaacacctgattaagattaaaatggattgaacgaaaaataaactggaaaaatcatgactaggaacacaattatccctgggatatagatcactaaccaacatcatggtgcaacccgcaaacctgcgtgagctcacatgcattcgtacccttaacggtaaatgacgaggccttaattacttgccgggaactaacctggtggcgtaggcccacacgttggtgctgaccgggcacaggatgcagtcagcaaggttttagatcgggtcattgccagagacgattgcctatactaataatcccaacatggataacatggcgaggcggccggtcttgagctacgtgactctagagctccgctaacgccttactgtcgactgctgaggccaaaggctacaaactgccgcctggcgaacgcgtccgtctagaccggaattcccgacc

SEQ ID NO: 23681 - DNA, 380 bp, Zea mays
  Clone ID: cC-zmle189052d04d1
cccgggtgccgtttggaaccgttccgactatcctgctaacccaaggccttggcctagcttaaggccaacgcgctcacaaactggcgaatgaccatgttatgcatgttcgcattgttcgtgcatgccatcggctccggtaagggaccgatcgagaacctttctaagcacactggctacccggtataaaaaaacgcttggtcctactgcaggaatttcgtgccttgtgagtgaaggaggcgccgtccgcgacctccaggcgtctggataactgtgaccgcaagctggttttcgcgttgtaccacgacatcaactatatgataatcgacagagcattattgcgttgatctgaattaatatgccggtttctgtttcctgcgtgc

SEQ ID NO: 23682 - DNA, 557 bp, Zea mays
  unsure at all n locations
  Clone ID: cC-zmle189052d05a1
aaagcatgaactttagtttacacttcctcttattttggccaattgtattcacaaggtatgacgctactgatgaaactgcacaaagtccaccgaattgacaggcgcccttgggtacatagcagtgagactggaaaggtaacaaatggaatacggatacgtagataaccacggagacccagcaatgctaaggtattgtttggtcactgcataaccgacgatgatggtcacaacgcctcgtgatgcctcgtgccttaacagcacccggatgatctctgggcccggttgccacccaccacgtccacggtatctggcacatacagttcttcctctggctcattcttcagagcattcttcacgatacactggaaggcgtcttccacgttcgttccgtccttagcagacgtctcaaagtacgggatgttccctttggaagcacaccatgcctttgcctttttctcagataccacgcggctgttgccaccatctacatcaactttgttacccaacagaacanaagggaaattatcaggatctgatgggctagcctgaatagaaac

SEQ ID NO: 23683 - DNA, 506 bp, Zea mays
  Clone ID: cC-zmle189052d05d1
ggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaataactggcgagaagagtttctaattcaggctagcccatcagatcctgataatttcccttttggttctgtgggtaacaaaagttgatgtagatggtggcaacagccgcgtggtatctgagaaaaag

SEQ ID NO: 23684 - DNA, 446 bp, Zea mays
  Clone ID: cC-zmle189052d06a1
gttaattgttttttgttatttatggttaaggttgattcatcatatagagagacttgttgctgttcttttattgctattcaacttaaaacatggtactactctggacgggaagctggtagaacactggttgaactgtcaaaacaagactgagaagacggagcagtgtatgccgaagaggcagggggccatatgagcgaagattgcgcagggggaatgcagacggctggtggaggggccagaaagcaagaaggcttagatcagggagcaggggcaatggccgtagaagctgatgctgtaaataagcgagggaactgaatgctgctagagggtggaaagggaaaagatgtcggtggtgagcagaagctaattggcagaatgcgtgaggccgagcgctaataaggatccgagcttaaaggagccagttggtggagtggaagaaactggag

SEQ ID NO: 23685 - DNA, 470 bp, Zea mays
  Clone ID: cC-zmle189052d06d1
gatgaaaaggactttgaaaagagagtcaaagagtgcttgaaatcgccgggagtggaagcgcaactggcccttcctcacggggttcgccatcaccggcttcatcatcaccaagatgacggccaacttcaccgaggaggacctcaagaactccaagttcgtccaggaacacaagaagcgctgaccaaccgggagtcgtccgaatcgcctgcggatgaaaaattagccccctatttatcttgtctttttttttatctagatgcgtgcactctattgtaataatgtaataagaggcaattggattgatccaacagcaaccggcttctgattttgatccgcttcgctgacataatatgtgccttttttctggatgttggattgcatctaatcctgttgaattggtgagctgggtcctctgtgatttcatcttgtttgttctgaagatagattggtcttgtttgttttggctcccc

SEQ ID NO: 23686 - DNA, 520 bp, Zea mays
  Clone ID: cC-zmle189052d07a1
ttttgcataaaattaatttatattattattccatacatatgctaatcacaattcacacatggaaactggaaaatagggtggttcacctctataaagaaaagttccactgcttttgtacctctataacatcatttatttatttatctatttatttttcaacgcatacatatggcaaagcgtgccttggcaacttgggcaacgtcttatgtaatctatttatatacttcgttttattcgatggccttctcttatttcattcgaatgcttcgacttggatgccgaatgcacttgctcgctagcgaaaggcatccatcagcacctgggttgcacgaacactgctgctgtccttataggcacggggaatcgacctgtggcggtgtcgaacgcagactgactggctaacgcatccgatgaattcacctgcactggatgcaactgaagccgcagtgatgcaagatcacggatttctatagacacttcttacggacatacattgaagactgtcacgacacatgagaat

SEQ ID NO: 23687 - DNA, 570 bp, Zea mays
  Clone ID: cC-zmle189052d07d1
gcaactggtcgtcagaatcggcttctggctgccaaatgctttgcttctcagtccgcttctgtgaaaatcgattctgtgaaaatcgctcaaatcaatgtgaatgtagaatccgccgagtcgtcgcgatgggaggaatctggtgcttcctaaaccctaaatcgtgcaggcctttttcatctttatttgcgtgcaagccccgcgatatctagattctcgtgacagcttgatttttcatgaatccagattcttagaaaaggtcttcagaaaaaagctatcccaaaagccccaataactggtgttggacaatcagttgcctagccaagcgtggtttgcccacaccagcctgccttcccgttcagtgattatgccgaggaaacaattgaggatattcgtatctcctgtgtgttcactcgacagatctggacaacagtgttcttaaggcgtcgcctaggcactaagggcggtgtctagtgcacttgctcgcctaggcgccttaagaacactgctggacaatattttttcagaaaattcccatgtcagcttgtgcatatccagtcgctgcaacttgct

SEQ ID NO: 23688 - DNA, 483 bp, Zea mays
  Clone ID: cC-zmle189052d08a1
gcagcgggaatcttattaccaagttttacaagttacatcaagtttacattatatatgattggagtgattacaaaagtgattcaaagaaataactttgaactgttataaattatttatagttttgaaatatatgctagcttaagtgaccatcctcaataagaagtatagaagggttacttagacttataagaaggtcgtgcccaccggcgcttaacaccaatcacaatcaagtgactcatgacctggataacactaggttagtgtggttagacgtcgatcacttgacgaccatcctttgtcttggcattcgtcagattatccatcttcaggtttgttcatcagcatcaccacgcggagtagcccgcacttggggtcgacttggctcgtcttccgcatcacgcgattaagtatcgtacctcatgagatgcacaatgcacatgtatgagcataaagtaaccgaatgattcagaaaagagaatcaaa

SEQ ID NO: 23689 - DNA, 483 bp, Zea mays
  Clone ID: cC-zmle189052d08d1
ctcatatggtctattgttttcctaataaatgaacctaggtttgatagtcttctggtgttgggccttagctaaggaaagtagacgtgcatataattttttgttccttgatgtttgagttaaatctggtaaaactagaaaatcgtgattgttgtgtttagtgagttataggtgtctagtgcttacgtaggattgtgtcgatgtcttgcgctaagtatttgattctcttttctgtatcattcggttactttatgctcatacatgtgcattgtgcatctcatgaggtacgatacttaatcgcgtgatgcggaagacgagccaagtcgaccccaagtgcgggctactccgcgtggtgatgctgatgaacaaacctgaagatggataatctgacgaatgccaagacaaaggatggtcgtcaagtgatcgacgtctaaccacactaacctagtgttatccaagtcatgagtcacttgattgtgattggtg

SEQ ID NO: 23690 - DNA, 397 bp, Zea mays
  Clone ID: cC-zmle189052d09a1
aaaaaaattggtggttaacaaaaggacaaaacaaaaaaaaaaacccccacaaaatgaaaaacccacacaaaaaaaaaaaaagggggaacaccgaaaaaaaaaaagggacaaaacccaaaaaccgggaaaaaaccaaaaaaaaaaaaggggaaaaaaaaaaaaagaaacccaaaaaaaaaggaggggaaggctcaaagagaccccaaaaactaaagggaagccaaacaggaccaaagcccgagggtggcaggaaagggcagtttaaacacccaggaaccaagaaggagggaccccagagcacaaaaaggggagcctttgaaaaaaacaattcttaaacgaaaaacccaccggagaaaccaatacaaaggacaaaaagattagcccccagaaagaaagc

SEQ ID NO: 23691 - DNA, 543 bp, Zea mays
  Clone ID: cC-zmle189052d09d1
gtttcaactaatcagcttactaggatgaagcctgcaacggtggcactgctcattttgttgaacatgatgtgcatagttgcatactttgatcatggaacgatggctgaagaaaccaccttgctggcaaattcgtatggaagaaatgaaggaaccaagggcatacatcatggaagaaagctgatggacaatagtattggttcaaaccgtgagtattcaatcgatgatatgtctcatccaaaggcaccacatactgagctcaagcaaccctcatacttagctcctggttgctcaagcaaccctctcaagcaaccctcaaacttagctcctggttgcattccctaaagttcatgcatacatatatagccttccactcatcatatgctggtatccgatctatatatagacacatatgatatgttgcatatcgccaggttctcagatcaagtcccttgtgtagtatgagtggaaacctatctaaataatgtgtgtggcttctgaaatatgtggtgttatggtactgagctatgctcaatagtaacaaca

SEQ ID NO: 23692 - DNA, 446 bp, Zea mays
  Clone ID: cC-zmle189052d10a1
ttttgacatcagcaggcactccttttattcgcaaaagccaagtatcaggaggacgcactccactcagcagctatacctatatgttccgttcttctcactggacagtgagagacggagatcctcacactgcatgcgtaccattctcacaactcagctgatgtatgtcccttcatttacagtgtgatgcatgtgcatgtgtaaccggatcaggctgcggcgacatgactctgttccttgaccacgctctctccaccctgttccagagtctgtacatgtgcaggctcctcttcgatggcctttcccttgccgccatcttccagttccagctctttcagctgcctcaggatatcttctctcttggcatgtaagtcttgcaggttggagaccaccttctacaggtttgctctgagcttcaccggatcggtcgacttctccttggcgccctt

SEQ ID NO: 23693 - DNA, 316 bp, Zea mays
  Clone ID: cC-zmle189052d10d1
agtatcgtgtggttttgtaagagcgttagacaaccggtttagttccgcttttgttacggcggtacttgaacatctagacactagtggtaggcacgcataccttatcgctcagtttacacgtgcgctccgatgctgctgcttcaactgcgtagacctatgtccaagaaccatactacacgaccaagcgatatcacgaccatcggcggtttgtgagatgtcaagatggtgaaggactgagaatctgccaagctgaaggcggagaagaagtgctaggaagacatccatctgcctgggattagcaaagactagcggtcct

SEQ ID NO: 23694 - DNA, 432 bp, Zea mays
  unsure at all n locations
  Clone ID: cC-zmle189052d11a1
cgaaagaaaagtatctgaattcaaaacggaatctgtagtgtatctatcgttggttccgtgacccatgttgaataatctccccgctgccgccgggccatatgtgcatatccaggcccagccatgcatgtatccctgagtaacgccatgcttgaacgctttgatgttgaatgcaattctatgccatgttaaaccttcatttttcccattgtatcgtcgatcccagtatcccgctttacgtgggcataggggcgtccttgccggtcaagccgccgatggtgtcttctggtggtgcgcagctgcagaagaggttcatgtcgccataggcgtcatccaatctggtgacggtgggccagaacttcttctccttcatccacggcagagggtatgcggcggcttcncgagtgtagctacggtcccactcgccaacaatga

SEQ ID NO: 23695 - DNA, 336 bp, Zea mays
  Clone ID: cC-zmle189052d11d1
gttcgtctacacgtgccagcgtatgtttgagtactggttttacgcccattacatgatcgggtccataaccaacatcttctatatcgaccttacagacagtgaaaccttggcctctctcgtccgttattacgcacatttgactgacattatctcagaaaggtctgccatcttctttagcgaggctgactgaattgtgtactacctgcgcacggaagcgcacgcggttacccaccttttcggttgagggagcgacctttctttgacttctgactgtgccaccgaatctctgccgtgctgatggcagacgacattctggcataatggtcatagattgat

SEQ ID NO: 23696 - DNA, 455 bp, Zea mays
  Clone ID: cC-zmle189052d12a1
ttgatttttttttttttaatatagaacctttcaagcaatacttatagcgctaggatacttatagtagtaccaccattctgaaacatagtagcgccaggacgaaatataggatcgtccaaaaacatatccttaacaagagtttaattcaataaaacctcgctgccagaacctagcagacttcacaaaagagcatacttagaacaccctgtatggcttccccatggtgctcttgacgtacaggcatctcacattctggcaggtcttcttcagaagggaaacaaggaagttgacgctcatctggatgttctgctggatctgcttctcctccatcgccaagttgccgacggcgacacccatgcaaaggaccttcttgagctggaacttgacggttgccttagtctcgttcaccttggactcgagggattcctggtgagtaaccaggggtcgggaacttg

SEQ ID NO: 23697 - DNA, 309 bp, Zea mays
  Clone ID: cC-zmle189052d12d1
gatgtttgatggtttctgaattagactaccacaaacacaaacaatgttccgaggggggcctggatacaccaggctttctggccctaacatgtcatggtcaagcagaatcatcagctgcgctgacctaatcttagcaaagtcacacgccggatcagcctgggtacatccaattattccgtaacgtgcagaggatcaataccttgcgctcgtgcattccatccttggagggctctgcctgtggcgtttgcgtcatgtactcgtagatggaggctaagcgaaagcgttatacgatcacaatgacacacaaca

SEQ ID NO: 23698 - DNA, 228 bp, Zea mays
  Clone ID: cC-zmle189052e01a1
acactctcatgtgttccacttgtttaaattaaccaattcttgagctatagaaatatgggtcaacaaacacggagtaaaatacaggcgggcacaaaaaaatgcccgaaaccggacgctcagaagaagccggggacgattccgaggctcgaagagaacaggaaaaaccaggggaaaaaaaggccgaccaaaccctaggccaggacattgacgacgtttaagcccaagggg

SEQ ID NO: 23699 - DNA, 52 bp, Zea mays
  Clone ID: cC-zmle189052e01d1
ttcccgggtgtggccgggacgtagcaggagctggaatgaaccccgactgcag

SEQ ID NO: 23700 - DNA, 468 bp, Zea mays
  Clone ID: cC-zmle189052e03a1
gagaaaaacatggaattacttcctttttctcatacaagtgtatactatatcataaataacacagatcgtcgtcgatcttcctccccatcatatatatatatatacacggatgtttattggcacctctagtactactacctacgcactcctccatagatagaaacgagcagaaatacattacacattgaaggcaaaagagagagagagactaccctgatcttttccccttccgtcagtccgtcctcgttttcccttctcattcgacgagcgcggcgaagcagctccccgtgcgcgccagcgagctccgggacgcccccgcggcgagggccgagacgccggggtcggcggcgtcgcgcgtcgggctgctcggcgtggaccgagccttcctcgacgccggcacgtcccggctcgggaaatcttaacccgattccctttcgggtgacgcgcgtgatcgcccacgcgttcggc

SEQ ID NO: 23701 - DNA, 506 bp, Zea mays
  unsure at all n locations
  Clone ID: cC-zmle189052e03d1
cggacgcgtgggcgatcacgcgcgtcacccgaaagggaatcgggttaagatttcccgagccgggacgtgccggcgtcgaggaaggcgcggtccacgccgagcagcccgacgcgcgacgccgccgaccccggcgtctccgccctcgccgcgggggcgtcccggagctcgctggcgcgcacggggagctgcttcgccgcgctcgtcgaatgagaagggaaaacgaggacggactgacggaaggggaaaagatcagggtagtctctctctctcttttgccttcaatgtgtaatgtatttctgctcgtttctatctatggaggagtgcgtaggtagtagtactagaggtgccaataaacatccgtgtatatatatatatatgatggggaggaagatcgacgacgatctgtgttatttatgatatagtatacacttgtatgagaaaaaggaagtaattccatgtttttctcaaanaaaaaaatacaccctcacttttatatggggcgggcg

SEQ ID NO: 23702 - DNA, 254 bp, Zea mays
  Clone ID: cC-zmle189052e04a1
gccgaaaaatagttgcgaatacaattactgatgaggccacagcacaacagtttctagtagggcggctgactgaaactgaatgggcagctaccaatccttcaaaacggttgttactaacaagcatgaacaacttagctggtcaccagcacaccggtagctaccactggtagtggtagtagtgatagtaattggggttgtgggtaccagcagtagggcagcggcacggcctcggcgggcttctccttctccttttt

SEQ ID NO: 23703 - DNA, 384 bp, Zea mays
  Clone ID: cC-zmle189052e04d1
ttcctgggtttacccacgcgtccgcggacgcgtgggcggacgcgtgggatcggcacccggcgcgacggtcatcgtcccgtccgttcattccctactgctcagacctgtcgttcgccacaacatctgctggtcctaatccccagcggcagcgcgatgaagcaaaagatcgtgatcaaggtgtgcatgccatgcgacaagtgccggtccaaggccatggggctggccgccaaagcaggggcgaacaagatggggatcaccggcgacggcagggaccagctggaggtggagggcgacgacatcgacaccgtctgcctcgtcaactgcctgcgcaagaagggtggtcgcgccgacatcgtcaaggtggaggaggtgaagcccgcggag

SEQ ID NO: 23704 - DNA, 98 bp, Zea mays
  Clone ID: cC-zmle189052e05a1
caaaaaacgggaaaaaacggggaccccaagcccaaattgggggaaacaaagcataccggggaggggaaaggaaaactgggccagctggtccctttggg

SEQ ID NO: 23705 - DNA, 331 bp, Zea mays
  Clone ID: cC-zmle189052e05d1
ttcctcggtcgacccacgcgtacgctctcccagaaggaacgaactggagagcacattaattcctctgtttatttatctatactgtatgtgaatcttgctcgggcggaacaaaaatttactgagccactccaccgtgccgcttctttttaaggggaactaagaaacctcttggaaccttcttatctttatatctaacttatgttgttgatctgctattctgcttccaaaaatgcatctgtttttcgaactttaaacatcttaccattcttttccatcattctacctccatatcatttttttacacggcacttgcttgtgtgcccttttcaac

SEQ ID NO: 23706 - DNA, 349 bp, Zea mays
  Clone ID: cC-zmle189052e06a1
actacacgcttgcatatatctcacgtttaaccaagataacatgagtaaaggatcaatgactttggtattcagcgtacaagatgcttgcacctcctagctagctgaacaaaattctgaacctgacgtgtacatgatttacaggaactaacagttttgaggtcggtaaacctaccaggctgaagaacaaatgacgacgtaagtcaagaactttgcttgcttgagtatcccgctgctgccagtgagcttccagtatacttaagactgacaaatatttaccagcctgcaaagctttcagggagtgaatagcgacaggaggtggaaacccagcgattttgagcaccgttctaca

SEQ ID NO: 23707 - DNA, 570 bp, Zea mays
  Clone ID: cC-zmle189052e06d1
cccacgcgtccgcaaggtgctgctgcaaggcctggtaaagcagttggttcggtgctgcagtacaacctctctcaagcatctgctgctgagcaatatgagcagcgaagggttgctaggcacccagcagttgccccaaacaacatcccttctggaagctcataccccagaagaaatcagacctgcaagagcgagacaggcgacactgagaggatggacgtgaaccaagctgggcagccgaagtcctatgcagcaaacaaactacctgcaactgttgatggtcgcggcggccattggtagatctccgcgttgtgtaacacgttatcagcatctgttacttgtgctaagcgctacattattctgacaaattcagaaatgtagttctgtacagatccgtattctttccccggattcctaagtactgtagaacggtgctcgaaatcgctgggtttccacctcctgtcgctattcattcactgaaagatctgctggctggtggagatttgtcagactgaagtatactggaagctcactggcagcagcgggaactcaagcagcagagttcttgactga

SEQ ID NO: 23708 - DNA, 382 bp, Zea mays
  Clone ID: cC-zmle189052e07a1
aaccgccaagatgaagtattgaataataaccggagatcgactatgaaacggctacgtggcgtttttttttacagagagtgcatgatcgcagaacacgcttatttgaagaggtcaaaagaattatgggttggtttagacaagcactgctgtgcccaatctacatacactcgacataattttgccgaaacattataaaagctaactcaaacatatttaccttcattttctccgatgggcatagggacttaggcagtttggctggacttaaatacaatatgggtaatacggaccgagcatttaccacagggagccaaaacatacctttcgctggccggacaactgcaagcagcggtgctttatccgattgatcgggaacggacaa

SEQ ID NO: 23709 - DNA, 591 bp, Zea mays
  Clone ID: cC-zmle189052e07d1
gtgtgtctcatttagtcttctggtgatcatatacattttaggtaattggttctgagaaggataaggacagaatacctggcattgacatcactcttaaggagggtgacacatggatgttcgctggccatcaagttcttgtactggaaactcctgggcatacaacaggtgtttgattgaaaatttcttatgactcatcttatattcgttcttgccttcaaagttaactcctgcactgcacatgaaggcttttcgttgacttttcatgtatttttattaggtcatgtgtgctattatttcgctggttctggagctatatttacgggtgacaccttgttcaatctatcatgcggaaagctttttgaagggactccacagcaggtttttcacttgcttgcaaatatcttcatttacatgtatgttgtgtgaaggtgctactggtcttctgtgacaagctactcctttgtagtgcttttatttcactaaagaagtctcttaattgtgaacaacaaacatttttgttggagtttctgatttttttatcaaactaaaatattttctcagttgcagctattagaacctataagcatgagt

SEQ ID NO: 23710 - DNA, 416 bp, Zea mays
  Clone ID: cC-zmle189052e08a1
gagctaaaattcaagctccttttatatttggtaatttattcattgatgggatcggaggtagacagggacagatacagaccatgtctatcttactacgcatccctactgccaagaacaagaacgtcggtgacgtgaacatcctcgacggacagcggcacggacgcgtgcacgtcgagctccagcaccatgtgcacctacgaccacaccttggccgtctgtccacagcacgtacccggaggccccgcggattcccccggtgccgacgaccaccgtgagctccctcgtctggacgtagatcctgtcgcggacggccaccacgaaggtgctgccgttgcacggccccgcggtgaggacgacggtgatgctgaccacgatcaccttctagtgctgcgagctcacatgtaggtgccctgcgc

SEQ ID NO: 23711 - DNA, 442 bp, Zea mays
  Clone ID: cC-zmle189052e08d1
cccacgcgtccgcggacgcgtggggtgaagtgaagtgaataattcaacaccagcaaaacacacacacaaattcgttcgcagcaagtaatggcgagaacgagagagaagctgacgctcctggtggccacagtcgccgtgggcctcctgctagccggcggcgcgggcgcgggcgtggcgtcggcggcgcgtggccgtgaggggcggcggcgcgtgcacctgcggctgtacatgcacgacgtgatcggcgggccgaaccggacggccatccgcctcatctggggcgtgggcccgccgcacgcgtccatgccggggcgcaccttcggcgacacggtggccatcgacgacctcgtcacggacgggcccggcgtcggcgcagactccaagcccgtcggccgggcgcagggcacctacatgctgagctcgcagcacgaggaggtgatcg

SEQ ID NO: 23712 - DNA, 343 bp, Zea mays
  Clone ID: cC-zmle189052e10a1
ggcaaattaagaaaaactgtcaggagcctttcgatgagggggcatcttgttgcaattacatccacgaacctaagcctagacaaacaactaaggtgtcccaatccacgcaattaactactacctttccaacaccacccgtgtttgggcccgacatattcagaccggttcctgaaagagaaccaggtttgcatatagagaggagcatatgagcccggccagggcacggacagagctgctccccgagcgggactgttttcccctcaaaaatccccacaccataaaggccgggggggtgccatttgtagccttgggagcctaaggtctgatccgactcacattaatt

SEQ ID NO: 23713 - DNA, 383 bp, Zea mays
  Clone ID: cC-zmle189052e11a1
ttttggactaaaactaatgatggtcattgccgataggcgttatgttatgcaagaagccagcaagggaacactgccacccttaaaagagactcggttataaaattacacaaggatcatcttgcacatccaaaataatgccaccaccgtgccagcagatacattacaatatactgctattaatagaagaagaagttctttaatttggatcccggctggggcgtgcggcgcacgccaagcgagattagccgaacgtggccttgccgttgtacttgacgtccatggggttgacattcttgccgacgctgttgaagatattgccgactccctgcctgccggggttgaccttcttcatgtagacacacgtctttgtgcggaggtactgc

SEQ ID NO: 23714 - DNA, 321 bp, Zea mays
  Clone ID: cC-zmle189052e11d1
ttcagacgtggcgagactattacccgatcttccattcgaaggttaggcgagcccggcctttggccatgggcaggcgtgcagctgacggagatcccctcctgcctgtatcggctcgtggacgggcgagggcaaacttcgcggagcgctgagaatcaggggataaggactggactactacgggggtcacacatggccgcccctagatgctgacactcacgccttgagaggccgggggggagcggtctatagtgttcgagtacaccggagtttataccccaactttaccaccatctgtctgccagagcctcatgatcctgctgc

SEQ ID NO: 23715 - DNA, 425 bp, Zea mays
  Clone ID: cC-zmle189052e12a1
gggaagcaaaacaaattaggccctgttcgcctattcccaatccacatggattgaatgggtttggaaaaaattattaaaaagtttggcttgcgtgggattaaaacccatccaatcccactcaatccaaatgggttgaagggttaccgaacaagccctaaacaaatccttctgacaacgggtctcttcctaggttcatttgccaacaaaaaaattccaccaatgtctgaggccttcctcatcaaggtttatttctcctggatatcatttcattttggggactggccttcctccaacctacggaagagtagctttcaactcctttctgtggggcccaaatgactccacgtggaatcccttcttttaaacatttgggaagagctcaaaagctttaggcctagaactttcctttgcttttgcaatggcgc

SEQ ID NO: 23716 - DNA, 422 bp, Zea mays
  Clone ID: cC-zmle189052e12d1
gggtcgacgccacgcgtccgcccacgcgtgcgcccacgcgtgcgcccacgcgtgctcccaattgtaagggttagaaagttgcttttggctcacgacttggcaactgctgctgagctcaaggatatggtgaaagatatcaggatacaagtacatgacgccattgcttaagcaaaggagagttctatgcctgatacttctgagctcttcacaaatgttcataagaagggattcaccgaggtgtcatttgtgccccacaggaaggagcagacagctactcttccgtaggttgggagactggcagtcctcaatatgatatgatatccacgagaaattaacattgatgaagatggcctctcacattgctagaatcctttggtcggcaaatgaacctatgtagagatcccctgtcaggaggatctgct

SEQ ID NO: 23717 - DNA, 443 bp, Zea mays
  Clone ID: cC-zmle189052f01a1
tttttatttcaggaacagacataacaagaacaccccgcacttttgtcgcctgatcatggcacatcaacgcacttggacaactaccctgataatatacatgcttctaccggtttaatactgttgaaagtgcacgtacatgagggacgatggcgcacagataaccatctaactgaatggtatctacatggtaaacctccaaaagctgggcctggccaggacttattgctacacaggacttgtgatctggtctcaaggaaatccagccgtaccaattagacatcaagctgtgaaccttgccatgagcaacagcttgattcccatgacgaatgcccacttgacccatctactgcgagcactgactcaaccgttctaaaaccagggacctactctttaacacctttacagagaccgtagatgcctcatagatcactaggacctgactg

SEQ ID NO: 23718 - DNA, 373 bp, Zea mays
  Clone ID: cC-zmle189052f01d1
gacaaacaacccctgatcctctcaggagctatgaaagagcctgtgtcgttccttgatagcactacctgctgcaggttcatcttaaaaggaggatggacgacacagaccaatgggtcctgcagcaagtgctgatggactagcacatgatgacggtttgaggatacgcttgccaggacaagaaacactttggggatgacaagacttagcgagctgaacataacgacgatcaacaggaattcagcactgatattgatttgaggaagcccttggaacggcatctacttaatggacagaatattgactgggtgagcactgatgatgctgacacactcctagggctacatgaatgatggtctgctttcgtatccaagct

SEQ ID NO: 23719 - DNA, 455 bp, Zea mays
  Clone ID: cC-zmle189052f03a1
agaaaacagtgtactaatcaggtctgaaaacatggcataacgctctgaacttgagacgactaaccaaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattatccttctttgcagcaggggttttcttcttcctaccaatgtcaactccatagtgagtgaggtaccac

SEQ ID NO: 23720 - DNA, 455 bp, Zea mays
  Clone ID: cC-zmle189052f03d1
gtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacacttttttttggttagtcgtctcaagttcagagcgttatgccatgttttcagacctgattagtacactgttttct

SEQ ID NO: 23721 - DNA, 188 bp, Zea mays
  Clone ID: cC-zmle189052f04a1
atatgggatccatcggtttgaaaccctcaaatttgaaccccttccatatttcacaaactggggctagttcagcactccatttgcaagctgttttgaaaatttcattaccttcacgagcaaaaacgcccccttggttacaagcttgtacacaggcttttaaagccccccgattagctggtgccccaggg

SEQ ID NO: 23722 - DNA, 589 bp, Zea mays
  Clone ID: cC-zmle189052f04d1
caaatccacggtttaataacgaaccgtgttaacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatcttttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggac

SEQ ID NO: 23723 - DNA, 119 bp, Zea mays
  Clone ID: cC-zmle189052f05a1
tttttttttttttttttttttttttttttttttttttttggttttttttaattaaaaattaataaaaaagggattaagggagatattaaaatgtggagtaggataacaaggaggagaat

SEQ ID NO: 23724 - DNA, 143 bp, Zea mays
  unsure at all n locations
  Clone ID: cC-zmle189052f05d1
ggcgagtgttgactggtngaatcccactattatcccaattatttctccctactacccctaatccccacaggtagggtttatatagtaaaatcatccggctctactattaagccaccccaagccattttatggtatctgtctac

SEQ ID NO: 23725 - DNA, 541 bp, Zea mays
  Clone ID: cC-zmle189052f06a1
ttttaacaaacagaatctctgaatctggtaattctgcgctgttgggacttcagacagaaccatgtctttgaacgattacaagaatatacacaagaatccgccacaggaccaacttattaccacgattacacgaccgacaaaacttcctcctttataacgaaagggaccacatagcaaccttcatccctcagcagcaccaacaaaagcacagtaatgtgcagtaatatatcgtacaggattacacatgtcacagcagaagcctcaaaaaccttgaatggaagtacaccaaagaatgctgggctgatggaatctcatgtccccttgatcacaacaacagggcagcccacatggttgatacagtagttgctcacactgcccaagaataccctcttgagcggcccaatggcacggcagcccatgacgagcagatcggccttacggttggccgcaatctcgcagattttatccttggggtccccgaccaccaccttcgtcttcaccttcactggggccaccgtaggggatgggcgccgggttgagt

SEQ ID NO: 23726 - DNA, 565 bp, Zea mays
  unsure at all n locations
  Clone ID: cC-zmle189052f06d1
cccacgcgtccgggaaaaaatctcgcaggctgcaggtgcaacacgcaacttgaccgatccatcgccgcatcgcggaccttgaccccgcgctcactgagctaggagcagacgaggcttgagaacgagcgacggagacctagccgaagcaggagctccccatggcgaccggcaacctggcgagcgtggtggtggctgtggacggcagcgaggagagcatgaacgcgctgcagtgggcgctcgacaacctccgcctgcgccccgacggcgagctcgtcgtgctgcacgtccagccgctgcccaacatcgccgcgggactcaacccggcgcccatccccttcggtggccccagtggaggtgaagacggaggtggtggtcggggaccccaaggataaaatctgcgagattgcggccaaccgtaaggccgatctgctcgtcatgggctgccgtgccattgggccgctcaagagggtattcttgggcagtgtgagcaactactgtatcaaccatgtgggctgccctgttgttgtgatcaggtgacatgagaatccatcagnccagcattctt

SEQ ID NO: 23727 - DNA, 464 bp, Zea mays
  Clone ID: cC-zmle189052f07a1
ttttcttcagttattgggctcaatgactccataagctccttctctttctcgcttgctgcttccaccacagcttcaagactagctgcttttgtctgataagcttctagatcatcagagagctgcgaagccttgcttctgtactgctcaagttcttattcagcccccttgagctttacatatgtgctgttcagctcctgctccagttcctgtgtccgagagtatgcaccttcagcatgagtctttgatgtgtgaagcagatcttccagctccagacttctttgctgaactgaatgggcttgtacttgatgctctgaacatctatcagtcagctccttgacttcttgctcaagtagctggcttttagacatcgaggaatctacggaggattgtagctcgttaattctttctttgcacccctctgcactggccattgattcttcaagctgcatttccccttctgctga

SEQ ID NO: 23728 - DNA, 489 bp, Zea mays
  Clone ID: cC-zmle189052f07d1
gcgtattcaacaagaagctgctgtatcagcagaaagaggaatgcagcttgaagaaacaatgaccagtgcagagggatacaaagaaaaaattaacgagctacaatcctccctagattcctcgatgtctaaaaaccagctacttgaacaagaagtcaaggagctgactgataaatgttcagagcatcaagaacaagcacattcagttcagcaaagaagtctggagctggaagatctgcttcacacatcaaagactcatgctgaaggtgcatactctcggacacaggaactggagcaggagctgaacagcacatatgaaaagctcaagggggttgaagaagaacttgagcagtacagaagcaaggcttcgcagctctctgatgatctagaagcttatcagacaaaagcagctagtcttgaagctgtggtggaagcagcaagcgagaaagagaaggagcttatggagtcattgagccaaataactgaagaata

SEQ ID NO: 23729 - DNA, 297 bp, Zea mays
  Clone ID: cC-zmle189052f08a1
ggagccacaacaatacagactaaaaaccaacgaagtacaacacaacgacaggaaccaacaggccacaaaccagtgagacggggagggccacacagggataacggatagggaaaaaaccaacccgacaaagccaagccaaggcatcgggcgccaaccgaaaacgggcgagggaccggcacaaagcctcaacacccggcgagcctaccagcacccacaagcagccgggagcccaggcgccacccaaaacggggacggaatcggacaaaaacaatccgggcgagggctcatccttcacac

SEQ ID NO: 23730 - DNA, 404 bp, Zea mays
  Clone ID: cC-zmle189052f08d1
caagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggagcagaaggggattc

SEQ ID NO: 23731 - DNA, 531 bp, Zea mays
  Clone ID: cC-zmle189052f09a1
ttttccttaagattaacttagaataaagcctgacgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgccgccaccgccgtagccgccgccgccatcacggcgcccgccaccgccgtagccgccgtctccacggccaccaccgtacccaccgtcgtcgtctccacggccgtcgcgggactgggctctcgtgacggtgaatgtgcggccgtccagctccttgccgttcatgccctcgatggcg

SEQ ID NO: 23732 - DNA, 404 bp, Zea mays
  Clone ID: cC-zmle189052f09d1
ctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgatggccgcggcggctacagcggtggcggcggc

SEQ ID NO: 23733 - DNA, 419 bp, Zea mays
  Clone ID: cC-zmle189052f10a1
ctttctattagttaagcatcttttactttttttttctgtaaagtttcgtgttggggacggagaaaacctcttcgccgatagacgggtccttacaaagcagatcaggaggatttaacacgtcccaatttggccgccaaagttagacaatgggggcttcaggaaatcccgggtctcaggaaactaaaacactaatttcgttcggggactcaaacgcttctttatcccaaaaacaaatgacatgttcgggcgcgatttgtttttgcccagcaatttcatctggttttgcctttgatgatcttcctccatttgtttccgctttatgggcccccttcttttcttctgaaacccttccagctactgataccgccttagccctttctggtgctgtaccattagcatcttttctcaacgccttttta

SEQ ID NO: 23734 - DNA, 372 bp, Zea mays
  Clone ID: cC-zmle189052f10d1
gatcacactagttgcgccggtaggaagttgtacttagactaatagaggaggacacagctaaaagagttgagcatgctattaggaagaaggttgtggagagtctgaattgtgatgaaattaagcgcgaaattcatcgtcggattgaggaaggacgaaaaaggatacatgaggaggtagctatccagatggagaaagaaaaggagtcagccttaaatgaagccaagctgaaagtggaacgagaaaaaaaggagcggaatgagctagagaaaatgcttgaagaataacgaaagaaggctgaagaggcgttgaggaaagaggcgatggtacagcatcagatagagctagagcggtatcaggagctggagaggcttc

SEQ ID NO: 23735 - DNA, 338 bp, Zea mays
  Clone ID: cC-zmle189052f11d1
tagaacggtggggagttgacaccataaacgtataggtccacggcttgcgattgaaagttaagtaggtcattcgcgtgtattaacggacctgattaagctaggggggatctccggccaaatagcctggcaacggccccagtgcacgaaatacactaagttattcagggcgctactagggtatctaagatcgcacaataattcccgcgagagaacgccatgggggaaggcaagatggggaacgcaatcctgagccatacaaacctttgcttaccatgggattgaggagcccaacatcccgcttggcttggacattggggcgtcctggccggccactcccc

SEQ ID NO: 23736 - DNA, 208 bp, Zea mays
  Clone ID: cC-zmle189052f12a1
gagattggaggccttaggggaactagcacccccgatcacattatcatacgatgccattataggcttcatgcgctaatagcagagccctgatagttacgggtccaacaaataaaatacaaaagcgcgacagcgatgaccaggaaagaacgcaaaagaaaacacgagaagccaacacaatctcacatctaatctcgcctctctagtttcc

SEQ ID NO: 23737 - DNA, 234 bp, Zea mays
  Clone ID: cC-zmle189052f12d1
aattctcgggtcgacccacgcgttcgggaaactagagaggcgagattagatgtgagattgtgttggcttctcgagttttcttttgcgttctttcctggtcatcgctgtcgcgcttttgtattttatttgttggacccgtaactatcagggctctgctattagcgcatgaagcctataatggcatcgtatgataatgtgatcgggggtgctagttcccctaaggcctacaatctc

SEQ ID NO: 23738 - DNA, 429 bp, Zea mays
  Clone ID: cC-zmle189052g01a1
aaaacaaaaggagctatgtaaattcagatggtacagcatcatacccaaacgctgttcaatggctttctagtgttacacaatcaaccaaatgtgctgggatacatttatcatgctagttcgacgttcattagctgtacaacaactttggacgcccccttctgtcgcaaaactggaaggctcgcttttgatgcagtccactgttacttacatggagatgccacacaacagaaatttgccaagctttttatgctgcccaagtctcagtattttacagaagaacacacgaagatgtagatcctttaaccatccagcgggtttcaccattcatccaaggccccttcggcataaagcaccagcagcttgtctttcaaggtgaataactcaaggataaatctttgcacagacccacgcgtccgcgcacgcgttcgt

SEQ ID NO: 23739 - DNA, 456 bp, Zea mays
  Clone ID: cC-zmle189052g01d1
cggacgcgtgggcggacgcgtgggtctgtacaaagatttatccttgagttattcaccctgaaagacaagctgctggtgctttctgccgaaggggccttggatgaatggtgaaaaccgctggatggttagaggatctacatcttcttgtgttcttctgtaaaatactgagacttgggcagcataaaaagcttggcaaatttctgttgtgtggcatctccatgtaagtaacagtggactgcatcagaagcgagccttccagttttgcgacagaagggggcgtccgaagttgttgtactgctaatgaacgtcgaactagcatgataaatgtatcccagcacatttggttgattgtgtaacactagaaagccattgaacagcgtttggctatgatgctgtaccatctgaatttacatagctccttttggttttaaaaaacacaaaaaattatattaattt

SEQ ID NO: 23740 - DNA, 480 bp, Zea mays
  Clone ID: cC-zmle189052g02a1
ctcgttcttttttttttgaataatattatgattgcttgctttattccggtccgatgatggtggatgcacatatttctccatcaaaccttggtgctctaatacgatgacatttttccagattatgtgcttacaggattgtttgtgcctagatataattgtttttaccagtcctcatctggcactgcggatgacagcaagtttacatagtcggaaatgacattttcacattatggacctagcactaccaatccactaaagaggctacaccagactccggagccggggccggttgacgtaacaaaccccaggctaccgctgatatatgatctttgccagacaccatttatattccatagcattggagaagttcatacgctatgctggccattctgtcaagaacaccctattgtgatgttaggcctatgtgccaaactgcaatcctagatcagttaacgaggatttgccggacgcgtgggttct

SEQ ID NO: 23741 - DNA, 466 bp, Zea mays
  Clone ID: cC-zmle189052g02d1
cacagcagctccgctcgtcgatcagctctcggctgaccactcatcgccagtgggtgcctgccgaccaggtctcgccgccgccaccgacgcggtagagaggggagggagagggggtaaaaactggcccagatcgagaggtacagcacgaaaaagagaggcacgagagataggggaccggagggcggagacccggggcccaagaccgaggggctcgtgcgcaggaagctgatgaggctcctgtcgctcgtgcccttcggctgccgtgctggacccatcgacgacgcgccggcgtccgtggaccacgccgacgacgcaaggaggctcctgaggaagaaggccaacagggccgcccagatgctgggggctggtgggggtgcgccgcaacagtggcgccccttgcttggcgacatatgcgaggagtgcaagagcagcaccgacaccttcaaggttaaggaagcggggtcct

SEQ ID NO: 23742 - DNA, 433 bp, Zea mays
  Clone ID: cC-zmle189052g03a1
ggtggaagaacaagttatacgctatctgacgcattgccatacatactgtattacatgatcaacgcatacgtgccggatgcatctatgtactgcattacatgagcagagagttactgcctactttccgaagtcactatatggcttctagatgtacaatattgtgggtgatgataccaacagtgtacacagtccgacaacagctaagttatccctatcgtacaactcagttcctctcgtacaactgaaactttatcatttaaatccgataggtgctaggattcaaaatcctgtttcgcatttgcatggatgcaaaaatcacatctgatttgacgaatctcttacgcttttttacgcgttggagaatcgtgtatctcccgaaagctatacagtccagtgtaatagacaatggcatggtgacctggtgtcttcattc

SEQ ID NO: 23743 - DNA, 241 bp, Zea mays
  Clone ID: cC-zmle189052g04a1
ttttgaggttcaagaaacttggaactctatatagaaacaagtttcactctaatacgatggtttagggttcttcatcacattgtcatagccacatctcaaaaactcaaaacttgagtacttgtaataacaaaagcctacagacataacgtaagataagtcttggacagcataagcgaatttgctaatggctgggtagcgagggtctcagtcgaacaggctgaaacccatgtcgtcatcagac

SEQ ID NO: 23744 - DNA, 563 bp, Zea mays
  Clone ID: cC-zmle189052g04d1
cggacgcgtgggcggacgcgtgggagcgcctccaccttcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagcgttgaggatctaatcctctccgtgggatctggtggtggcgctgctccagttgctgcttccgccccagctgggggtgctgcagctgctgctgcccctgctgcagaggagaagaaggaagagcccaaggaggagtctgatgacgacatgggcttcagcctgttcgactgagaccctcgctacccagccattagcaaattcgcttatgctgtccaagacttatcttacgttatgtctgtaggcttttgttattacaagtactcaagtattgagtttttgagatgtggctatgacaatgtgatg

SEQ ID NO: 23745 - DNA, 251 bp, Zea mays
  Clone ID: cC-zmle189052g05a1
cggacgcgtgggtgcttcaatgaggtgccctgggtgccagggctcaggtatgaaagtcaccattcgtcagctggggccttccatgatacagcagatgcagcagccttgcaacgagtgcaaggggactggggagagcatcaacgagaaggaccgctgcccagggtgcaagggtgagaaggtcgttcaggagaagaaggttctggaggtcaaggtgagaagggaatgcaacacagtcagaagatcaccttccc

SEQ ID NO: 23746 - DNA, 458 bp, Zea mays
  Clone ID: cC-zmle189052g05d1
aaaataaaatgcaccaatgtgcaacggcaacgtccattgagacatgatgttatgcctagccttacacaaacattaagtccacctacaaattaaaatcgtcactctagcaaatctcacaagcaaaagttataaggtagccagctattgcctgggtagcatttttcagttgcagcaaaaaaggatacattcccccgcttgcagagccaggggcgcatcagcttcctactttgtagctcagcgacagcaaaaccatagaaccatacagtccacaggcgcactcgcataattgaagagcaaccaaagtgccttgaatcccattttggtagtctgcttactgttgagcgcactgcactctttgggctccgccaggcatttcgtcgttctcctcgtacgcctcctgagcagcatgagcctgctttctgcgcatctttttctcgatgttgttcacatcatgccat

SEQ ID NO: 23747 - DNA, 235 bp, Zea mays
  Clone ID: cC-zmle189052g06a1
gaatccacaaatagattcaagctaccataaatatattcatactgccctataacaaattacaagatcagctatggcaatctccagtaagcatctgttagtaggacgggggtgcgccattacatgtcactgcaacattagactactcacagctacacaggtcgcattggcgtacgtcgtacaagtaggtaaccttgcatcttcaacgacaggctcgcatgcctcaagatcatccaac

SEQ ID NO: 23748 - DNA, 235 bp, Zea mays
  Clone ID: cC-zmle189052g06d1
gttggatgatcttgaggcatgcgagcctgtcgttgaagatgcaaggttacctacttgtacgacgtacgccaatgcgacctgtgtagctgtgagtagtctaatgttgcagtgacatgtaatggcgcacccccgtcctactaacagatgcttactggagattgccatagctgatcttgtaatttgttatagggcagtatgaatatatttatggtagcttgaatctatttgtggattc

SEQ ID NO: 23749 - DNA, 463 bp, Zea mays
  Clone ID: cC-zmle189052g07a1
ttttaaatctaataaagagtagatatcttattattgttggcacgccgcacgcacgagtataatgcaataaattgtatcttttattgaaaaatacatgaatatattactaatatatatttttttaaaagaaatgatgaccggcacttcattcgtcgcgtaacgtcacccgttcccaatccccacgtaccgcgtcaaatgcgtttccactcgtccaccaatccggtcagtgtggcctccgactcaccggcctcacgcagcgcgtccttggactgccgcatggccgccagtgtgcgcttccggagcatcctcccgccatcggactccaagagccatcgcaccttggcagcaacctgctcggccgccacgatgccctcgtcgctgtcgtacccttccacagtcacggtcagctgcatctccttctccaggaacacccggttgagccgctgctccgagtatagcggcc

SEQ ID NO: 23750 - DNA, 463 bp, Zea mays
  Clone ID: cC-zmle189052g07d1
ggccgctctacgcggagcagcggctcaaccgggtgttcctggagaaggagatgcagctggccgtggccgtggaagggtacgacagcgacgagggcatcgtggcggccgaggaggttgctgccaaggtgcgatggctcttggagtccgatggcgggaggatgctccggaagcgcacgctggcggccatgcggcaggccaaggacgcgctgtgtgagggcggtgagtcggaggccacactgaccggattggtggacgagtggaaacgcatttgacgcggtacgtggggattgggaacgggtgacgttacgcgacggatgaagtgccggtcatcatttcttttaaaaaaatatatattagtaatatattcatgtaattttcaataaaagatacaatttattgcattatactcgtgcgtgcggcgtgcccacaataataagatatctactctctattagatctaaaa

SEQ ID NO: 23751 - DNA, 531 bp, Zea mays
  Clone ID: cC-zmle189052g08a1
ttttatgcaacaagtagtactatatatgctatagatgaataagatgtaggacacccagacctcactgttttacactcgcaataccagaagtagctactggatgaagataaaaggttaaaagccaggtttgagaaacaaaatgaaggaagatcaaggaaggtggtagcttcagatgcctagcgtgttcgatggaatagggttgcggcacctgttctgccaagctagactgactgaatgattaccgagttggccacgccggcttcctcgatggtcttggccgtgtcttcaagcggctttggggggaacccggcctgcagcgtgtaatcactggctcctggccttgtcgcgtcgataaatgcccgcacgtcactaatcctgtggcttgtgttgaaacgggcaaccaagcgactgccgtctgcgaacctgatttgagggaagttgatggcaaagaatcgtccactgtgattgtccgagaagcagttgcactactggaagcagcagcagcagcagcagcattggaagtattattat

SEQ ID NO: 23752 - DNA, 396 bp, Zea mays
  Clone ID: cC-zmle189052g08d1
aaggattctgactgcccaactgagcttgtgccggctgatgagaaatctatagtgaatgtgaatcttgtccggacggaagaagaatttactgagccagtcaagcgtgctgctccttttgaaggggaacgaagaaacctcatggaaccttctgataataatacttccaatgctgctgctgctgctgctgcttccagtagtgcaactgcttctcggacaatcacagtggacgattctttgccatcaacctccctccaaatcaggttcgcagacggcagtcgcttggttgcccgtttcaacacaagccacaggattagtgacgtgcgggcatttatcgacgcgacaaggccaggagccagtgattacacgctgcaagccgggttccccccaaagccgctt

SEQ ID NO: 23753 - DNA, 150 bp, Zea mays
  Clone ID: cC-zmle189052g09a1
ttttagattcattaaaaccaaaactttattatgaccatgcatatattattggtcataccacacatgataatgtgtgtcgtcttactgcattattacatatatagatagagagagatggatagaggagatttcccaaatcggacgcgtggg

SEQ ID NO: 23754 - DNA, 150 bp, Zea mays
  Clone ID: cC-zmle189052g09d1
cccacgcgtccgatttgggaaatctcctctatccatctctctctatctatatatgtaataatgcagtaagacgacacacattatcatgtgtggtatgaccaataatatatgcatggtcataataaagttttggttttaatgaatctaaaa

SEQ ID NO: 23755 - DNA, 399 bp, Zea mays
  Clone ID: cC-zmle189052g10a1
gcgcatcaatggtactgcttttccattgagcaattttaaacagctatcaagctccaattattaacatagaacgctcaacgaagccgtttacataggcaaggaaactcaaatccagtaaacaacaaagaacttgttcatatctacagacaaacaaacatagagaatgggcttggaaatctggatactacatttttgcccccgagtgtaacagaaaactgaggggtctagggggtacacttccacttggatgttggcacgcagttcaggtagtggcaccaatggcaggcatcggtcccgttcttccctttgaaaagcatcacttgtgaaatcacaaacccaacttacagcaagacgagtgccacaacccacaaaatatactggtatgctttgtacttggga

SEQ ID NO: 23756 - DNA, 524 bp, Zea mays
  Clone ID: cC-zmle189052g10d1
tgggtcgactccacgcgtccgcccacgcgtccgacggaacagctacatctccgttggtgcttctggagctctatttggcctgctgggatccatgctttctgaactactcatgaactggactatatactccaacaaggcagcagctataataacactgttgtttattattgcactcaatttggctattgggatactacctcacgttgacaactttgctcacattggtggattcgcgacgggtttcctcttgggttttgttctgttggcaaggcctcaatttagctggatggaaagtcatgagttgccacacactaaccaacctcccaagtacaaagcataccagtatattttgtgggttgtggcactcgtcttgctgttagttgggtttgtgatctcactagtgatgcttttcaaagggaagaacgggaacgatggctgccattggtgccactacctgaactgcgtgccaacatccaaatggaagtgtaacacctagacacctcagttttctgttacactcgggg

SEQ ID NO: 23757 - DNA, 412 bp, Zea mays
  Clone ID: cC-zmle189052g11a1
ttttaatcaaattccaaggaatgataatgcatcaattgtttattcgcacaactcctatcacctaatgcagcaggtaagtgataaaagtttttaaaacagaaggaggtggcaaatgcaccggggcttgtctgagataacactaagtcagtgttgttagatgatgtccgcttggggagcatctctcatcctggtacttgaccagatcatccaagcttcaggttcgttcaccagcatcattttgggatcaactcggctcttgtcgtccgcatcacgtgatcaattaacgaaccgcggtgaacagaacgacaacgaacttcagttcaagcacttcatagaacacctaatgagcgttgaacttaaccttctcctccacctaattctccagggattttactccatatcgcacacatca

SEQ ID NO: 23758 - DNA, 443 bp, Zea mays
  Clone ID: cC-zmle189052g11d1
ccggaattcttgggtcgacccatcgcgtccgtgatgtgtgcgatatggagtaaaatccctggagaattaggtggtggagaaggttaagttcaacgctccttaggtgttctatgaagtgcttgaactgaagttcgttgtcgttctgttcaccgcggttcgttaattgatcacgtgatgcggacgacatgagccgagttgatcccaaaatgatgctggtgaacgaacctgaagcttggatgatctggtcaagtaccaggatgagagatgctccccaagcggacatcatctaacaacactgacttagtgttatctcagacaagccccggtgcatttgccacctccttctgttttaaaaacttttatcacttacctgctgcattaggtgataggagttgtgcgaataaacaattgatgcattatcattccttggaatttgattaaaa

SEQ ID NO: 23759 - DNA, 415 bp, Zea mays
  unsure at all n locations
  Clone ID: cC-zmle189052g12d1
ggaaaacttttttatttaatgaatttttaataaataataattctaattaatagtatattgatatagaaaaagggttctaaatgtttttagtatctgtgaagtgaatatataataagatatttataagaactattttattaggtaccttttgtatcaaggctaaccaatccttgcttatttataaattattcgcccgaaatgaaaagattgataatgatatcatttatttgacgtgaaaaaaatatattatataattatagttgttatatgctattcattgnttttatatggggttgtggaataattgaatgtaatgaataattaaaattctattgagggaacgctattactaataatgatttgaatgaaataaactgatggattagctatggggaatgcctataattttttaatc

SEQ ID NO: 23760 - DNA, 537 bp, Zea mays
  Clone ID: cC-zmle189052h01a1
acagatcatcaagcgcaaataactatgaacacatcatattacatttcccagtcgcgagtcttgttagaagaacctaacaagcaccaagcttgcatccagttcatccagttgagaggtaacaaatatcaagctggattaaaccctgatgaaatggcgatgttcatatttacagatgcagtaaatggaaaatagaaacagataattaagccaatgaagtaactaacattaagcagaaacatagggatggcatgacaaatagacataagttagcacctaagcacatagagcataaatatttcaggaacgacaacaagcagccgtcataactccttgatctaggtctagttggggtcaaagacatatcatatcctttacaacaaaattagacacacccaaccatatgtccataacactgtaattccaggcaactggaagacttaggtcgccctttttgagcaacaccttaccaataccggacacaatccaaaaccaccagcacatcaatatgcaccctgcagagcatcaagcaccaacccc

SEQ ID NO: 23761 - DNA, 572 bp, Zea mays
  Clone ID: cC-zmle189052h02a1
ataaagtagccagcaaattcatggcgaggagtaccatccatttgcacactcaaaagatgcaacacatccaaggagaaaaagatgatccagacaatgagaactcaagagttcaccctagaacaacttaaaacacgcaaggcacaactcctgctcaagttcaagactcatgatcctttctactcaatcagatcatcattgtcatcaggaagaggttgtgcagctgctgcagcaagctcagcttcatgctgatgctgcatagccatgtcgatggtaacttccggaggcttaagagcaacagccttaacaaagtgaaggttcggatcaccagccagcttccttgcgaggtacaggaaagggttcttaaagttgtagttgctcttggcagaaatttcatagtactgcagattcttctttctgtggaaagtaacctgcttggctttgacctgcctgttcttcacatcaaccttattaccgcataggacaatggggatgttttcacagaccctgcacaggtccctatgccacgtaaggacattcttgtaagtaagccttgggttacatcaaacatgatg

SEQ ID NO: 23762 - DNA, 551 bp, Zea mays
  Clone ID: cC-zmle189052h02d1
ttcttgggttgacccacgcgtccgtagggttttgctgctctccgaccccgagctccgaaggccgcagtatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgacgaacatgcaggtcaaagccaagcaggttacttttcacaggaagaagaatctgcagtactatg

SEQ ID NO: 23763 - DNA, 553 bp, Zea mays
  unsure at all n locations
  Clone ID: cC-zmle189052h03a1
ttttatcagtttccaatcatcttttttccttatatattattcctttccatttcaatggttcattcaggtcattgctcacactgccacccatggtgatgggtgacactacgttactcatcgccgctaaatgagtaaactagcgagctaggtagctagccagcggctccattacattattactacagtacatagtttcctcagtagtagacaccgccggcagctgcgttgcaagggcagggacctggctgctgcagctgcaggccgcacatcgccgtcagctgctgcgctacctgggccgccatcagcgccgcgagctcgccctgcggctgctgctgcatgaaggactgcaggaccacaccgtatgtcgcctggtaccggtgcagcggctccacctgcctgatctggtggcagcactgctgctgcagcgcctggcactgtggcaaagccgtatggccgtcgcgccgggctgcactggtgcctcacgaactcgacgcactggcccaggaacgggctgccgactctgccgacgccgcangatccgaactgctggcac

SEQ ID NO: 23764 - DNA, 507 bp, Zea mays
  Clone ID: cC-zmle189052h03d1
ctggacgacaacctagcaattagctcatcgactccagattggagaactcgacaccatgaaggtgctgatcgctgcccttgctctcctggcgctcgctgcgagcgccgccttcagtacaagcggcggatgtggctgccagacaccaccgtttcatctaccgcctccgttctatatgccgcctccgttctatctgccgacgcaacagcagccgcagtcatggcaataccccactcaaccaccgcagctaagcccgtgccagcagatcggatcctgcggcgtcggcagcgtcggcagcccgaccctgggccagtgcgttgagttcctgatgcaccagtgcagaccgggggcgacgccctacggttcgccacagtgccaggcgcttgagcagcagtgctgccaccagatcaggcaggtggagccgctgcaccggtaccaagcgacatacggtgcggacctgcagtacttcctgcagcagcagccgcatggcgagctcgcggtgcttatggc

SEQ ID NO: 23765 - DNA, 590 bp, Zea mays
  Clone ID: cC-zmle189052h04a1
ttttgacgataacaaacacacgacttgctgcaaagagtacaaggaaatactcgctaattcagtcatggtttgctgtttcctatacacgatgtgccgccgtcaacattgaactccctcagtattgctcttgcacaatgagcaaaaagaatagcaccaaagatcttatactaaaaatgaacagcaaggaactgcacttttgcaatgccaagctgaatatagggaaaaaaactcatcaaaccataatgaacagtgtgaaatattctacgttatatcttggtactctgcaacataactcaggtttcgtgctagcgtccttcagacatcgtggatgctgttatggcaacgttccgcagaaagcatttcatcttattctcctcttggaattggactgagcactccctcgtcacgtcaggggtgaatttgtgtcatcatggatgttgcaggtcaggcgtgattctgtttattttcatgatgaacaaagcccatgaagtctgttgtccaaatgcccgaaaaatgagtgtttggtgcatttcatgccctgttaattagtgaatgttgcattccgtcatgaacttctcttcactggtcat

SEQ ID NO: 23766 - DNA, 583 bp, Zea mays
  Clone ID: cC-zmle189052h04d1
gatggagcacacaattgtgagagccaagtctagtgaagtaggatgctccaatgttgaacggaaacttaggcagctacttgatataactgaagatgaagcttatttccatacaaggcagagtgcatttctatatcatcttggagtgcagactatgccgaaaactcaccattgcttgaacatgagattgacagtagaatatttcaagtctggatcaaatcatgtggatcagttaaatgaccagaagcttgaaagtcctgccttacatcactatgtaatgttttccaggaatgtacttgcagcttccaccactatcaattcaacggttatgaactcccaggattcggaccacatcgttttccatgtattcactgatgcacaaaacttttatgcgatgaagtattggttcgataaaaattcatacttggagtcgactgtacgcgtaactaacattgaggacaaccagaagctctctaaggatgtagattcccttgagatgcaacaattatggcctacagaggaatatcgtgtcacgattcgtaatcattctgaacctttccagaggcagatgaaaactaagtacata

SEQ ID NO: 23767 - DNA, 203 bp, Zea mays
  Clone ID: cC-zmle189052h05a1
ttttaagtctggttgcgaggtctaaatagtgagtatgaatcatagttcctttttttttttgatccactctatgtatttcgtgttccagatactagaataaataatatctgacgaattagaatcatcttgatagagataacaggccccttctatgtattatcaataggatcaattctaacaagtcacacactcatattccagag

SEQ ID NO: 23768 - DNA, 203 bp, Zea mays
  Clone ID: cC-zmle189052h05d1
ctctggaatatgagtgtgtgacttgttagaattgatcctattgataatacatagaaggggcctgttatctctatcaagatgattctaattcgtcagatattatttattctagtatctggaacacgaaatacatagagtggatcaaaaaaaaaaaggaactatgattcatactcactatttagacctcgcaaccagacttaaaa

SEQ ID NO: 23769 - DNA, 467 bp, Zea mays
  Clone ID: cC-zmle189052h07a1
tgcacgcgtgcggagctctggatactctagagcggtcgccctttgtacttgttttttgttttttttttgagagaaacatggaattacgttagttttgtcgtatacaatgtgtatactatgtttattaagtgaacacattagttgttgtgctatcaaagctccccatcggtatctatggcatttaccacggggggttattggcagccgtgagtctagagcgatacacactcactatcatagatagaaacgagcagaaatacattacacattgaaggcaaaagatagagagagactaccctgatcttttccccttccgacagaggggtcttgtgttcccttctcattcgacgagcgcggtgaagcagttccccgtgcgcgccagcgagcgccgggacgcccccggggctagggcagttacgccgggggtggaggcgtcgctcgtacggctggtcagatggaccgtgcct

SEQ ID NO: 23770 - DNA, 345 bp, Zea mays
  Clone ID: cC-zmle189052h07d1
gcgggatggaaagcgtcgcaaaagaatcaaggcagctggtattgactatgagtgtccagctcttatagggagcattcaaccatcagcgaaaaagatcaagttcgatgaggcatagtattttattctaatgggctgttggatccttagtagacgaggcggtggaatggttgagcaatatattcaccttttgaggagacggacgacaactatgtatttcacttttgaatttctctatgttttatgaatgacaccgacacagatgttacaacttaagtttgaaaatgcaatgggcgatgtgttcttaatttgcccttggaaggtttcatataacaatgtgttcttaat

SEQ ID NO: 23771 - DNA, 297 bp, Zea mays
  Clone ID: cC-zmle189052h08a1
ccgatcacggttttttcatatttgtaagtactcaaactgtagtttattgatccaacaatcctcagtttcgtccctagcagtagatcagaattggaagcacgaaaggggacgctgaggacgtggccaaggttttcacataattgaaaaacacaccacctgggttatttaaggtaataaggtctgcgagtagcagggcaccagttttgcaggttgaccctggccatgtaaatatatgcaaggatgtcaatagtcattggcagtttgccacacaaccatttccgaactacatagcttact

SEQ ID NO: 23772 - DNA, 331 bp, Zea mays
  unsure at all n locations
  Clone ID: cC-zmle189052h08d1
ggaattnttgggtcgacccacgcgtacgcgtgggcggacacgtgggatcggaccccaccacgagttgtcattttcaagccggtggattgcctacacggggacgcgccccgataacacacccattcatgtgtggtacaaccatgcactaggacccaataatcgctcatagcctactacaaggcacgaattggatggggactcgaggtctactacaactaatggcgcctggaccataacgtgcgcctgagtaaggtgaataacgaatgatgataacatgcattaatctgcgatggtgcagctgccttaattaacacgcgtgaaacactgttac

SEQ ID NO: 23773 - DNA, 193 bp, Zea mays
  Clone ID: cC-zmle189052h09a1
ttttaccaaatagcgtttattcaaacatgttctgataaagaagcaagccatcgatgttcgatggagcctcgtagtacaaggttcgacacgacggtaacaagcatacacgcagggaggggcctatatgtgtaataggaggaacgcgcaggcggcgtactaggcctgcttgcagtacacagcccggacgcgtggg

SEQ ID NO: 23774 - DNA, 315 bp, Zea mays
  Clone ID: cC-zmle189052h09d1
acgaccacgcgtacgcccacgcgtacgcgctggatcctgacccggcgcgactgccatcgtccggtccgttcatctatctacacgtatagacccgtccctggccgcatcatcggctgcgcctagtccaaccttgtactacgaggctccataagacctcgatcgctgggtgcttgccatgcgacaggtgccagtaccactccatggggctgaacaacaaagcaggggcgagcaatatggggatcacccttgcctgcacgggcctgctagaggtggagggcgatatcatggacaccgaatgcattgtcatgtgcctgc

SEQ ID NO: 23775 - DNA, 427 bp, Zea mays
  Clone ID: cC-zmle189052h10a1
gacaatatattttatcattggatcaatgttgcatgaacataaaaaatgtataacacgtagatcacttatactggcagaggctgcacccaggctccatacaggactgctcactaatcattattgcgcgcccgatatcttctctcagatgaaggtgggcaagatatgcaaaacactgcggcttccctccatggaccttcttccaatttcctatttttcgggtcttgtaacttcagcaagcaggtggatacaacaatagctgtattggacggaactgatgatgtgccatgtgcctacttgttagccatagatgagtccataacactgcacgacttgtccatgaattttttcattgaatgtaactcccgtccaaatggctctaggaacttcatatctatatcaaggggccaaaccttgagccccatgagcc

SEQ ID NO: 23776 - DNA, 527 bp, Zea mays
  Clone ID: cC-zmle189052h10d1
gcgtccgatccgaatccgataggggaggggctggccatggaggcgttcgctgaagccgccgggccggagtgcatcgtgcccggacagcaagcgcctctaaggctcatggggctcaaggtttggccccttgatatagatatgaagttcctagagccatttggacgggagttacattcaatgaaaaaattcatggacaagtcgtgcagtgttatggactcatctatggctaacaagtaggcacatggcacatcatcagttccgcccaatacagctattgttgtatccacctgcttgctgaagttacaagacccgaaatataggaaattggaagaaggtccatggagggaagccgcagtgttttgcatatcttgcccaccttcatctgagagaagatatcgggcgcgcaataatgattagtgagcagtcctgtatggagcctgtgtgcagcctctgccagtataagggatctacgtgttatacattttgtatgttcatgcaacattgatccaatgataaaatatattgcc

SEQ ID NO: 23777 - DNA, 321 bp, Zea mays
  Clone ID: cC-zmle189052h12a1
acgggcccaccaaaaattttttccccggggggcgggcccaaatttattggcggttccccggttcaaaaggggggggcccccttggggcctgtggtaaaaaaccaatttaaaggggtttccctggggcccccccgtcaaaaaaaacccccggggtttgttgcccaaccaaaaaaagggggcgggggcgagcccccacaaatatggagtctttaaaagggccccttggggcccaaaaagccccggttagggccttgatttttttgaagagaaaaaaaaaaaccccctttgggggaaaaaaaaaacccccccccccctccgggg

SEQ ID NO: 23778 - DNA, 267 bp, Zea mays
  Clone ID: cC-zmle189052h12d1
ctctgtatttcaggctttggttgagggcaccggatatcatggctgtgagtccaggaccggtggctgcatcaccccactctgttaagcggcgtggaattttgcatacgcaaggaccagctgtctcgtctacattctagccaacgacgttccacctgttccaacacaccacacggaaatccactacattacacaagctctgttgcttggagcccgcctggtgcgtctcaggggccggcatagcgggactatgtcgataaaaccctcacc

SEQ ID NO: 23779 - DNA, 293 bp, Zea mays
  Clone ID: cC-zmle189053a01a1
gcaagaatgagaatgctcggttacatatatatacttatacggacaggtacagctatacacgtggcgtacacaaatcaggctcctacgcacgctgcagcgggtgagcgatactacgcacgtcggcacgagtacaaaaaagagcgcgagcgcgacgcatggtgcaagtgcaagaacaagaacaaaggagaggtggagcggagcgcggcggtgacgggccggccgggggcgctagccagtcgctaggcaggtcgcgttgcggctagcctagcactagcagcaaatctccatggaga

SEQ ID NO: 23780 - DNA, 192 bp, Zea mays
  unsure at all n locations
  Clone ID: cC-zmle189053a01d1
cacgtggagcatatgatcgaggaactgctggactccgatttctttttggagattngctgctagtgctagggtagcggttacgctacctgcctagcgactggctancgcccccggccggcccgtcaccgtcgcgctccgctccacctctcctctgttcttgttcttgcacttgcaccatgcgtcgcgctcgcg

SEQ ID NO: 23781 - DNA, 255 bp, Zea mays
  unsure at all n locations
  Clone ID: cC-zmle189053a02d1
cgggtgcacaagccattcaggcatgcttcctgtgtccactgatatgattttcctgtaagggnaagaggatttatggtgngtggatccttatgttgcttcctgcgtccagctattgtgcactgtgtaggtatagccatgctgtggcactgtgcttcgtcttggacaacacaaggtgtggcatgttctgtattttatgtctgtataatgcatccaactacatctagtgttctgtgagcttaaaaaatcaaactaaaa

SEQ ID NO: 23782 - DNA, 346 bp, Zea mays
  Clone ID: cC-zmle189053a05d1
tttctatatccatcctctcttgtttaaaaaaattttattttctttaaaacaaaaacaaaaaaaaaagaaaagtttaattttttataaactaacccctttctctttctttttttcccttattttcttccttcttatccctctttatatttcttctcatcttccttctctccttctttttactttcctttttctttttattctttttctctttcatactttcttttctttctccttccattttccttcttcctcttttacttcttctcttctttcttcttttctatttctcatattatttttttttctctttttccttctttttctatttcttcttactactttccct

SEQ ID NO: 23783 - DNA, 298 bp, Zea mays
  Clone ID: cC-zmle189053a06a1
aaaaaaagaaaaaagggtttaaaaaaaaaaccacccaaaccccgcgtaaaacaggggaacaccactttttgccccccgccccggggggtttttgccctccattggaggagaactttcccaaaaaggaacccccttgaaagaaaaaaaacccccgggaaccacaccaaaagggtccctataattccccggccccggggagttcccccctaaattacggaccggaaccctgggggcgcccaattttttaaatatgggggccttttaaaactggggggaaaaaagggcaaaaccttccccg

SEQ ID NO: 23784 - DNA, 362 bp, Zea mays
  Clone ID: cC-zmle189053a06d1
ccacccgtgcgaggatatataagcacgattctgttgtagttcccttgttttttttctcatcgcatgtagtccctgtctcggatagctcctcctacatcaacgccaaaaagccacacggcacgaggccaaaagctgttgttaccttgcttctaccgctgtttacttggttttaatttgaaacagattttaccttttcaaaaaaaaaaaaaaataaaaacaaaataaaaaaaaaaaaaaaaaaaaataaatataaaaacaaaaatactaaaaaaaattattaataaattaaaatgggcggcctctctcaaaggttcaatgttttctcaagcgtttataaaaacttatattttttttatatggat

SEQ ID NO: 23785 - DNA, 563 bp, Zea mays
  Clone ID: cC-zmle189053a07a1
gtatatccatcttccactgaacatacagaccctggctctacaaagagggaggagggggtgcaggggggtaaacatacaggacaggcttgaggagaacaagatgcaccggaaacgtgcacactacatacacatcgttcctcaacgtaccgaacaaccaaccattcgtggcaacatatggcgcggtcacggaccagcgaaactgctgcgagcacgtccgtctccagcagcaaacaatctcgccaacgaacggctgaccgaccgacccaccggtagcagaagaacgtttcttgctaacttcgtcaccagcagtagtagtagtagagcagtaaagtgagtagagtacccgacggtaagttatccttcaccttaacctgaagctacgacctgcaccatccgtgaatctcgtgcactgcaccttcttgtcgggcaacattcatcacatctccagcttcgctgttgtcgctttttggcccagccccagccaaggtttttccaccccagctccagccgccttgctggacgcctcgacgccaacaacaagactgttgacttgttgtatggcg

SEQ ID NO: 23786 - DNA, 586 bp, Zea mays
  Clone ID: cC-zmle189053a07d1
gaagataagggcgccgtgcgcggccatggctggaagtgcgccggcgtcggttatggacaagaccagctttgccaccaggtgcagcctgctgagccagtacgtcaaggagaagaagggcggcctgctgcagggccttggtgccctcgccatggcgccggcagctggtaagggcaacagttctttcgtcgtgcgatccgctcctgtccgttaagtgccacactgccatgcacgaataagctagcttccccgtagacactaacactaccgtcaatgaacaataccgttctgcttatcgcacatcgatcgcgctcttcccatcgtcgcaggagaaggagctttccggccgccgaccaccatgaacttgctgtcagctctcgacgacgcgccggccgaggagcgcatcgagaaggccaccgccggggagccaaaacaccaggacaaatgcaccggcggaaattcaagggaggaagcatccggagaggaggaggaggaggcgcatcaactgaccattctctacggcggcagagtggtcgtcttcacatgttcccctcgccaggtcgaagactgctgaaatcatgagccctgc

SEQ ID NO: 23787 - DNA, 504 bp, Zea mays
  Clone ID: cC-zmle189053a08d1
ggaggaaaaaaatctaaccctagcatccgttgcgctagggttctgtggctgcgatggcggcggcggcgaggcagcgggggacggtgaattggttcaacgacaccaagggcttcgggttcatctcccccgaggacggcagcgaagatctcttcgtgcaccagtccgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaagccgaggaggcggcggcggcggcagcggctacggctcccgtggcggtggcggatctggcggccgcggtcgcaactacggtggtagctggggcggcgggcggagatccggcggcggacccggcgcgtgctacaagtgcggcgagcccggtcacatggctagggactgtcctagcgcccacggtggaagcgggtattgcggatgc

SEQ ID NO: 23788 - DNA, 308 bp, Zea mays
  Clone ID: cC-zmle189053a09d1
ttgaccacgcctcccggggaggaaaaaaatctaaccctagcatccgttgcgctagggttctgtggttgttatggcggcggcggccaggcagcggggggcggttaattggttcaacgacaccaagggcttctggttcatcttccccgaggacggcagtgaagatctcttcatgcaccaatcgtcgatcaattcggtgggcttacgctcgctcgcggtgggcgaggaggtgcacttctccgtctcggatggtgacgacggccgcacttatgtcgtcgacgtgaccggcctcgacggatccttcgtcaagg

SEQ ID NO: 23789 - DNA, 311 bp, Zea mays
  unsure at all n locations
  Clone ID: cC-zmle189053a10a1
tttttntttttttttttttttttttttttttttttttggggttgggttttttttttttttcgttttttttttttttttttttttttaaaagaaaaaagggcccctttatccttgccaacccccaatcaaaaaaccaacgtttttttaaaaaaaaaaaccaaaaaaaaatgggggtttacccccccccccttggaaaaaaaaaccaacgtaaccctggggaaaaaaaaaatccaactaaaaaaactgggttaacaccgggggcttggggggggaacccccgggggaaacttaaaaaaagaaaacggggcccc

SEQ ID NO: 23790 - DNA, 416 bp, Zea mays
  Clone ID: cC-zmle189053a10d1
gacccacgcctccgcgacctcaactggttcatggacaacttccgcctggacaccatcgtcgtgcttatgctcaaggacaaccgccgatgggcggccacgttcacctacttcaacgtcaccgccgggatccacaccaacagcctgccgtgatcaaccagttatttcagttcgatttttttttccctgaggttgacgttggctgattgtgccaaggtggcgtgcgtaagccacattcttttcttgtatttattatattacatatcgttagtcttctgattggtcatcgtcaacgatcaacgtgccatactgacatgaaaaataaaaaatataaataaaaaaataaaataaattaaaaaaaaactaataaaaaaaaagaaataaataaataaaaaaatataataaataaaaataaaggg

SEQ ID NO: 23791 - DNA, 512 bp, Zea mays
  unsure at all n locations
  Clone ID: cC-zmle189053a11a1
ttttatgtataattcagnaattgtacaataccgacagggaactggcgtcccattataaatcctttcagtaatgataacaaaagtttcaacaaatgctcgacacaaagttttaacagcaacatattatagcactctgcagccgggatccatgtggctaaacatcataacataaagttctcggcagtaagaggcagcatcaataattcctccacaaacttctaacttcagaaatataaagtaacacttaggccagcattcggccgttctccaaatcaaaaacttattcttcctcctcagcctcctcgagccatttgacaaacggctccagagctttcacgaaagattgcctgcccttctggtttgaacctttacggaaccaaagcaggacagtatcttcagctaggacatcttggtcatacagtgttcttatgatttcaggaaacagcttcatcagcttagcattctcatagcactgtgtctggactttgtatataagttccagttcgagtctg

SEQ ID NO: 23792 - DNA, 491 bp, Zea mays
  Clone ID: cC-zmle189053a11d1
ggaattccctggtcgacccacgcctccgcaaggagtacctgaaggaaaacaccttggatgatttgattgcgtctttgtagaaaggaaaaatggaggacaatctgggggacttttttccatcagctaagagatcctctgaggctttatctgagcatttcatcaaagaaggtctgactagccttgttgagtacaatgaaaagaagatgtttgaagttaaacttaaagagataaagtcaacactgaccactatgatcaatgatgaggctgcaatacctgaagcgattgagactgtcaaacagcaagtcaaggatgctaaatttcctgatctagaggtcattcgcatgttgtgggatgtgctcatggaggctgttcagtggtctgggaagaaccagcaacagaattctaatgcagcccttccgcaggtagaaagcctgggctgaccttttcaaatgcttcttgcaccagtggcaagactcgtaccggaacttata

SEQ ID NO: 23793 - DNA, 83 bp, Zea mays
  Clone ID: cC-zmle189053a12a1
gattgaaagaacaggaactcaaccaacggaaggcacaacaagctgcagccgcggcaggcatggggcaccgcgcgcactgacac

SEQ ID NO: 23794 - DNA, 88 bp, Zea mays
  unsure at all n locations
  Clone ID: cC-zmle189053a12d1
ccggtgtcaagtgcgcgcggtgctcccatgcactgccgttggctgcagtcttttngtangtcttgtagttgagttgagattcctagtt

SEQ ID NO: 23795 - DNA, 429 bp, Zea mays
  unsure at all n locations
  Clone ID: cC-zmle189053b02a1
ttttggtattttattgctcatgctgcacagntcatgtttcatgaatgtatagctacaaaaaaaaaaggttacacctgcatagttgctgcagctaactgtacaatttacataacccctgaagtgagggaagggcgaagcaactttccaagatctttggggttgctatgtggagttgtccttgaagccgctggtgtggaggtactatcagaattccttgcctctgacttttcgtttgaataagtcgacagtattgtgacccagacaagctccacacagtcgacccatagaagtctttgctcaacaggaaccacaccatatgtaactaagtgcgcaaaaggccacaacttccatccagcagtaagcatgggccagaatgtggacttgagctcgttgtagatagtggttggtgattccaaccgaaggaaaccc

SEQ ID NO: 23796 - DNA, 541 bp, Zea mays
  Clone ID: cC-zmle189053b02d1
gggtcgacccacgcgtgcgcccacgcgttcgcccacgcgttcgcggacgcgtggtttgactttcttcagagcagtgcgcgtgtgggggggtggggatccttatgagcgcgcaacgatggcagcggcggccgtggcgactgtggccaccccatcccccgtctacaggcggctgttcccctccgccggcccgtctcttctccggatcccaaggccgaccaagcggttccggcgcgccctgctgttctccgctgcgggggatgaagcggacgtgctgcctggcccgggggccgagggggaggccgtggtgcccgcgatgctggatgagcagccggacgatcagctgggcggaagccagcttgacatcagagggctcgtctttcaaggcgacgtgggcggtggcttcacccgctgcggagcgggctccagagtctccggctgtggcggcggcaacaagatgctggaccggggcattaacacggtcatcgtgcttggggtcagcacctacgctttaaccaaactggttaccgtcgaccagaactac

SEQ ID NO: 23797 - DNA, 531 bp, Zea mays
  Clone ID: cC-zmle189053b03d1
cccacgcgtccgcacagcaatccacacaagcactttgtcttcttacgggcgctgcgcacagacacacggggcgtgtgcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagcttctgtacgaattacgacaataagctcgtgacctgaataaaacttctt

SEQ ID NO: 23798 - DNA, 139 bp, Zea mays
  Clone ID: cC-zmle189053b05d1
ggtcgacccacccgtccgcggacgcgtgggcggacgcgtgggtggagatagcttttctcagtgcggtggtggtgctgtgatctagtggcagggggtaagaaactggctacaccttttacaagctgcgtgttggagatgt

SEQ ID NO: 23799 - DNA, 317 bp, Zea mays
  Clone ID: cC-zmle189053b06a1
ccggggccgggaacaccatttttttccttaggatttaacttaaaaaaagcctgacgggggtaacatcacccattgatccccaatccatgctgggtgatgcatgggtctgctggagcccaggataaacacatcactaacaactgacacagagcgaccttcaattaaaaacacagatgggcaacaaccaacacgagacgaacgaagattaacactttggactaggtgaaacaacaccggagcgaacaggataacttggccgcgcgggccccaccgtttaattcctccaattcccgtcggagttgcccaaacccccccca

SEQ ID NO: 23800 - DNA, 463 bp, Zea mays
  Clone ID: cC-zmle189053b07a1
gtgtgacagccgagcatcggaagctgaattgaagcatcatcacatgacatgtactggctaccacttgatagaggactcgatgggagcaaggaagaaggtatcaatataattatcattgtccgccactacttgatgatgtagtacttatagattatatacttatatatgtgcgtagaacatggtcgtctcaggcaaggaatccgagcttctctccgttcttcttggcgaggcggatgaggccctgccgctgcttggagtcggcgccgatggtcttgcagaactcggtgatgacctgcgagtgcagcgcgattgccttccccctgagctggttgaagcgcttgcggccgatgatgttgcgcgccaccaccacgagcggcgcgaacagccccttgccggcgttcacgttgcccatcatccgcgccggcgaccgcgcgcgacaccggggccgcaccgacaccgacat

SEQ ID NO: 23801 - DNA, 634 bp, Zea mays
  Clone ID: cC-zmle189053b07d1
cgcctccgcccacgcgtccgcggacacccacccgccacgaccaccagaccactcgttttttcgaagcttcagctccgcgcttctctgggcgagctagccagcctccagcaagagcgagcgagcgagcgagcgagggcaacgggcatggcggcggctgtgtccttctcccgggtgcgagctctcccgacgtggtccagctccgtgtccggcgacgacgaccaccgctcctactccgcggcgctggccatgtcggtgtcggtgcggccccggtgtcgcgcgcggtcgccggcgcggatgatgggcaacgtgaacgccggcaaggggctgttcgcgccgctcgtggtggtggcgcgcaacatcatcggccgcaagcgcttcaaccagctcagggggaaggcaatcgcgctgcactcgcaggtcatcaccgagttctgcaagaccatcggcgccgactccaagcagcggcagggcctcatccgcctcgccaagaagaacggagagaagctcggattccttgcctgagacgaccatgttctacgcacatatataagtatataatctataagtactacatcatcaagtagtggcggacaatgataatatattgataccttcctccttgcttccatcgagt

SEQ ID NO: 23802 - DNA, 584 bp, Zea mays
  Clone ID: cC-zmle189053b08d1
ccggaaggaaaggcgcgggcaagatgtcttggcaggctttgttgtacgagcacctgatgtgcgagatcgaggggcagctttttagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtgggggagaggctcggcgattacctgatcgagcagggcttttaaaagtccgccatgttctgttttggtcatttgggcaccaaagtttgcgcctcatatggttctgtaattccggagctcgtgcatgtacttggcgtttgcatgcagcgataatttaacttgggtttgtttggtgggggcattggtggggacggatttgaattgggttta

SEQ ID NO: 23803 - DNA, 652 bp, Zea mays
  Clone ID: cC-zmle189053b09d1
gacccacgcctacgcccacgcgtccgctcacaccacgcatctgattctgatcgcaccgttttgtttcaccgcttcagttggcagttgcgagtggctgcaacaatccaccggcaccaacccagcgcggcgccaccggcgacccgtaccccctcccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagatcaagttccaggccaagtaccccgtcgtcgtccgactcgccggcgacgcctgaactcgtcagtctcggtctaaaattactctgtcctgcctcttgcggtgttcagtgctgtgcttgcttgcttgttgctagttgctttgctacccaataatctgaatggaaggacgtatgtgatgtgcctgctgaatagttcctagttcttgcatacactgttgtgctaccacatg

SEQ ID NO: 23804 - DNA, 439 bp, Zea mays
  Clone ID: cC-zmle189053b10a1
ataagcacaaatcttttaaaaggcagtgacctgaaacatagaagtgtttaactccattaacacaaagagatggaaaatacaatccctatttaagccgtcttcggcttgggcttaagtcgcttgagctgtgagtacaggaaaactccggcaagtgcaatcgcagtaccgagagagttgataggagaaacaggtgtcctgaagaacagcactgatgttacaatgaccacaacacgtttaacacagttgcccacagaatgagtgacaggagacaccatcgccaaaatcatgtaagacacctgttggtatgcatggaaacacagtccagcgaaaagacaccttgtaaggacttggtttacattcagaccagcagattgcaaaaatgtaggagtaaattttgacaccttttgtaaagaaagtaacaggggccaaaaggaaaaat

SEQ ID NO: 23805 - DNA, 494 bp, Zea mays
  Clone ID: cC-zmle189053b10d1
gaaagaggaattcttggacaacctttatctcttctctattttactttgatgcatttttccttttggcccctgggggcttctttacagaaggtgtcaaaattactcctacatttttgcaatctgctggtctgaatgtaaaccaagtccttacaaggtgtcttttcgctggactgtgtttccatgcataccaacaggtgtcttacatgattttggcgatggagtctactgtcactcattctgtgggcaactgtgttaaacgtgttgaggtcatagtaacatcagtgctgttcttcaagacacctgtttctcctatcaactctctcggtactgcgaatgcacttgccggagttttcctgtactcacagcttaagcaacttaagcccaagtcgaaaacgggctatatagggatagtattttccatctctttgtgataatgtagttaaacaacttctatgcttcaagagactgcattttaaaagaattgtgcttataac

SEQ ID NO: 23806 - DNA, 567 bp, Zea mays
  Clone ID: cC-zmle189053b11a1
ttattatttttttttttattaaaattttttttttttttgtttttgtttattttaaaaaattattttttaaattaaataattttttttaattaataaaaattaaatattaaaaaataaaaataatacaaaatacttttaataaaaaaaaaaaaaaaaaaattaacaaaaaaaaaacaaaaaaaaacacttaattaaaaaaaaaaaaaaacccttaactcaacccaaaaaaaaaaaaaaaatcaatttaaaaacaataaaaaaatcaacacaaccaaatacccttttttaaaaaaaaaaaaagaaaaagttaaaaaaaaaaaaacacaaaatatttttaaaaaaaaccccaccccaaaaaaaaaaaaaaacctagagaataaaaacataacacttaaaaaaaaacattaatacaaaacactctttatttttaaaaaaaaaaaaaaaaccccttatatacccgttaaaccccctctacaaaaaaaaaaaaaaaaaatcacccaaaaaaaaaatttttaaaaaattaatcccccccacatcggtaaaaaaaacaaacacatttaaataaaa

SEQ ID NO: 23807 - DNA, 591 bp, Zea mays
  unsure at all n locations
  Clone ID: cC-zmle189053b11d1
gacccacgcctccgcccacgcgtccgcccaggtattggtggaagcatgtttaaccattccgtatacgcgaagagtccatctacctctgatgagggaaatcaaaacgacatgcttcctccgaccaaagcggccgagaagccactaaacggtactgcgacagagcagcagcctcgcctacggacgcttgggtccctcacgacacggacgggcagcaccagtgacatcagaaagctcatgatggaggacatgccaatggtctcatccaaggtagaagggcccaacgccaggaggatcgacggcttcctgtacaggtacaagaaaggcgaggatgtgaggatagtgtgcgtctgccatggtagcttcctcactcccgcggagtttgttaagcacgcggggggcggtgatgtgccgaatccgcttcggcatattgtcgtcaaccctgcgcccttctcgtgaagagagagggttacgctggtgctgctatctgctgtgctgtaacatgtaggctcctttgtttctgggagtncaaccggaggtctctgtatttttacataaatcgagtgtgacagcaaattcaagagaaaaaaatca

SEQ ID NO: 23808 - DNA, 287 bp, Zea mays
  Clone ID: cC-zmle189053b12d1
actaaaggagggaggctatcgtacgctgaacccccacaaaaaaaaaaaaatatagggcgacctatatacatgaaccaggccttcgatctacaatcatgccgattgataaatccttttttagtgccccctaaaatcaatttgcagcccatccccttttaaccagctgactgaaaaaacaatagggtcgcacaaatcaaccttcctaaaagatacgcacccttcatgagtaatgggactcgccaagaagccccgcattaacccccttaccaagaggtggcacacctcaa

SEQ ID NO: 23809 - DNA, 407 bp, Zea mays
  Clone ID: cC-zmle189053c01a1
gattatgagagattattgagtccacggggggtgaagcatgcaataaattacatgatgattgtggagattaagccattacaagattgatgttgtgacgctagcagctaacgtagcagctaggcagcagcctcacttcacaactacaaatcacacaggagcatggggtccttgagcagactggcctcactcatttcacctcgaggatctcgtccaaggcatagttgttggtagacacgccggcgtagttcaccttgttgaaccgcaccaccaccgggtaacgggtgttaggatcctgatcgacggtgacgacgttgccgatcccgttgtaccagtaggactcccgcctcaggatcttcaccttggcgcccctcttgggcccgatcggcggcggcttctcggccttgggc

SEQ ID NO: 23810 - DNA, 500 bp, Zea mays
  Clone ID: cC-zmle189053c01d1
aaggttgggttaaccacccgtgcgggagtccccggtatagccggcgcccacggcggaaggggaggtctgccgtttccaccaagcccaaggccgagaaggggccgggtatctgtcccaagaggggcgccaaggtgaaaatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactatgccttggacgagatcctctaggtgaaatgagtgaggccagtctgctcaaggaccccatgctcctgtgtgatttgtaattgtgaagtgaggctgctgcctagctgctacattagctgctagcgtcacaacatcaatcttgtaatggcttaatctccacaatcatcatgtaatttattgcatgcttcattcaccgtggactcaataatctctcttgctctaaaaacaaaa

SEQ ID NO: 23811 - DNA, 557 bp, Zea mays
  Clone ID: cC-zmle189053c02a1
ggacacagatgcttacattacatagagggtttcaaaaaaagttcacatggcagtactaagtttcctgacaacttactagtgactaaccaggtccagctgcatggaagtattattgctggatcatgcaggagtcctaatgcccagaagaagcctgatcacctgatgctggcattataatgccatactctacacatactcagtagtccgaacttccgtgctatcacacaaaccctagtgtgctctaatacaacaatctgatcaggttacaagctatatacagtgtgcctgacattagagggaccccagcccaggaccacaaactgcgacgaacaataaaattacagttctcaaacgtgaaacgtgggaaggctttgtacaaccgagcatagatttcataaatttaatcagcacggccattaccttcgccgcctttttgactccaccagcttttcttctgattgcgctgtagctttatgtgaattctcaaccatcttaccattttcagctgtacaggtctggcagaaaaaagctcgagttctttgttttttgattgcatc

SEQ ID NO: 23812 - DNA, 438 bp, Zea mays
  Clone ID: cC-zmle189053c02d1
attgttcggtcgacccacccgggcgactggatacaccctgcttgcattgggatgacaatcttataattatagaaactcgagcattttttctgggagacgggtacagctgaaaatggcaagatggttgaaaatccacatgaagctacagcgcaatcagaagaaaagctggtggagccaaataggcggctaaggtgacggccgcgctgattaaatttatgaaatctatgctcggttgtacaaagccttcccacgttttacgtttgacaactgctattttattgttcgacgcaaagtgcggtccagggctggggtccctctaatgtcaggcacactgtatatagctcgtcacctgatcagattgccgtattacaacacactacggttcgtgtgaaaacacaggacttcccactactgagtatctgtacagaatcgcattat

SEQ ID NO: 23813 - DNA, 508 bp, Zea mays
  Clone ID: cC-zmle189053c03d1
aattctcgggtcgacccacccgtgcgcacagatcagctcgaccactgggaatggaattctacttaggctttggcggttgcttgctccaagaacggggatgttctgatgagctagctgttcatggagtatctctcatgttcgggccttggagattttgttgcgtctatatactactagtacggatcagacggagaatgcacattgggccaatgaatgaatagtcacacttcaccgacagagctccagacgtccacgaaacatcagatgtttcgtggacgtctgccaacatcatatcataaccccccctgttagttgctccaagcacgctttttccacagcgctcttggaacatgtagattgtaccgaaagaatggcgttagaatgaccatgtacatgttatcgtaagactgagttctcggatgtgtgggtaaacagcatctcacttatgtgccgtttggttgttttgtttacgaaatgtaacttgattactagtgggaacaagtttgag

SEQ ID NO: 23814 - DNA, 556 bp, Zea mays
  Clone ID: cC-zmle189053c04d1
gaagacgttcctgatcaacagggagagggccgtcgttttccttatctccctggagaaggtgttcgtgagggacgagtacctcaactgggaccccgagaaccggatcaaggtccgcatcatctccgccagggcgtaccactccctcttcatgcacaacatgtgcatccgccccacggacgaggagctggaggacttcggcacgccggacttcaccatctacaacgcagggcagttcccctgcaaccgctacacccactacatgacgtcgtccacgagcatagacctcaacctcgccaggagggagatggtcatcatgggcacgcagtacgccggcgagatgaagaaggggctcttcggcgtcatgcactacctcatgcccaagcgcggcatcctcttgctgcactccggctgcaatatgggcaaggacggcgacgtcgccctcttctttggcctctcaggtaccgggaagacgacgctgtcgacggatcacaacaggcttttgatcggcgacgacgagcactgctggagcgacaatggcgtgtccaacatcgaagga

SEQ ID NO: 23815 - DNA, 484 bp, Zea mays
  Clone ID: cC-zmle189053c05d1
cccacccgtccggcggggctgtcgctgtggtgcgtgtgactgcggcgcgttgttgtcttgtgtggaggaggcacaggcgcgggctgggttcactcataccacgccaacttcgtcgagtccactgaggccgtcctcaaccttgtctgctccaactgcggcaagccatgccgctcccataccgaggtggacctgcacacgaagcgcacgggccatacggagttcgcggacaagaccgcggaggcggccaaacccatcgacctcgaggcgccgcttaagccggcctccgatgatgccactgacgtcgatgcgtcggcctcggcgactgaagagacacaagaaacggttgtgccagatgtgaacaatgaggtgctcacggacctttggggccttgggtttctcgacagcacgtgccaactaggcgccttacttctctggtaatagcaccaatgaatgtgcttttaactggcttttctgagccccaaga

SEQ ID NO: 23816 - DNA, 499 bp, Zea mays
  unsure at all n locations
  Clone ID: cC-zmle189053c06a1
aatangtcaacaaaagtatgctaccactttcatcggcaagcgattctgcaagatttcaataaatataaatgtcgggcaaatcacaggcaaaaaaagaagctgggcgaagccagcaacacgcctgcactgcgacgtgcagcagttctgagtgagaatctatgaatggagttggagtttctttttttattcaaaacattggggtggcaattgctctctgggtgtggtagaatttactcgaggcatgagtaagcaagcgtcttctcctccgtcagctcttgggcagtggcatccatcttcttccttgagaactcatcaatcgggaggccttgaacgattttccattcaccaccactgcatgttactgggaatgaataaatgagtccagaaggaacaccgtatgaaccatcagagtacacacccatggaaacaaatgtactctcaggtgttccaagaacccaatcacgaatgtggtcacaagcagagctagcagccgagagag

SEQ ID NO: 23817 - DNA, 447 bp, Zea mays
  Clone ID: cC-zmle189053c06d1
gggtcgacccacccgtgcgacccagcaaacaccaatgctcttatcttgaaagaatttgtttttcctattccagagaagaacgttactggcctggcccgtttggaccacaacagggctcttggccagatttctgagagacttaatgtccaagttagtgatgtgaagaatgttatcatctggggtaaccactcgtcctctcagtaccctgatgttaaccatgccacagtgaagacttccactggggagaagcctgttcgtgagcttgtctctgatgacgagtggcttaatggtgaattcatcacaactgtccaacagcgtggtgctgcaatcattaaagcgagaaagttctccagtgctctctcggctgctagctcttgttgtgaccacattcgtgattggtgttcttggaacacctgaaggtacatttgtttccatgggtgtgtactc

SEQ ID NO: 23818 - DNA, 470 bp, Zea mays
  Clone ID: cC-zmle189053c07a1
ttttttttataattttttttttttttttttttttttttttggtttttttttattttttattcccctttaccccatttataaaaatataaaaaaaaaatatcaatccttttttttttacacccaaaaaaccccccccccacagccccacacattaaaaaaaaaaaaaaaaaaaaccccccccaatttttccccccccttagggcccccccaaaaaaaaaaatttaaaaaaaaaaaaggggtacaacaaacaacacttttttttcccaaaaaaaaaaaaaacccgccccaaaaaaacagaaaaaataaaaaaaaaacgtgaaaaaaaaattttccccccccctttcccccaatcttttaaaaaaaaaaaaaaccttttttaaccccaaaaaaaaaaaaagggggggggccccccccccccccaaaactcacccccgtaaaagggaacacccaaacccccccccccacagggg

SEQ ID NO: 23819 - DNA, 263 bp, Zea mays
  unsure at all n locations
  Clone ID: cC-zmle189053c08d1
cgcctccgagcgcanatacccatgcttggaagccacagcctcttgtaaatatggatacttgcccgggcatggtgtttctgagtagcgggggggatatctaccatgtataggagtttttccttgtaaataaaagtagcacgccaggagactccatcccaggttccgcactgcttgcgcgaccagatgctgtaaactagccagatacttgaagaccaatataaatggatatgtctaaacaaaaaaaaaataaaaaaacaaaatgg

SEQ ID NO: 23820 - DNA, 129 bp, Zea mays
  Clone ID: cC-zmle189053c09d1
gaataaagccggagatctattcttcatttctactgggacagttttcttttatgcggaaaaagaactccaaaacgggaaggcctgcaagctgaatgctccatacagacatgccgttatttgcatatgcaa

SEQ ID NO: 23821 - DNA, 473 bp, Zea mays
  Clone ID: cC-zmle189053c10a1
tttttgtttaatttaacaaagccactattagtatcaggacttgttacaagcttacaaccacagctctgtattctgcaagtacagcaggcctccattgacaaaaaacaagtatgacaggccaactcatcaccacatcccaagcctacaccctctatgtcattctttttcccctctcttgaggaacaactatgtgttatcccagatgttatcccatgaaatcatttgcgctagtcatacagcccctcctgctcccagatgtccacaaggaaatcgaccatctcatgaagaggaatgggttgaggaaatggcttatttgatccaagcagactctcatatgctgcattccaactcaatactggttcacgaacctgcttcaccttcagccgcagacttctagtttcagtccactcctgccttgtatgttcccacagaacaagtccattattaccaagtccaggaaggttatgactgct

SEQ ID NO: 23822 - DNA, 567 bp, Zea mays
  Clone ID: cC-zmle189053c10d1
ccgcccacgcgtacgcggactcgtgggcggacgcttgggctgtccacaatccgtaccacccaggaccaaataaccataggggagggattttggagcacaaccaccatcgaggttgaaccagcagatctcagcggtgttacttcagtcaatacatctaacttggcccttggaactggtagcaatcataacctttctggacttggtaataatggacttgttctgtgggaacatacaaggcaggagtggactgaaactagaagtctgcggctgaaggtgaagcatgttcgtgaaccagtattgagttggaatgcaccatatgagagtctgcttggatcaaataaaccatttcctcaacccattcctctttatgagatggtcgatttccttgaggacatctgggagcacgaggtgctgtttgactagcgcacatgatttcatgggataacatttgggataacacatacgttgttcctcaagagaggggacaaagaatgacatagatggtgtacgcttgggatgtggtgatgagttggccctgttacctggatttttgtcaaggaggcccgc

SEQ ID NO: 23823 - DNA, 320 bp, Zea mays
  Clone ID: cC-zmle189053c11a1
tttttttttttttttttttttttttttttttttctcgggggtgggtttttttatttttttgcgggtaccttcaggcggaccagcggcccctaccctgaaaactcaaaaaagcttcccaaaaccatgcaaatttcccctaaatggggaaaattaaaaaccgggaacaatcccacacaaaattcaaaccggaagcaaaaagggaaaagcctgcagagccaaaaaagagaccaaacaaaaaaaaaaagggtaaagctcagggcccccaaaagagacgggaaacccaaaaaaccacctgactcaaaaaaccccccaacacgcgg

SEQ ID NO: 23824 - DNA, 81 bp, Zea mays
  Clone ID: cC-zmle189053c11d1
cgaaaaaaaaaaaaaaaaaaaaaaaaaaaaaaaataaaaaaaaatttttataatataaaaaaaaaaaaaaaaaaaaaacag

SEQ ID NO: 23825 - DNA, 277 bp, Zea mays
  Clone ID: cC-zmle189053c12a1
gataatacaacagtcaaacatttcaaaatattgagaatattcaggacattcgccatcatcaccgggcaaatttcaaaacagaacagaaaaaacagcagcatagtgttcagctcgtgttccatcaataccagaagtccagaacattcaggaccgcacattgtggccatcttattggaaccaaatcagaggcagccgagagttcgagaggacctgagacgcgcggatcactcggcctgggtgtcggcagcggcgaagctcctgctgctggaggcgctcg

SEQ ID NO: 23826 - DNA, 522 bp, Zea mays
  Clone ID: cC-zmle189053c12d1
attccttgtcgacccacgcctccgggcggccgggcggtggacgaccccaggtcacgaggagcgccctttttgtacctcttcaaccggccgccgccgcctgcgggggaatctcgcaagtgggaggattgggagctgccctgctacgtgacctccttcctcaccgtcgtcatcctcggcgtcggcctcaacgcgaagcccgaccttacaatcgagacgtgggcgcaccagaaggcgctcgagcgcctccagcagcaggagctcgccgctgccgacacccaggccgagtgatccgcgcgtctcaggtcctctcgaactctcggctgcctctgatttggttccaataagatggccccaatgtgcggccctgaatgttctggacttctggtattgatggaacacgagctgaacactatgctgctggtttttctgttctgttttgaaatttgcccggtgatgatggggaatgtcctgaatattctgaatattttgaaatttttgactgttgtattttcaaaaaaaaca

SEQ ID NO: 23827 - DNA, 325 bp, Zea mays
  Clone ID: cC-zmle189053d01a1
ctctggaacgaacttttaaaaggggaagtgtttaacattgtcactacgcccaaaatagtatctcgcatgtttcctgtggaacatcatgtacaacacccccgcgtaggacaaaaaaatgtagccaataaattatctttccaaaatccaaaccggatagggacccactatttgtacctacaccccaatttcgtagcttacaacatattttctttggtaaaatcccccattggcccccgatggtaaacaccactgacgtggacattttggatccttcggtctcaaattctctggagaatcttttggggacgtacaaaattattgttgg

SEQ ID NO: 23828 - DNA, 375 bp, Zea mays
  Clone ID: cC-zmle189053d01d1
ggttgacccacccgtccgagaggagctcgcacagggcacagcgccatcgtctggcctccctgctgttttcccgaccgctcgctcgctccaggggaaggaatctagcttttaccatcgcgtctctggcgctctgaatcaccgtagcggggaccgcggcggctacctctgtgaggacgcagccggcacgccggtccgagctggtcgtgccggccgctgacagcatgggcggcccggcgcccgccaaagaggagaaaggcctcggcgagaccatcttcagcttcatcttcaagaaagaccaactggcggagacggacccgctcctcaacaaggtcggtgccgcgccggccgactactcccgcgccaagacaaccgccg

SEQ ID NO: 23829 - DNA, 585 bp, Zea mays
  Clone ID: cC-zmle189053d02d1
gtaattaacgacaaaccgggacaccaaagcgccaccctattaaaaaaatttttttttaacaaaaaaaaaacaagggacatttaaataaaaaacccaccccaaaaaaaaaaaaaaacaataaaaaaaaaccacacaaaaaataacaaaacaaaaaaaccaaaccaaaaaaaacaaaaaaaaaaaaaaaaaaaaccaaaacacaaccccaaaataaaaaaaaaacaaaaccaaaccaaataaaaaaaaaaaaaacaaaaacaacacaataaaatcaaaacaaaccaccaaaacccccacaaaaacaaaaaaaaagaaaacaaccccacacaaaacaaatcacaaaaaaaaaaaaaaccaaaactaaccaaaaaaaaaaaaccacaaaaaaaaataaaaaacacccaccccacaccaccccaaaaatcccccccacacaccaaaaaaacacacaaccaaaaaaaaacaaaaaaaacctcacaaacacaaaaaaaaaaccaacccaacaaaaaaaaacacccccaaaaaaaccaaaaaaaaccacccaaaaaaaaaaaaaacccggccccaaaagaaacccaccaaaaa

SEQ ID NO: 23830 - DNA, 519 bp, Zea mays
  Clone ID: cC-zmle189053d03d1
ggtcgaccacccgtgcgcgcacgacacttcagacgcgcatacaagcacatccttattaatcacaccaggggacggccaggcttggtacgggctgattctgattctctaagaagacaccataaggaacacctttacatccgattgagcacagaaagatatgatgcaaaactagcgggcataaaagccgttaacatcttgaaataacaccgtaccatccaaaagccctaaaacgctcgatcacatacattcttaaacaaaagtgaaaactggagcgttggacaacaaaaactgctatgcctaagccgggaagaaactaaagcacagcagaatactgcccatggactatgctcactgcttccgacgattcccaaaccgatgctgtgattcaaaagatcatccctgaagactttgcagcttgtaccattatcagcatcgcgcacagaatacctaccgcgatggacagcaacaggatcctcgttatatatgcaggactaacaaaagtatttgaccgggctgcaa

SEQ ID NO: 23831 - DNA, 322 bp, Zea mays
  Clone ID: cC-zmle189053d04d1
tttcgggtcgacccacgcgtgcggccacgcgtccgactgaaatgaggatagtatcgcagctttctttaataaaacctgaatcacccacaacgatgtgctaagtatctcagccagtggtatttactggttgacctactgtagtttgcgtcggaatagatatgtttttttactcttcgtggggcagttttgtactggtggattcataaggactctgattatggtgcgttcggaacttataataataagcacatgaaattttgcttcaaaaaaaaaaaattaataatttaaataaaatatttaaacattaaataaaacattttaa

SEQ ID NO: 23832 - DNA, 356 bp, Zea mays
  Clone ID: cC-zmle189053d05a1
gggttgggtttttttttttttttttggttggtttggggaagcaaacccaagaagaacaagtatagttaaatattattacaagggggggggggttttattattattaaaaccactcaaaggaagggaagggggcccacccgggggaaaaaatggggaataaaaaaaaaagaaagggcgaggggatccttcttttgcctttggaaaaaaaaggcccaggggggggaggggatacaaggaaaaaaaaaacccttggggaaccggtaattttcaaagaaaatttggttaaaatggttgaaggaacccgaaaaaaatttttccacacaaaaaaaaaaagaccccgccccgcaagaaaaggg

SEQ ID NO: 23833 - DNA, 353 bp, Zea mays
  Clone ID: cC-zmle189053d05d1
ggttaattgtcgggtcgacccacccgtgcgcccacgcgtccgacctgccctactcctgtcgcgcctttcccttctctcctgcgaccggacgaccccgggggggttctctaccagttggaccagagcttactcgacgacgaccaggtcgccgagggctttgtgctcacctgcatcgcctaccacaccttggaccttttcattcacacccacaatgaggatgcactccttgaggcgtactagtataggcagccattaatggaccacatacccacccttttcctggcatgcatggctggcataataaaaaaaaacacccccgcctggcattattaacttaatttccccgcccccca

SEQ ID NO: 23834 - DNA, 287 bp, Zea mays
  unsure at all n locations
  Clone ID: cC-zmle189053d06d1
acccgtgcgggcctcatgcgcacagcctnctgccnctcttcctctcttcattttcccccaccaaaccctaacccgaggacccagttactctcttagtctgctcgcgccaccctttggggctctcactctgagcggcagggacccgcaaggctccggttgtgtccaggaaacatcccagttgttggcgagagaccaataaacggcggataaggagggagcgaacgttggagcggaagagatggacaagcggtagcaagaaggggaggcaaaggaagtggaagtgaaat

SEQ ID NO: 23835 - DNA, 279 bp, Zea mays
  Clone ID: cC-zmle189053d07d1
gaccacgcctccgcggacgcgtgggcggacgcgtgggtttccatatagaataatatacagttttttcgcccaaagagacgtatgttatatatatgagttgtatgcagtcaccgaactggtacaggcttccgctttccatttcctgttgggagtcgtgtagtgtaatcctggggtgtgtatttgtttcatcaatcatgccagccgatttgaatctcgtttcaccagcatgatctgatttgggtatacaagtataaaccgcaacgagcgatcttgtaaaaa

SEQ ID NO: 23836 - DNA, 515 bp, Zea mays
  Clone ID: cC-zmle189053d08d1
cgcctacgccacgcgtccgacacacaaacagacagacatacaagcatacaacatcgttttcatttagttgtgttcttgctaggcaggtgcgcacttacattgagccgcagctagctgtctacggcacaactatctcctgcgcgcgtgctcgatctgaagctaggccagacctgagcctgtccaattttgccttgttctacccggcccaccggtagtcgagaaggttccataagcgcaagctgacagcaaaagagctaaggggtctgagacaaggttcgaacagatggaggatgtggtgaagttcgtctttggagtttctggaaatgtcatcgctctcttcctctttctgtccccagtgcctacgttctggaggatcatcaggaggaagtcgacggaggatttctcaggggtgccgtacagcatgacacttctcaactgcctcttgtcagcttggtacgggctgccgttcgtgttcccgaacaacatgctggtgtcgacgatcaacggcgcgggcg

SEQ ID NO: 23837 - DNA, 449 bp, Zea mays
  Clone ID: cC-zmle189053d09d1
gtaatcgccgccatggccgccgccggcaagctcctcctcctggtcgttcgtcgtcctggcggcttccctcgtcgccgacgcgggcccgtgcggccacgcgcagacgctcctcgtctccttctcctccgtcctcaggccgaacccggaccccaccaacccgacgccgctcaccaccacagtcgtcaccgtcctccgcgtacgccgcctaggcccgcaccagatccgtcgtcccatggcgctccccgccgtcgagtcggaggtcgccgcctcgtccgctcaggaccgtgccaaggacatcctcgttgacgtctccggcctactcttatgcttcagctgcggcgccctcaccgccgcgtccatgtacctcgaatggtcgctcctcgccttcacctgcgcctccggatacgacgacgacgtctacagcgacagacaaggaccggctgtccgac

SEQ ID NO: 23838 - DNA, 476 bp, Zea mays
  Clone ID: cC-zmle189053d10a1
agcgaaaccaccagcgtatcataaaccaggttttattaattgaggcgaaaccatgaacagacataacagtggtgtgtgataaaaaaaaaactcaaagagaaagtatgtgatccaccaacttatcgacggcaagttgagaagacccattgctctcaaggcacatccgcactttctccttgaaatccttggctcttcccctgataccaactccctcgtcttcttccatcagcttcttgatggccttttccacctcccgccgctccagcacaccctccagcaaaactccaatcctccacacgtggcacacgtaccttgccgttggcaactggtctccaaagatgggcctcgacagcataggcaccccctcatagatactctccagcgtggagttccatccgttgtgagtccagaagcctccgactgccgggtgagctagcaccttcttgctgcggcgcccactcgatcaccttggccct

SEQ ID NO: 23839 - DNA, 501 bp, Zea mays
  Clone ID: cC-zmle189053d11a1
ggtcctcggcggccggactttcctgtggcttcggcctggcggcgcgcggagggccctggacgccgtcgtcgtcgcgcgggcgtcgtctgaggcggagaccgccgaggcgggcggcggcggcggcggagcggaggaggagcggccgtacgaggagtacgaggtgacgatcgagaagccgtacgggctcaagttcaccaagggccgcgacggcggcacgtacgtggaggccatccagcccggcgccgccgccgacctgaccggccagttcgaggtgggcgacaaggtgctggccaccagctccgtcttcggggaggagatctggccggcggcggggtacggccagaccatgtactgcatccgccagaggatcggccctctctacatgaagatggagaggaggtttggtaagtgggacggcgccggcgacctcaccgagaaggagatcatcaggttcgagaggaactccggagtggtcagcggcagggtgcgggagatccagct

SEQ ID NO: 23840 - DNA, 402 bp, Zea mays
  Clone ID: cC-zmle189053d11d1
cgcaaactcactagacaagtattgagagtttgttcgctaacatatttactttcttgatccttaacatatttggcatgtggggtacaagcacaattgcatatttcctttacatttggacagtactcatacagacatacacaatgtatctgcacggcaaatggtcaggtacgagggcaagctaagctaacaatcgcctcacttgtttccgagatctaacaaggacttgatggcgttgatggcgttctcgttgatgaacgacttgtagtagttcttcagcaagggctcgaacttctccgacttccttacgttcgcgagatccgggtcggtgcaaactgccttgaagtcttcataccctgacttgagcgcatcctccagcgcagaaagcgcatgctttacccggtc

SEQ ID NO: 23841 - DNA, 469 bp, Zea mays
  Clone ID: cC-zmle189053d12a1
tttgctatatatttgtgccaaaaaattgcttatcaccgggaaagagtttgataacccggtcatcttatccatcgtcaacctccgacattttttttctctgtccatagagcgaaagtcactacttctggaagtcagaagaaagcgaggaagccaccgcagatggtggtgagacccatgagccagacgatggcagcaacggcggccggcatgacggcggcgaccttataggagaagaggagcgtcagcgcggacgtgagcagccacaccgccagcttgagccggtccctgagcgacgacccaggctccgcgcgctcgtaccttcggaggcagcagaagagcaggacgaggtctacgtacgccgacacgacaaacgcgacgttcccggggtcgggccatcagcggtgcaaggccatcgcggagcttgagcgtgaggtacacgatgccagcggttggcagccacgggaagctg

SEQ ID NO: 23842 - DNA, 332 bp, Zea mays
  unsure at all n locations
  Clone ID: cC-zmle189053d12d1
cgccacgcgtncgactagttgactagctacaatgccaaacattttcttcttcgcccaggcgacgcccgncacgcgagaggagcctttcctacggtgggaagacgacacaacaccgccgaaggccgccggcggcgatgggcagacgctcgacacagccgcccgttacgcccacagcttcccatggctgccaaccgctggcatcgagtacctcacgctcagctacgcgacggccctgcaccgctgctggcccgacccccgcgacgtagcatacgccgaatcggcatacgtcgacctcaacctgctcttctgctgcctccggaagtacgagcgcc

SEQ ID NO: 23843 - DNA, 421 bp, Zea mays
  unsure at all n locations
  Clone ID: cC-zmle189053e05a1
ttttatattttttccttgnatttatatataaaaaaaccgccgggcagtgcactttattttcacagtagtatattgcgttacatgcatgtgatagtggtagcctacagctctacgcattccaaatgcttcaccggaatccattattgtctcctccatccacaaggaaatcatcttatagccgagcctgaactttctttgttggtgcactcagaggaatcccttttgcagctctttcagcgaggtaagagcagggcttgaagaaacccccataccgctttgtccactcctccaactttccatggatgtactttgcgccgatggaatctgcccagtgcatgacacctcccctataaggtgggaaccccatgccaaagattgaagcgatgtctaggtcagaagccttgacggcgataccctcatc

SEQ ID NO: 23844 - DNA, 603 bp, Zea mays
  Clone ID: cC-zmle189053e05d1
ttttcgggtcgacccacccgtgcgcggacgcgtggggttgcaggaccacgggctggactttttattttgcaacttctttccaggaactgcgggtctgagatacttgtaaaagcttagttcatgtgttcttttctcagcgggcaacgtctaagattccaggtgctacagacttggggttgatgcctaggaaaataactaaagttgccattctaggtggtgggcttatgggttcaggaattgcaactgcgatggtattaagtaactatcctgtgctacttaaagaagtaaatgagaagttcctaactgctggaatcaacagaatccaagccaatttgcagagtcgagtaaagaaaggaaaaatgaccgaggagcgatatgagaaggctatgtctctcgttactggtgtccttgattatgaacgtttcaaagatgtagacctcgttatagaagccgttattgagaatgtgaagttgaagcagcaaatattttctgacttagagaagtactgtccttcacattgcatccttgctactaacacatctacaattgatcttaatctgattggggagaaacaaaggctcaagatcgattgctgtgcacact

SEQ ID NO: 23845 - DNA, 124 bp, Zea mays
  Clone ID: cC-zmle189053e06d1
gagtgggcccctaatgggcctctctccctataaccggttttccccccttgtcgtcgggtccccctctttatatagggcttctgtttcaactggacaaaccctaacctcttttcgtctatttttt

SEQ ID NO: 23846 - DNA, 390 bp, Zea mays
  Clone ID: cC-zmle189053e07d1
aagccaatcttataggagggtttatatgtgcattagccgccgcatatccacggactcggggtccactagggaggtaggagcctagtgaaatataccactttgaagatcttatacaacgtcaagccatcaatgttgccataaacatgctgatcacttttgcgattgctcaaaatttcctagtcatgcttcgccacttgaagataggccttttcttcttctttgctgcatttgtactcatcatgaccatcttcattgccaagttgctgcctgagacaaagaacatccccattgaagaaatgcatacagactggagatcacaattggtttaggtcaaaaatagtcccacatgctgatgatcatcccaagcctgatgctgcccaaagtttaaaa

SEQ ID NO: 23847 - DNA, 460 bp, Zea mays
  Clone ID: cC-zmle189053e08d1
gacgcgcgggtcttggtcttgctgccatttatgatgctcactgcattcttattttggggccacgatttcagacctaggggccgaatactttcatcattgaggaagcagttcccacatatccctttgttagctttaactgcaactgctgtcccgaaggtccagaaagatgtggtatcatcattgtgcttgcaaaatccagtaattcttatagcttcatttaatcgacccaatatattctatgaagttcgctacaaggatctttttgatgatgttaactctgatatatcaaatttgctgaaatcaagcgggaatgtatgctcaattatatattgccttgaacgggcagcttgtgatgatctaagcatgcatttgtcacagcagggtgtctcttgtgctgcttatcatgctggcctaaatagtaaagtgcgaagttctattcttgatgactggctttcatcgt

SEQ ID NO: 23848 - DNA, 240 bp, Zea mays
  Clone ID: cC-zmle189053e09d1
gcccgctcgagaacctcgctgaccacattgccgaccccgtcaacaacaattctttttcctacgccaccaacttcgtccccggcaagtgagggaggcgccgtcggtgacctttatgtgtccggatgcatgtgagcgcacgctggttttcggtttgtaccatgatgtaaactattgttcaatcgacaaggaataattgtgttcattgtcattaaaaaaaaaaaaaaaaattataataaatat

SEQ ID NO: 23849 - DNA, 219 bp, Zea mays
  Clone ID: cC-zmle189053e10a1
ttttgtctatctttcaaagaaacaagtgacacatatgggcaggatttcatacaaaggaacagcgacaagtggacaaaagaacacaacgcgccccacccaatgacaactggccgacgagcatcattcggagctgactcacaacgagagggaacaactgggttactgagttataccagaaccctccagctgacggcccatccattccatgagaggacccta

SEQ ID NO: 23850 - DNA, 533 bp, Zea mays
  Clone ID: cC-zmle189053e11a1
ttttttttatttttttttttttttattttttttttttggtttttttttaatttttttatccataataaataataaaaataattataaaaaaaataataaattaaaaaaaaaaaaatatctacatcatagaaaaaaaaaaaaaaacaccccgtgcaaaaaaaaaaaaaaaaacaacccacctcttctaaaaaaaaaaaaaaaaaaccttttttaaaaaaggaaccccttcccccccttttttggacctcccccccccaaaaatcaaaataaaataaaaatatcccaaacaaattggttttttgggagggaaaaaaaaaaataaactttgccccccatggttccaacaaccctaaaataacaaaaattgttaaaccccaaaaatcaccccctttaaaaaaaaaaaaaaaaaaatttccccaaacaaacaaaatcacatccctaaaaaacctgtcccccaaaaaaaaaaaaaaaaaatgggggagaaaaaaaaaaacacaatttataaataaaaaaaaaaaaaaaccccccggggg

SEQ ID NO: 23851 - DNA, 102 bp, Zea mays
  Clone ID: cC-zmle189053e11d1
acgcccacacacaccgcgaacgcgcggcccgacctttacaacacctctggttatcaacacaagcacaagcacaagaaggggcggagccattccccccaactc

SEQ ID NO: 23852 - DNA, 446 bp, Zea mays
  Clone ID: cC-zmle189053e12a1
aaataataataattctgtacagaggcaggagtcaaatactagcacaatccattacatcacagactgtagtgcgcccatatatatatatggtactagtactgatacaataacagtacgtagcctctattcggctcatgttcattgacatggcttattctagtcccacgatagcgaaacacacggtctactcgctccctcgcaacatactagtatactactataggtccataggaacagggagaagcattattataataatagaaacaataataagattagctcgacacgtaattgacggagaacgtcgcttcggcccacccgtgtgcgtatggtttcagtgggcgcggggcaccgggttgaaggaggcgagctggcgggtgcgggtccaaacctgctcgtacacgacggcgacgtatggcacggtgcggccggcggggtcggcggcg

SEQ ID NO: 23853 - DNA, 550 bp, Zea mays
  unsure at all n locations
  Clone ID: cC-zmle189053e12d1
gcctccgcccagatctaactgccccccgactcacgaatctcaaagccttangtcgattcaccgccactgcctcccactccggctgggggtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgcccactgaaaccatacgcacacgggtgggccgaagcgacgttcttcgtcaattacgtgtcgagctaatctcattaacgtatctattattataataaagcttctcacttgttctatggac

SEQ ID NO: 23854 - DNA, 558 bp, Zea mays
  unsure at all n locations
  Clone ID: cC-zmle189053f01a1
ttttaatgtttcttttaccacatcgctcggtcgctcatgtgggaatttgcaacaatgagttcatctctatttacctcttgctacaatatagcaagaaccataggctcttccagcatggttccctacgttgcgcaatgcattttagagttcctcttttccagaagaggttccattagagttacctccccttttccagaagaggttccataaggttcacttgttttgatgggtttgaatcaccctcagtaggtttcttgagaattccaggaggttgctgtccttggcgattctgtgctccctgaaggtttgcagccttttggcccgttaatctcctaacggatggagcccttgcaaccgatgatgcggcagcagcagcagctactcggatccttttatgaacatcaacatattcatcagtctcgtccacgatttcctcctgtaggagttcttcgaatacatcctcaagtgtgatgattccaacgacctcaccatcctcaatatcctctgatgacctangcactgcgtttgatgctgtgttcccattaatctgcctgttat

SEQ ID NO: 23855 - DNA, 599 bp, Zea mays
  Clone ID: cC-zmle189053f01d1
ggttgacccacccgtccgcccacgcgtccgcggacgcgtgggcgcgggcatctcctgctttctcgttctcttcgcagggatcatgtccgggggcacagttggactcatgtcgctcggcctcgtcgagctggagatcctccaacgcagcggcaccgacgtcgaaaaggctcaggctgctgccatccttccggttgttcaaaggcaacaccagcttcttgtcaccctgttgttgtgtaatgctgttgccatggaggcacttcctatatttcttgacagaatgtttcatcctattgttgctgtaatattgtcagtgacatttgttcttgcctttggagaggttataccacaagcaatctgtactagatatggtctagcagtgggtgctaactttgtatggctcgtacgcattctcatggtcatctgctatccaatttcttaccctattgggaagatcctggactgtgctcttgggcacaatgagtctgcactttttaggcgagctcagttgaaagctctaagttaatccatagcaaagaggctggcaagggtggagagcttacccatgatgagactacaatcataagtggagccttggacct

SEQ ID NO: 23856 - DNA, 363 bp, Zea mays
  Clone ID: cC-zmle189053f02a1
ttttgactttgcgtaattgaaaaccgccaaacaaaaaatgggggggtatatcctaaaaggatcggcagacaatcaaaattcaataaatcatcacactcaaactatatttgctgactgcaatcattacaatcgagtgcattcactattcaaaatacatatgccagcaatatgacctatacccccaaaaaagtaactttccatacctagacacgttgatccctaaactccagacacaacacgccagccagtgctccaccacaacaacagatactgactaactttttgaattaatggaagaatgcaccatacccacgaaggcaaaataattctggaactaatgcaatgcgtacgcttacaccggaa

SEQ ID NO: 23857 - DNA, 412 bp, Zea mays
  unsure at all n locations
  Clone ID: cC-zmle189053f03d1
tccattttcacttccaacatttcatttttcccaccgaagactcancccatgggcagagttactcttaacaatccccagcccacaataccaaaaaaagcatggatgcacactgaaccttccaggtatgaacatacgacttcataaactgatctatgatggcaacactatcgctctttaatgccaggagaacattttcctaactacaaccaaagtacctattacagacattaaacagaaatacacaaaaatcacattcactcccacacaacctgacctaaaatgaataccactacccacctaactaaatgaacttcacaatagccacccctaacaactaagtaaatcccacacaattaaacattaacttccaaccctccattcaaaacccgaaatgcttcgacacgtacaatca

SEQ ID NO: 23858 - DNA, 208 bp, Zea mays
  Clone ID: cC-zmle189053f04d1
gtgggggacaaaaaaaagaataaccacttctatttccaccactacgatatcgaccacaggaacagcatcatcgggagcgattgatatttagtgtcgcagcccatttacaacacatttattcttgctggatcaaagaatcataccaacttatgctaatgtagtgtttcaccaatactcacgcatttaatacatctattaatcatcaaaa

SEQ ID NO: 23859 - DNA, 415 bp, Zea mays
  unsure at all n locations
  Clone ID: cC-zmle189053f05a1
nctttnnttttntttcccaaaaaaaggactttcttaggtgggggaagccacaaacatcagataaaaaactttattattgaactataactcataagaaatctaaaagagggcaccaccaatgatgggttgttggtagaacactgctgggtttgtcaaaacaagttggttgaatggcaacaattgttgcaattgaaaaagggtgccagcgttaggcgcaacgtgctggtaaaaccgcaacaactgtggttgtgttaaaaaagtagcaaggctcacaccacctagctggctgaatggtaatacttgttgctgctgaaataaaccagagagctcaatgctgctagttggttgaaaggaaaaaattgctgggggtacgcacaaggtacctggctgaatggtaattgttgtttttgcaaaa

SEQ ID NO: 23860 - DNA, 543 bp, Zea mays
  unsure at all n locations
  Clone ID: cC-zmle189053f05d1
ctagcaacatataaagcacaatagtttaccaacatttgctgctcaaaatatttngcctccttatgcggcttgtttttttttcaagtgctgctacggcaaccattttcccgcaatgctcgcaagctcctatagcttcccttcttcccccgtacctctcaccatcggtgtcttcggtatgtgaaaacccaattcttcaaccctacacgatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcatccagctacctgctgcctaaccccagcaatttcttccattcaccaactagcaacattgaactctcctgcttatttacacaacaacactactac

SEQ ID NO: 23861 - DNA, 548 bp, Zea mays
  Clone ID: cC-zmle189053f07d1
acgcccccgcccacgcgtccgcggacgcgtggggtctcgaatggtcgaacagaagttttctttttattatccatggcgacttctacgggggctgccactgcactgctccgccccaggccggcagttccagccaagttggcgcagaggaggtgcctccatgcggttgctgggtggacgacgatgaggaggaggggagctgcaggggtcgagcgagctttcttcaaccctctcggggatgagcgcattctccgagaagccatcaaggagccagtagcattcatgggtggtgtgtttgctggcctcttgaggcttgacctgaatgaggatcctctcaaggaatggataagtcggacagtggaggcttctggaatagctgaagaaaacagctctgaagaatcaagtgaggcagatcaaaatgatgcaccttaacatatcgagattgagtgaggtgcattgtctaccttttgtccacttgtcactttttccttgtaacttaatccgaaatttgggacacctgattcatcacgtgcttgtcaaaaaaataaaaa

SEQ ID NO: 23862 - DNA, 194 bp, Zea mays
  Clone ID: cC-zmle189053f08d1
gcccacgcgtccgcccactcgtccgcggacgcttgggcgtaaaccaagttgttttcctgaattgtctgttaaacgtaacagacatatgttttgaagcctaaggggagctttcacttcaaaaaaaaaaaaaaaaaaaaaaaaaataaaaaaaaaaaaaaaaaaaaaaaataaaaaaaatataataaataaatagg

SEQ ID NO: 23863 - DNA, 358 bp, Zea mays
  Clone ID: cC-zmle189053f10a1
ataattttattttttttaaccgaccccaacccaccaccggcgaagttttaaaaacaaacccccccccccaccaacttaccctataatgaaaccaacaaaagccccaccaaaacaaagacacaccccatcccccagacaaacccctacccccccacaaccccacacaacataccaccccaaaccaaaaacaaaaaaacccccccaaccaaaagagcgaccccacccacatacaaccccaaacccccaccgcccccttaacagaacaaacaccccgccccacaactgaaaaaaaaaaacacccaacccccggccagaaccagcctctcaacaaagcacacaaccggccatccccctcacc

SEQ ID NO: 23864 - DNA, 411 bp, Zea mays
  Clone ID: cC-zmle189053f11a1
gggaaaaggatgggggtcatatagaataatatttgatgtatacaatgtttttgagtttggctctcgctgccagtcgtgtgtttattctgcacccgtggtaccccactaaacgttagtcgagttcattttatgcatcaacagacagatgacaagttcctcttttatttattacactgaaaaaactagtccggaatggtgatgcaaaaaattctcctaaaatacaactgggcggaggattgtttcaaatattggtcgggggggcgttggattcagggtcccagcctggaggctcgatgttgggccaatcgcctctgcaaccaagcctgatgtagaggctcttcttccctgctagcttcttgtctgctaaggtgagctgcttgagtgcgacgaggcatcccttcgcaacagccc

SEQ ID NO: 23865 - DNA, 493 bp, Zea mays
  Clone ID: cC-zmle189053f11d1
cgaattcctggtcgacccacgcctccgacccggagtacacgcgggctgttgcgcagggttgcctcgctcactcatcagctcaccttagcagacaagaagctaggggggaagaagagcctctacatcaggcttggttgcagaggcgattggcccaacatcgagcctccaggctgggaccctgaatccgacgccccaccgaccaatatctgaaacaatcctccgcccagttgtattctaggagaattctctgcatcaccattccggactagttttttcagtgtaataaataagagaggaacttgtcatctgtctgttgatgcataaaatgaactcgactaacgtttagtggggtaccacgggtgcagaataaacacacgactggcagcgagagccaaactcaaaaacattgtatacatcatatattattctatatgacccacattaattttcccactaatataaatgcattatattagaaatttatttatctctg

SEQ ID NO: 23866 - DNA, 390 bp, Zea mays
  Clone ID: cC-zmle189053f12a1
aacccaaaatatgaggaggccatcccagctgggtatcatatcatacggggtgctgctgcggcggcggcggcaggtaaagaagcattgaggtatagcttcatacaagttcattccacgtatgacgcgccgatcgagagtatcattccacgccctatatagctacgactatagctagttgtcgtaaatgcggcactcctcggaggccgggttctccttgcagtacttctcgagcgggtcgttggcgttggtctccttgaggctgtcgcgggcgtggctggccggggcgctgatctcctccaccttgtcccacgccggcgtgcacttggggttgcccttttggtcgtccgcgcacgtctccttcgcctgcttgatgctctaagacaccttgtc

SEQ ID NO: 23867 - DNA, 544 bp, Zea mays
  unsure at all n locations
  Clone ID: cC-zmle189053f12d1
cggaattccttggncgacccacgcctccgcacaccacacacacccgacgacgatcacacactcgtagaagaacgtgnncgttcgatcgtgaccgtgacgcaggaagctgtaagctagccaagacaggaataataatggcggcgtcgacggtggcgagcctctctgtcccggtgacgacgacgaccttcgcggcggcgggcggcgccgacgtgctgatcgtcgtcccgaggagggcgggcgccgggcgcgtcgtctggttccccgcggcggcgcgccgcggcggcggcagcgggcggttggtcgccgtgcggtccagcgggccggccacgccgccggagatctccgacaaggtgtctgagagcatcaagcacgcggaggagacgtgcgcggacgaccagaagggcgacgccgagtgcgcggcggcttgggacgaggtggaggagctcatcgccacggtcagccacgcccgcgacagcctttaggagaccaacgccaacgacccgcttgagatgtacttgaaggagaaccccgactccgaggagtg

SEQ ID NO: 23868 - DNA, 138 bp, Zea mays
  Clone ID: cC-zmle189053g01d1
tgccaaaaaaaaaaaaaaaaaaaacaaacaccaaaaaaaaccaaaaatttctaattttcaaaaaaaaaacaaaaacaaaacaaagaccgggcgaccataaaaaaaacggtcccaaaaaaaacacaacccaaaaacccc

SEQ ID NO: 23869 - DNA, 464 bp, Zea mays
  Clone ID: cC-zmle189053g03d1
ggtcgacccacgcgtgcggagaagacgacgccacgaggctcagcaatctttcacctttgttttcgcttgaatgaaattgtaataaggggggaacatagcaacgggggttgatagcgaaacatacatagggttcaaagatacagtaggtgattggttgataggatttgagattgttctgcatttttttttgtagagtcaaaggttcaatcatcatttttcagatttggtgagaccgcgtagcctgtgtagtcaatactgtgcaggctattttgccaccagactttgcaatcaatcggtttttagctaaaacagaagttgatttctcctctccaacctgggaatcagattcccccttgttctccatgtgtacacgcgttcctgtttggattgttctgggccaatcagcacaaagaaaggagatgtttttttcttctgaacactgaaaggaaagcaccaggagatgt

SEQ ID NO: 23870 - DNA, 84 bp, Zea mays
  Clone ID: cC-zmle189053g04d1
ccaaataaaggtaaaaaacaacaccacaagggaaaaaacatccacaccccaacaccaatacccaaacccttttattttaaaaca

SEQ ID NO: 23871 - DNA, 583 bp, Zea mays
  unsure at all n locations
  Clone ID: cC-zmle189053g05a1
tttttnaataantttttttttcttttttttttttttgggttgtttttttttttttttttcctctctttttttttttgggaagccccccccttttcaccatctaaaaaaaaagggtggccccccccccctaaaaataaccccccggggccttgcccctttttcaacccccccccacccactttttttccccggaaaaaaaaaaaccccttcccccccccccttacttggcatttctccggggcggggggtccccccccaccagcgaggggccccctcggcggcccccgaaaaaaccgagacccagtttttcccccaaaggggccctataagggccttgggcaaagtcccccccggggcccccccccgtcaccttngcccccgttgaaaaaggcgaacatgggaaacactgcccccccccccctccttatccccccccccccaaaggaaggcgcccccgcccgggcccctgccccccccccgggggaaaacgccccccccggggcccctttgtcccaaagccacccccgtggggaacccgggaccccccccccccccccaagaaaacccccccgaaccccccccc

SEQ ID NO: 23872 - DNA, 428 bp, Zea mays
  Clone ID: cC-zmle189053g05d1
ggtcgacccacccgtccggaaatctttctctgaattgtgggtctccgacaatggctgtgctcgctccatccaagattctgggcacggggctgatcttattgggctcctcccgctaccccaccgcagcgcccaccgggggggctcagaagattgtctcccttttcagcaagaagcctgcccagaagcccaagcccgctgcggtatcgtcgccttctgcagacatcagcgacgagctcgccaagtgggatggtcctgacaggaggatctacctgccggatgggctgttggaccggtcggaggtgccggagtacctcaccggagaggtccctggagactatggctaccacccttttggcctgggcaagaagccagaagacttctcctagtaccaggcctacgagctgatccatgccagaagggccatgctc

SEQ ID NO: 23873 - DNA, 361 bp, Zea mays
  Clone ID: cC-zmle189053g06a1
ttttcttgatatttgcatattttgaaattataaaagcgggaaggttttcagaaaccttaccacaattaattctaatacaggggggaaaaatttcattagggtacaatacaagtgggaaaaaccctggattattcattatataatacctctccagcgggatgacccagaaaacctttcattgtcgagcgcccacctccacaaaaaaacctcatgctaccgtggggattgctacgagctcgaacctatccaggtgctggaaacacttccacgccttatgccacaccttggcctcggacaagttcttttcgacgacgacggccttctttaccttgacgaagaagtggtgcatggtcccggccac

SEQ ID NO: 23874 - DNA, 512 bp, Zea mays
  Clone ID: cC-zmle189053g06d1
atatccgactcgtgtctcctgtgctttcattggtccccctcctttacagagccgatcaccgtcaccggacgggaggatatatcgatggctgaggtacacaatgagcggcccgtggggatggagggcgacgaccgagacgcaccggaggaccgcgagaactacctccaggccatcgagctcgtgcgcttcgcggacgccgagcacaacagcaagaccaacgcgatgctggaattcgagaggctggtgaaggtgaggcaccaggtcgtggccgggaccctgtaccacttcaccgaccaggagaacgatgccggcggcggcgaaaagaatctttacgaggccaaagtgtgggacaaggtgtgggagaactttaagcagctggcagagcttcgaactcgtcggacacgccgcgggcgtctgaggcttttcgttggaggctggagcacaacaatgaaagaatttaactgtgatccccactggaaagtattgatttaatgaattaaccagggtcttac

SEQ ID NO: 23875 - DNA, 133 bp, Zea mays
  Clone ID: cC-zmle189053g07d1
ccgcggacgcgtgggtgcgcattgcattacgatttttaccaataaggtcgtaattttcaaaggaaattaatagggttttggggtgcgcgaaaaaaaaaaaaaacacccaacaacacaccataaacacaacaaa

SEQ ID NO: 23876 - DNA, 400 bp, Zea mays
  Clone ID: cC-zmle189053g08d1
cgtccgaatactgcggctgattgtaaaactcatgtcctgtttctgctgatctggccgaaccattggggcggctgtctgaatatccgcgcgccccccgatactgccaatctctggcccatacaccgtacataatgcctcgagttcatccaataatgatgcacataagcggacctgtactggtgtgaccaactcataccgtactgtccggtacagagcaagatcttcgagacgttcgacgctacgatcaccaaaagaaagtcagggccggacgttctagaggatgccaaggctgctcacttctggcctacaacaagatcggtcgtgtatagggaccccctgactaactatacgggacgttattagccaaccaagtcacggcgaaaacccaggagctacccat

SEQ ID NO: 23877 - DNA, 411 bp, Zea mays
  Clone ID: cC-zmle189053g09a1
ttttctctaaacattcatatatagaaattatttttcctgggatctggccgtcaagcatacatgcattatctcagacttcgcagtggcgagctcgatcgatatatatgatgactagcatcagtactaaaatagtattgtatcagggacacacgtacggcatcgaccagagcaccatgcatgggccatggatcatatcatcattatcatggcttcatgggatgggaatggatcggagtacgtgcttaaccatgatcagtacacacgtatctctcggaggggcggcggtatcccgggtgatggccgggcgattaattagtagctgtagttcttgacgaacattccctccttggcctcggcggcctcgccgtcggaggtgtacttgccgagctgcgccagggagttggccttggc

SEQ ID NO: 23878 - DNA, 441 bp, Zea mays
  unsure at all n locations
  Clone ID: cC-zmle189053g09d1
acgagtgtcaagtgaacctgaaacttgcggtgtcactggctggnctccttttatgtgagtgagtgatcgagctagctgagcgggcgatcctcgctagctaggataccgccataccacaagtcttcttcacaagtttaggagtgacagcaacaagagatcgatggcctctgtcaccgtgctcaagtactccttccttcccaagaagtccgaatggggcgccaccaggcaggccgtcgtgcccaggccgcccaccgtttccatggtcgtacgcgcctccgtctacgccgatgagctcgtgaagaccgcgaaaacgatcgcgtcgccggggcggggcatcctggcgatggacgagtcgaacgcgacgtgcgggaagcggctggcgtccatcaggctggagaacacggaggccaacccgtaggcgtaccgcacgctgttggtcac

SEQ ID NO: 23879 - DNA, 440 bp, Zea mays
  Clone ID: cC-zmle189053g10a1
aatattacacgctgggctgtctccattttcatttggacgactcaatattaaaagaagggtataacaatttttttttttttgaaaaaactacacaagttacattataaacactagtctgttctacatgagcacgaaaaaaaatgaaacggtattatgccaaacatttgaccatataaggtccttctagctcataacccaatttgcggtagtagtggcgagtaccaacccccgaaatgacagccaatttctctgaacggtgctccttttgagcaatcctttctgcttcttccattaacagagttccatacccctggtgctgtagcttgtctacatcacggccatgcacagggactgcagttccatagacatgaagctcacgaacaattgaacacctccctacaagttcagggcatgtaacattacggccacatttacgcaag

SEQ ID NO: 23880 - DNA, 622 bp, Zea mays
  Clone ID: cC-zmle189053g10d1
gcctacggtggcaagaattctgtctatggttccaccatggacacgagtgtatcgggtccatagagatattcctatgcctcttgtcagttgtggtgttgagaaaggtaaccttcgtgagctagctttggctcgaatggatgatctgggcctaaaatgccgagatgtcagaacccgtgaagcagggattcaggatatccatcacaagatcaggcctgatgaagtagagcttgttagacgtgactatgctgcaaatgagggctgggagacgttcctctcttatgaggatacacgacaggatatcctgatcggcctgttgcgcttgcgtaaatgtggccgtaatgttacatgccctgaacttgtagggaggtgttcaattgttcgtgagcttcatgtctatggaactgcaatccctgtgcatggccgtgatgtagacaagctacagcaccagggggtttggaactttgttaatggaagaagcagaaaggattgctcaaaggagccccgttcagagatattggctgtattttcggtggttggtactcgccattactaccgcaactgggttatgacctagaaagaccttatttggtcaaatgttggcataatccggttaatttttttc

SEQ ID NO: 23881 - DNA, 546 bp, Zea mays
  unsure at all n locations
  Clone ID: cC-zmle189053g11d1
ccggatggaaggatccccgatctcatcttctggcacataccgagtacgtcgnatcgccacggaagctccgaaggccaagggggggataaggaagccctgcgtcggctccatcaacgaggaggaagtggcgccgcaggcagctgaatggggcatgatggatgcgctcgccaagaggtcgtcggtgaaggcggtgtttgttgggcacaaccacgggctggactggtgctgcccctacgacggcgaggagcgggagcaggagctgtggctgtgcttcgcacggtacacggggtacgggggatacggtgactggcccataggagcgaggatccttgaggtcacggaggagccattctcagccgtgtcatggatacggatggagaacgggaccaggcacagagacggtacactaacctcctgaattcatctgtctgcttgattctcttgttcaatgtacagtatagaggatatttctttatattataaacaacggattttaatataactacacccaaaataaaagcaccggaggacattttattatggccc

SEQ ID NO: 23882 - DNA, 464 bp, Zea mays
  Clone ID: cC-zmle189053g12a1
gtacgtaagctggatccttaatcggccgccttttttttttttttttatttcccaaggaaactttacgggaggtacacattaaatacaaggcttctcaaatgagagaacattctactgtcataaggcaagaaaactacatctaagtcaaattcaagcatgcatgtatgctccactgctccagaacgctacttcgggttatactatgtgcgccatcaattattcactcaagacaaagaggcaatttacaaaaaaccaacaaagtggttgaaaactaatataaccagtttagggtgttgtcatccacaattccttgatttattaagaaattattcctgctgatttctcaagatatttactttaatacctgaaaattctgcatttttgacacatcagtcaaaatccttggcccagatctttttctttgggtaatgaacacctgactttattttttaaaaactttttga

SEQ ID NO: 23883 - DNA, 186 bp, Zea mays
  Clone ID: cC-zmle189054a01a1
acctaaagagggcaattctttattattaaataaaattgcagttcaatgacgggacacgtgacaaactattaaccgaccgacgcactgaacgactgaatgaaaaaaaagcaggccgccgacgccgacgccgacaaccaccactttttttttattaaaggcaagccggacccgtgggcggacccctgg

SEQ ID NO: 23884 - DNA, 194 bp, Zea mays
  Clone ID: cC-zmle189054a01d1
tgggttgacccacccgtccgcccacgcgtccggcttgcctttaataaattgagagtggtggtcttggtgtctgcgtcagcggcctgcttcttggtcagtcagtcgttcagtgcgtcggtcggttgatagtctgtcacgtgtcccgtcattgaactgcaattttatttaataataaagtattgttatttttaggt

SEQ ID NO: 23885 - DNA, 335 bp, Zea mays
  Clone ID: cC-zmle189054a03a1
ttttttttttttcttttttttttttttttttttttttggtgtgttttttttaaaattttttattcctttttttctatttattttttccccaccccccccccacccctgaagtccacccgaaaaatccaacccggaccccgagggggaaaaaattttccaaaaaaaaagccaaaaaaaaatggggccaaaaaaaggaaaaaaatatcccccggggaaaaatttaaaaccaacaaaattcccaaaaaaaaaaaaaccaaaaaaaaaaagggaaaacccgggggggccaaagggggggccaaacaaaaaaaaaaaggctgggataacaagcccaatcc

SEQ ID NO: 23886 - DNA, 454 bp, Zea mays
  Clone ID: cC-zmle189054a04a1
ttttgactagatttatgggattctcccatcttgtagcggtatggatatacttcaaatctctcacaaccctctttctccaaaatttctgatgttccacatctcctagggcgtgtacaagggctggagaaattttagcgttcatgtccgaatttaagcatacaaatagtgagatctaatcaaaatgcaaattacgaaaagaggactagcacagtagctagctagcgccgcctgcaagaacaaatcttcgatccgtcccattcaaattcaggcaggcggtcaagaggcttcctggaactccaccaccaccacgggtttttcctccttgccgcccgcgtcggcgccggggagcagccgccgcaccgctgcgatgagccgctcggacgtggccggcgtccggcgcccgccgagcgcgtggcataaggcggcgtgccccgcgatcgctgcctcgagcttc

SEQ ID NO: 23887 - DNA, 495 bp, Zea mays
  Clone ID: cC-zmle189054a05a1
actagcatagttaccacagcaggcgcaagttatctcattacccaaggcaatggtaggttaatgttggactagaactcggatcctagagatggatcggagaatgcacaaggaacagaagaacatacgtccccgataacagtttcatgggcaacaccacaatcgtctgcatttagccagtaacgccgaacatttcatcccatggcgtacttctgggtccagctgcgggctgtcgcctcgtacttaggccgatccgtcttgtacatgtgagcaatctcagggacaagagggtcgtctgggttgggatcagtaagcagggagcagatagaaagcaaaaccttagagattgtcaaagcagggctccactgctccttaagaatgtcaagacatatgcttccattactattgatgtttggatggaagaccttcgtcttaaaagatacctttggaggctcgaaggggtagtctggcgggaaatgaatgttcaccaagaaaaca

SEQ ID NO: 23888 - DNA, 543 bp, Zea mays
  unsure at all n locations
  Clone ID: cC-zmle189054a05d1
gggcgacccacccgtncgagtccatatgctggaggtgttttcttggtgaacattcatttcctgtcagactaccccttcaagcctccagaggggtcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcacatgtacaagacggatcggcctaagtacgaggcgacagcccgcagctggacccagaagtacgccatgggatgaaatgttcggcgttactggctaaatgcagacgattgtggtgttgcccatgaaactgttatcggggacgtatgttcttctgttccttgtgcattctccgatccatctctaggatccgagttctagtccaacattaacctaccattgccttgggtaatgagatgacttgtgcttgctgtggtaactatgctagtgttgatgtaaaaa

SEQ ID NO: 23889 - DNA, 495 bp, Zea mays
  Clone ID: cC-zmle189054a06a1
attaatttatttatttaccgaaaaaatttttgggaacgaaaatttaaaaaaccaaccgcgaaaaaaaacaaaaaaaaatatattattttactaagttcgaaaaaaaaaaaaaactaaatttattcaaaaaaaaaaaaaaaaaacctaaagaaaaaaaaataaaaaccaaaaattcccccacccaaaaacctaaaaaaaaaaaaaccccccatttcttaaaaaaaaagaaaaacccccaaatagaaaaaaaaaacccccaaaacaaaaaaattaaaaaaaaataaaaggaaaaaaaaaaaactcctcaaaaaccctcaaaaaaaaaaaaccaccccaaaactcttggtctttaaaaaaaaacccccaaaaaatttcccccaccccccccccctttaataaaaaaagactaataaagacctcccaaaaaaaaacaacccccccacatagaaaaaaaattttcctccccaaacaaaaaaaaaaaataaatatgcctac

SEQ ID NO: 23890 - DNA, 110 bp, Zea mays
  Clone ID: cC-zmle189054a06d1
gcatacatgcaaagactaccttgagaaacagcagggcgaagtggcagaacaatattagggagctgcttcaaccagacccacgacgtgcaccggaaatcctcacaatgacc

SEQ ID NO: 23891 - DNA, 450 bp, Zea mays
  Clone ID: cC-zmle189054a07a1
gaaaggccccctatttcagaaaggggccttttaatacaccagaaactttattcctccaaagaattgggctggaacaacaacacaaaataaggagccaaatcatggacgtatttattctaaggaggatacaaagagtaatatagccgttacaacagtttctgggtgttcatatcctgatcgctctactgtactggacatataaaccctggggacaaaaaagaacaaatttcatcttagctcacttggagagattgtccttccaattgcacttggttctccaattgaaactgatgctaaagatttggaagcccaaacggtagcgttcattgcgccctcctgcagatttcctcgctttgaacttgaagggtatagcctatgaaacttctgtcttgcttgctcaaggtaggtgaggaaatattcatgtgctcccatcaattttgcaaacatatt

SEQ ID NO: 23892 - DNA, 569 bp, Zea mays
  Clone ID: cC-zmle189054a07d1
agggccgttcgcttaaggcactaaggagtgcccattcttaagtaatgcggccgccgggtgtatacgctggatgagtaatttccaaatatccggcgcgttctcatactgaggaatcggcaattaggccaagcataattgctagatacggcatccatggtatcccaacactctatctcttgaactcgaccatgagagtacgatatcatggaccaaggactgttaaatcacttgcagctttctacactgatgtctcaggtatcaatgcatccgtgaagtcaactgcaggggaggccatggtacatcccttggatgatattgagcataaaaaggacgctgaacaggaaaattgcccattctggtgggctcggtcaccagagaatatacttcagcaggatacttatctagcattggcgaccgtatttgtaattttgaggttgctgtatcgtattttcccaaagatagattcccttaccagatgggcatggaggaggcacaatatgtttgcaaaattgatgggagcacatgaatatgtcctcacctaccctgagcaagcaagacttaagtttcat

SEQ ID NO: 23893 - DNA, 356 bp, Zea mays
  Clone ID: cC-zmle189054a08a1
catcactcctctacaacaaaactatacaggcccccccggtatcaaaataccaaacatcacccatggagaatgatgagacgcctcaaaccagataggaacgccacgcacaaccataagggacccgagcccggaaattctatcacattcacaaactgaagcggtcattcacaccaaacaaccttaaacacctcttatggcctgactatttgaatgaatccggaacacctacgggcttaaaaaaaggcgccgcgatacagaacttgagcatattgtacataagacaagaccgctctggatgaaggaaaactcgaccttagcatttgggcaaaaacagcctacccaccctgctttggggg

SEQ ID NO: 23894 - DNA, 422 bp, Zea mays
  Clone ID: cC-zmle189054a09a1
ttttaaataaagaccaacaacaaattttatagggatttgttttaaaatattaaatttgtcctgacagttcggattaccactttcatcaaacgcagagacgaaactccgcaactccgccgacgaactaataaccaaaataatcctcaaggagtgacagccatgacaggctcagcaggtgcaacatcaacataatagctctaacatcaacataggagcggacaaacaacgacacaatgcaactgctgatttaacaccagagcacaagataactgaccaaacctcggtattttcgatgactactaatctagatccagcagtgctgttgtttcactgctagtgctaaaactgcgcagggctacataagcgtgtaacacctgtacgagctaaattgggcgttatgtcactacagagcaaccttatca

SEQ ID NO: 23895 - DNA, 465 bp, Zea mays
  unsure at all n locations
  Clone ID: cC-zmle189054a09d1
aatgatgatagatactcggtggntgttagatactggncacggtacatttcatgaggcgcaggccgcaggcgaaggatctcataagcttagacggctgaaggtgatagtgccctgttaggtgttattaaggtggggtctgggtcgaggatggggttgcacggcagttggtagtattcacctatatgcttccttcatctcttaggcgtaggatttaaacctttttaaaaacagcatcatttgcatccacagtacctgttctgagctggcggtgggcactctgccatagcagtaacatacgtcctaaccccaaaccagatgtcaaatatttgtagggtaccatgcatcttacatacccttgcatacttatttccttctgtcctctagccaactggctctaactattctcgctttctggtgctctgcaaagaacaccattatctcctcagcagctcttctgtttttttt

SEQ ID NO: 23896 - DNA, 486 bp, Zea mays
  Clone ID: cC-zmle189054a11a1
attcgaggaaaaccctctttcatcgatttggtcatttaatatggtatgacacagcccatcctctacgaaggcggcatagtctcaaagctatgcgcaacctccttttcccaccccaaccgatccttgcagtaaatctccgccgcaggcttgaactccggctacagcaagcccgtgcgcagcacgatcttgtcgtcgcccatggcctcctgcgcgtggtacacgtgtgcggagcagttcttgcaggaaaagcagggaacgcccttgcccgaatcgcccttgtacgtgtacttcccgagatcctcgccctgggtgatcttcaagttcgccttggggatgaactggttgagggagaatgtgccgccggagagctgcttgcaggtgttgcagaggcagaggatgtgcgactgctggtcctgctcaagcttagcagtccacttggtgttgccgcaatggcactctccctggaaggctgccatgatgcggacg

SEQ ID NO: 23897 - DNA, 492 bp, Zea mays
  Clone ID: cC-zmle189054a11d1
tccgcagtatgacaaacttccagggaaagtgccattgcggcaacatctagtgtactgcgaagctcgagcaagaccaggggccggtcatcctctgccactgcaacacctgcaaccacctatacggcggcacatacaccctcaaccagatcatccccaaggcgaacttgaagatcacccagggcgaggatctcgggaagtacacctacaagggcgattcgagcaagggcgttcactgcttctactgcaagaactgcaccgcacacgtgtaccacgcgcaggaggccatgggcgacgacaagatcgtgctgcggacgggcttgctggaggcagagttcaagcctgccgccgagatttactgcaaggatctgttggggttggagaaggaggtagcgcatagctatcagactatgccagcttcgccgaggatgggctgtgacataccatattgaatgaaaaaatccatgaaagagcggttacctcgagaaaaaaata

SEQ ID NO: 23898 - DNA, 287 bp, Zea mays
  Clone ID: cC-zmle189054a12a1
ctgtggggtaaattttgtctcatatacataaatctttttactagggtacaaagaatgtcatcctggacagactcaacgcaaggcaggggaaaaaaaggaaaactttgcagtcttgtacaacacttgatatcataagacgtcacattccagttgaagatgttcttcctattctttgagcaccaagttttggttgcgctggctttgttcctcggcccctacctgacgaggctaagggtctggctttggttgctggtggaggtgctgcgatggcaccccataagtcgtca

SEQ ID NO: 23899 - DNA, 298 bp, Zea mays
  Clone ID: cC-zmle189054a12d1
tctgaccacggcccgccacttatggggtgccatcgcagcttttccatcagcaacctaagatgcttccttagcctcgacaggtaggggccgaggatcattttcagcgcaaccaaaacttggtgctcaaagaataggaagaacatcttcaactggaatgtgacgtcttatgatatcaagtgttgtacaagactgcaaagttttcctttttttcccctgccttgcgttgagtctgtccaggatgacattctttgtaaactagtaaaaagatttatgtatatgagtacagttttgaccaaaa

SEQ ID NO: 23900 - DNA, 335 bp, Zea mays
  Clone ID: cC-zmle189054b01a1
aaaagaccctcgcggggcactcgacagaatatgaatcatttcaccatgaacatccaagggacgaaccctactttggctttgctatcgaatctaaaaaagcacttacgtacacgttattgggtgcacccttattggccacctactacttaccatttttctaatggcattgaagggacgggcattgtacatcccatccataacacatttggcccgcttcaacccacctggatagtgcttaaaaaaatatccctaacctcctgtagtcgaagataaatgcaccaaaaaaaaccaccttttagaaaccgcccacgaacccccccccaacactacccaaa

SEQ ID NO: 23901 - DNA, 401 bp, Zea mays
  Clone ID: cC-zmle189054b01d1
cattgtgaatctttttcaatgaagccatttcgtttctttctatgggtacattacgtctgagcggggttcgtctcgaggaccgctctggatactgggggacgtcttgatgggagcttacctcacggttgtcgacttcggcaacgacaggattggcttcgcggaatctgtatgagtgtggagagcactctcatctttataaagacgataccctatgttttagggatgtgtagaatactgtctatacactacatgccaacaggacgctgcaaataaatcggtggccaaaattgctgataccagaaacgtgaacagtactgctttctttgtttctggagaagagcaaatggatgacttaagacatgcatgtccgatgtgtattgagaaatagagcgactagtgct

SEQ ID NO: 23902 - DNA, 375 bp, Zea mays
  Clone ID: cC-zmle189054b02a1
ggcatcggacgccgcccggtttccttgagagctcgtgggacttcgcgcagtcgctgggggacacgtacgagctcgtcgccgtggcgcggaggctcgagtccgtcctcgacgtcgccggccacgacgccgccgccgccgcgccgcaggagggcggcgcgcggggagcggggacgcggcgcagggagagcgcccgcagcctgaggaacctgttgcttcgctccacgtcaaggaggttccaggaaccaagcagctagcgtgctctcacctctcagtcactgtatatggctaaatgttatcatgagatttaagagaaaaaaaacttcgcagttcacaaggttattttttttctttctcccacacctaaatttctaaacc

SEQ ID NO: 23903 - DNA, 375 bp, Zea mays
  Clone ID: cC-zmle189054b02d1
atttttacctattcaattttttaggggggggtttaataaactatcccgtcctcgccaccccaaagggttaaaaaaactgggggggggcaaagaaaaaaaaaacccccgtgaaccgggaaatttttttttttttaaaagtcatgataacctttaaccatataccgggaccgggaggggaaagccccctacctgtttggcccccggaacccccttgacggggagcaaaaaaacaggttcccttaggtgggggggctttccctgggccgggaacccgttccccgggcggccccctcttggggggaggaggggggggatacctggccctccacatcaaagacggactttagccttccggccacggtaaaaagatttttt

SEQ ID NO: 23904 - DNA, 386 bp, Zea mays
  Clone ID: cC-zmle189054b03a1
gtcaacaagcgttttctttatttccatcttacctttttctcatcaattctctgatagcacgcgccaagctaacacacaaccaacctaccccgtactacatattaggcgtcctaattaatcatcgtcaacaacaacaaaaaaatactatggtagtagtagagtagccctaattaaccactctagctccgcacttccctacgagctacgctgctgcgacatggagtatatagatagtacgtcaccatgggagtacacagtacagcaactgtgtttgtttcttgcaagcctacgccactccagtactgaacaagacaatctcgatcttccctacttcaacatctactgcggcgcttcgtcggcggctggccagcggcggtggcgtaaca

SEQ ID NO: 23905 - DNA, 198 bp, Zea mays
  Clone ID: cC-zmle189054b03d1
acacagacaaagcctacagcgggaagctcgggagcaccgacggctcgccggccgagcggccgtcgtccgacgcgacccaagacttcttcaggcacggcccggagatccaccagagagccgtgccggagctcccgtccccgcccacggcctcggggctccactggcagggcggaccccgccacggcgcggacaccacca

SEQ ID NO: 23906 - DNA, 433 bp, Zea mays
  Clone ID: cC-zmle189054b04a1
atatcaaagctcaggtaatttcagcagtcttgtatatttacatgacgggaaaccaagataaatatatactgtaaatcgcttaacacacgtactccattgttctaactacctaatattctgtttctaccgaaagagttaaaagtcctatatgcatgcctatctggtctatttaatagagtaaaaataacaagttaaaaataacatggacaaggggagctgacgaccatggaaaggccaaggaaggatggacgggggagcaagactacaaacgccttggtcctctcatcaaagccacagcgcgccggcgtccttgagtatgggcacgaggtccccggaaatgtgcacggccatgaaccggtcgaggccgccgaggagcctgcccccgacgaacacggccgggagggcaacgtccccgccgccgttgacgaccccg

SEQ ID NO: 23907 - DNA, 482 bp, Zea mays
  Clone ID: cC-zmle189054b04d1
gacgggcggcggcggactgcgggcgcggttgtgtgtttggaagcgcgggcgctgcctcagccacgtggtgaagcggctgctgcagggtctcggggtcaaccccgccgtgcacgaggtcgccgacggcgccgaggcgaagcttattgccggggtcgtcgacggcggcggcgacgttgccctcccggccgtgttcgtcgggggcaggctcctcggcggcctcgaccggctcatggccgagcacatatccggcgacctcgtgcccatactcaaggacgccggcgcgctgtggctctgatgagaggaccaaagcgttcgtagtctcgcttccccgtccattcttccttggcctctccatcgtcgtcagcgccccttgtccatgttatgtttaacttgttatttttactctattaaatagaccagataggcatgcatataggacttttaactctttcggtagaaacagaatattatggagttagaac

SEQ ID NO: 23908 - DNA, 497 bp, Zea mays
  Clone ID: cC-zmle189054b05a1
ttttgtctatctttgtgggaaaaacgatttcatttggggatcggttcactttaatgcatcgatcctgaacaacgtaactatacttgcaccccccatatcggattaccaatcatcaccgatggagaataatgagatgcatcataccagaaaggaatgcaacgcacaaccaaaagggagccgagccccgatatcataacacattcacaagctgaagcggttagtcagaccaaacgtccttgaatatcttttatggcctgaatattttcatcattctggccacctgcgtccggcaaaatgggcaccgcgaaaccgaacttgagcatcggttacatacgacatgaccgcatggtatgagggtcatgttgacctcaccattcaggcagatacggcatgcccatgctgctgtggcgacatcagactcttttacagccgcctgcgacttctcctgctccaccaagagagcaacttgagagtctttaagctgcggacgcgtgggt

SEQ ID NO: 23909 - DNA, 125 bp, Zea mays
  Clone ID: cC-zmle189054b06d1
aaccgcacaacaaagcacacacccgaccccaatacaaagaatttcatcacaaacaaccagaaaacaacaagaggagcggtcctataaaaaccacccacccccaaaaaaacaaggacgaaccaaac

SEQ ID NO: 23910 - DNA, 415 bp, Zea mays
  Clone ID: cC-zmle189054b07a1
atcggccccaatatagttaaatctgggcggggctattcatgtagattaatttgaagtttaatcaaacctgtaattcataaaactatactactatgtagcaacagctgggtgtgaaatttaactttacattctgagagagtactatgtagcaacgctttgttcgttcgtctgcccactcgttgtcgctggccttgtttgcgatatcctccccttacattgttctcagatcctagatgggatgagcggcgtggagtttgacaggtacgccgccgcggctgccacgccgctacctagtttcactgggtaccccacatccttgagcaccatctccacaccgctcagacatcccagaagttgcagctcgttgaggttgccgagatggccgatcctgaagaccttcccggcgaccttgttg

SEQ ID NO: 23911 - DNA, 456 bp, Zea mays
  Clone ID: cC-zmle189054b07d1
gagaccgacgcgtgggagggcgtcgcttaccaacacgctgcccccgggcgacagggtcgtgtccttcttcatcgggcaagtcagcctgctgtggatcgaccagcagcggcgcctgggcttcgacgtggacgcggtggagagcgagtggggccagggcgccgacctggccgcgctggagcgcaggctccgcgaggacgcgccgcggcacgccttcaaggccgtggccatcgtgcacaacgagacggccacgggcgtcaccaacgacctggccgccgtgcgcgcgctgctggacaagcacgcgcacccggcgctgctgctggtggacggcgtgtcgtccatctgcgcgctggactttcgcatggacgagtgtggcgtggacgtggcgctcacgggcttccagaaggcgctgtcgatgccgacggggatgggcatcgtgtgcgccagccccagggcgct

SEQ ID NO: 23912 - DNA, 240 bp, Zea mays
  Clone ID: cC-zmle189054b08a1
cgaaccccccaaaaggccgctttttttttattaccccaaaggccccgccccccggacgagcaaaacaaaaagcgccgcaaccaaacaaacacggcaaaaaccccacaggacaaaaaagaaaccaagagaggaacccccggaaacccccgcgggctctatcctgataccaccatgccgattaccggacacccgaacgccttactccctacaggaagcaacgcgcctcctcatagctcacgc

SEQ ID NO: 23913 - DNA, 423 bp, Zea mays
  Clone ID: cC-zmle189054b08d1
ccgccaaacaagaccaaaaacacagcaaaaccttagtatagaacacacacaaaaacccgccgagcgaccgcgagcattacacaaaccccgcccgcccaccccaaaaacaccatcaagagcacacagcaccccacaaccagcccacaagaaaccaaagcccacccacccacaacacacccaacccccaccgcaaacccccacaagacagccacaccaccccacggagagaccccccaaaaacccaccaccccacccgcacacccccccccaaacaacacacgcccgacaacaacgacaaaaaaccaaaccacacacaatccgcaccccaccccaaaaaaacaaaccccccccccgcccccacccctaaccccccacaaaacacccccacaaccaagccaaaacacacccaccacccaaacccac

SEQ ID NO: 23914 - DNA, 380 bp, Zea mays
  Clone ID: cC-zmle189054b09a1
atgtttatcattcacaaaggcatttgtatttagcgcaggggggcctttcggccttgcacctcacttttcttctttatgcaagcaggcttataagtacagctattgtcaataagtaagatatacaagcacaacttttcaaaataagacgtagggcatttctaacgaaatgcacgaaccactaccgggataccgggtttttggtctgtgaaggcgcttttatcgaaccagactgttctatgcatctattgtgaacttatacaattacaataaagacagatgaaattaaaaacattgatgtgcttggctttcaactgcccctttagaatagcacatgtcatggaacatgcgacaggaaacctccttgacttaagacgccgcct

SEQ ID NO: 23915 - DNA, 395 bp, Zea mays
  unsure at all n locations
  Clone ID: cC-zmle189054b09d1
acgcgtccacacgtctctcctctttttctcctctcctgcttcagttctacacggacnctgacccccacaagtgaagggtttaattgagcgccccctcctcgtcgacctcctcgacgaggagctcctgatcccgctcgcccgcgcggactcatcctaatccccgcccgacaccaccgcgtacgaagagctccgcctacgaggcttcccgcgcgggctgctcccgaccaacgagcgggcctacacgctcaactccagctccggggacttcgtcgtcgacctccgatccagctgccggatcgtgctgaccgcggcgagctacctcaccaccttcagtgaccgcctaaagggccggctcgacgaccgacggatctagggcctagacagcatacgcgtca

SEQ ID NO: 23916 - DNA, 511 bp, Zea mays
  Clone ID: cC-zmle189054b10a1
gggcgaggcgtctttctcgttcaggtggtccaccgcggcagggctggggagggcgactatggtatcggacgacgcagccgtcgtgtccccggggctgagcccctgggcggcgccgcagtcagggtcgcccgccgccacggcggcgccggcgaggtcctcggggctgtacttggaggggtcagcgtcgcggccggtgagctcttggacgagggcgcggaaaccagcggcgctagtcttgacgcgcacggggttggagatgtacaccactttgatgggtttcttgcccccgcccttgtgcttcctcgacgaggagccgcaccttccgctcccaggagcattgcctctgggactgtgctgctgccgctggcgccgctgctcgtggtccatcgatcagctcagctctgcgagcggaggaggagcaccgagacggagaggagcttgaagcgggtgatcggaatgcgagggtggaggcaaggtgctacgtctggcttccggcctgcaaggacaaaca

SEQ ID NO: 23917 - DNA, 132 bp, Zea mays
  Clone ID: cC-zmle189054b11a1
atgatatggggtttattcacacagaaacacgggacaaacatataaatctgtactgtacaccacaggcaacatcgatccctgatatagtagcatgcagcagcttgacgctgagtcagatgatggtgttgtacc

SEQ ID NO: 23918 - DNA, 293 bp, Zea mays
  unsure at all n locations
  Clone ID: cC-zmle189054b11d1
caacaccatcatcagactcagcgtttagctgctgcatgttactatattaaggagcgangccgcctgnggggggcagttcaaattaagaagccggnccacgccanctgtaagacataacctaaatataataaaaaactattatacataaaaaaatgacaccaaaaaacaacggccatactctctaaaggaaccaactttacgtacgcagacatatctacatctgacacattctaatacagtgacacaaaatccaattcacataaccgccgtaatacaacagccagaataacaga

SEQ ID NO: 23919 - DNA, 266 bp, Zea mays
  Clone ID: cC-zmle189054b12a1
atagtttctattttttaacgccaaaaggtaattcaacaggggaggggtttttttttatgtggtccaacaaaaaaccacccgcggttctcgttttattggtttctttcccgcacgccgtggggcaaacccgctatgccgacccgatgcctagaggggcacctcttttccctattaggggttgattttggacttggcgtaaacaaggccaatcatgacacccgtgcgaaactgcttttcggttacaattgcccacaaaatcccccccg

SEQ ID NO: 23920 - DNA, 227 bp, Zea mays
  unsure at all n locations
  Clone ID: cC-zmle189054b12d1
gggaaaagaatcaatagagggagaatcggtcgatatccncntcgtaacttatcaaaaaaaaaaaaaaaaaaaaagggaagggtattaattaagaagagcggacggaaacaaaaacaaggggcggccgcaaaaaaggaaccaagccaacggccgccagccaccaaagacagaacccttcaagagggccaccaaaanaaaaaccacgggccgaccntngacaacacaga

SEQ ID NO: 23921 - DNA, 505 bp, Zea mays
  Clone ID: cC-zmle189054c01a1
gacagcgagaatagctgtgacgtctccaagatagcagtgttaaatacaaaaaaaacctacgcgtctctacaatccatacatcaatctccaactttatacatgaagattgagagccacaaatcagatgtatccttatgtgataagctgcgggaacagaccaacctaatgcatttcgatctcctgcacaggaacggggttctggtctgattggcgggcattagaagtaccagacgagctcactatcttagatttgcacagagggcaaagtgcatttatcttgagccatttatcaacacagtccttgtggaaacagtgtgcacatggaagttcacggagctcatcattgtgcgcatattttgcaagacagatgcagcaaactgcgttttcagcagagagtgatcgctccttgtcagtttctgcagccaaaatccctccttcctggccttcagattcactgcctgaaccatggcgacgtttcttgattttgaattatattggggcaaag

SEQ ID NO: 23922 - DNA, 335 bp, Zea mays
  Clone ID: cC-zmle189054c01d1
cgggccacaccaacccaacaccttttcttcctccgctctcagctcttcctactacaggcgagggaggcgactccttggtcggggctacccgatccggccccgaccgcatctcctttgcacgccacggaccgcgcgcagtgtccaccggcacggtcgtcctccgagtgtgggggcgcatctggtgctagcttgccgggctagggattggcttggcctcgactaccgccccgtctcgtctgataggcacaggttccgtgcacgcgatcgatcgctctccatccggtgtgactgatagccgtcccccgcttgctttgtcctgctacaggagggccact

SEQ ID NO: 23923 - DNA, 345 bp, Zea mays
  Clone ID: cC-zmle189054c02a1
tttctattttgtatttcagcagacactatatataaaatttgcggggggccacacagaaacacagatcacgacatataaaacagcactggacaccacaagcaacacttatacatcacaaaatagcgcggggaaattagactctgcatcataaaaaggaattgcaccctgaccctttggtcgatcgggaaataacagaccacgtgcctgccggcgctacaatattcccctccgacagttgtcttacagcctggccgatacgtgctaacagctgcatcctacgttagatcgtcattctttcacacctacacacaacatacaagccggcagcataaagctgtgaagcct

SEQ ID NO: 23924 - DNA, 147 bp, Zea mays
  Clone ID: cC-zmle189054c02d1
aagaattaacagaaaagtttttttttttagtggacgttgtaaaatcaaagaggggggcgttaaaaaactctccagtccctaataaaacttgagagaaattgatataataatggttgaaattttaagaggcatattataaatagaaat

SEQ ID NO: 23925 - DNA, 487 bp, Zea mays
  Clone ID: cC-zmle189054c03d1
aattatactttttattttgattttactcatttttttttttgaaaatttcagctaaaaaaatgagcttttatttttaaattaccgtatcccaacaaattaatcttaaaaaattatactttttttttatttttttttaactttttcatacttttaatttccatctttcctttttttatattttttattttttttttctattattatttttttattattttttttatcttttaattattttcttttttttatttttttttttttttttaatactttcttttttttcattctttcttctttttcttttcaattctctattcttttttttcttttcctttctaactttcttcttttttcttctttttacttaaattctatatcttttctttttttttaaaaattatctttttttttataatttatttacttattttttttcttcaatttcattactttttatttatatcctaactaaatctttttttccttt

SEQ ID NO: 23926 - DNA, 345 bp, Zea mays
  Clone ID: cC-zmle189054c04a1
ggggggaaaagaaaaaaacccctgttttttggtacatgacaaagggggaacctccctgggggcttaattataaacaaaccccctgattttacaagacaaaacccaaaaagcccatgcattggatattcttaacccgaaagggcccttgtgtttaaaacaaagagggcccccccccccaggatcccagagagggggacggcccaaaaaaaaaacccagggggtccccccaccaaaaccttcccggggggaaaccaaaaaatcttcttgaaaaatgggctttattcctccacattccccccgaacttgtgaaaaaaatgggacaaccccttgcccttggcctttttt

SEQ ID NO: 23927 - DNA, 402 bp, Zea mays
  Clone ID: cC-zmle189054c05a1
gacaacgaacacaattattcctgggcgagtgaacaatagtttacattatggaacaaaccgaaaaccagcgtgcgctcacatgcattcggacacctaaaggtcaccggcggcgcctccctcacttgccggggacaaaattggtggcgtaagcccaagcgttgttgttgacggggtcggcaatgtggtcagcgaggttctcgagcgggcccttcccggtgactatggcctggacgaaaaatcctaacatggagaacatggcgaggcggccgttcttgagctccttgaccttgagctcggcaaaggccttggggtcgtcggcgaggcctagcggatcgaacctgccgccggggtagagcggggagactaccttgacgagcgggccgccggcgatgcggtagccct

SEQ ID NO: 23928 - DNA, 603 bp, Zea mays
  unsure at all n locations
  Clone ID: cC-zmle189054c05d1
ggaanaatcgggacgacccacccgtccgcgtgcgccttcggcgaggcccgtgtgactatgcgcaagtattgtgtgaatgccaagccggcggcggcgggcgggagcccttggtacggccccgaccgcgtgctgtacctgggcccactgtccggcgagccggcgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggaaggttcgacccgctcggcctcgccgacgaccccgaggccttcgccgagctcagggtaaggagc

SEQ ID NO: 23929 - DNA, 392 bp, Zea mays
  Clone ID: cC-zmle189054c07a1
ggggggagggccggggtttttttactaaaaagggtacaacggggggggacagggtcaataccccaacaaccccgggatattgaaacaatcccttttgaggaacccgggggggatccctccaccttctttgggcaaaggcccctttcccgcttctttagtgacaacccaaaaaatcccccttgcagacaccaccaagtttccaaaaacttactccaatgtgttgacaacgggcatttttattccccggcggcccaaaacccaaaaacttattcggcttcaaagaccctttccttggacaagggaccctccccaacctgtttttggccgatgcgccaccaacccaaaccttgtgggcccccttttccggggtaaaaatggaaaacccaaacttt

SEQ ID NO: 23930 - DNA, 551 bp, Zea mays
  unsure at all n locations
  Clone ID: cC-zmle189054c08a1
caccttggattctgtacacgcggccgccctctttctttttttttttttcatcatatttagcanacncaccacagcagggacaagggttattattacccaaggcaatggtaggttaatgttggactaaaactcggatcctagagatggatcggagaatgcacaaggaacagaagaacattcgtccccgataacagtttcatgggcaacaccacaatcgtctgcatttagccagtaacgccgaacatttcatcccatggcgtacttttgggtccagctgcgggctgtcgcctcgtacttaggccgatccgtcttgtacatgtgagcaatctcaaggacaagagggtcgtctgggttgggatcagtaagcagggagcatatataaagcaaaaccttaaagattgtcaaagcagggctccactgctccttaagaatgtcaagacatatgctttcattactattgatggttggaaggaagacctttcttttaaaagaaacctttggaggcttgaaggggtagtctggccggaaatgaattgttaccaaaaaacacc

SEQ ID NO: 23931 - DNA, 433 bp, Zea mays
  Clone ID: cC-zmle189054c09a1
ttttaaatcttatttaggcattgaactgcgcaggactggtgtattttgcgactacaatccaaaaccatccaaaccagcatatacatttgacgagtcttacagcgagtactaagaaaaagaaagaaaagagcacccaggaaaagagctaacagtacaagccaaagtatcacattcggcacctgatcgatacacatcaaagacagtaacatgaaaagcatatacccatgtcgaccgagtagtagcaacctgcaagcagaagcactttccatgtacagtagcgccagcccgccatgctattgctcacagtgagactgataccccaaccgacttctgaaccgtttgccggggcctcgccgtcacggacagcgccagcgggacggccatcttgcacgacagcttgagcaccttcgacaggtcgacgggcgaggggagc

SEQ ID NO: 23932 - DNA, 450 bp, Zea mays
  Clone ID: cC-zmle189054c09d1
gggttgaaccacccggcgcggggacccggcgcaaaaaaaaccaaacaaaaaaaaaaaaaacccttcagatccaacccacgcacgcaaaaccaaaagacggggtaaaaacaaaaaaaccccaccgcaagccgccgccaacagacgaacagcgcgccggaagcacgcgccagatggacaacgccaccaaggagctgaccgcgagccaaaacaaagcggcgcggcaaccacaaggaccaccgcgaaccgcgcccccgctcccagaacaacaacacgggcacagaagcccgccccgcgacaccaccgggaccagcacccggaccaagagaacccccacacacagaagctgaagcaaacgcaagaacaaaaggtacgacccgccgggccaaatcaactggaccgaccaccgggcgggcctagcgtacccaaaccaacaaaaaaccacagccacga

SEQ ID NO: 23933 - DNA, 197 bp, Zea mays
  unsure at all n locations
  Clone ID: cC-zmle189054c10d1
gggggaaaggcatggagaaggngctccacgacacaacggtttcactggctgacaaagacggaancgacccgcgccagtacaagaagcagccgcggacgggacaccaacggaangnggaggccaaccaaccgcngaaacccgcaccagacaacacgcgacgcgcgcaacagcaagcgaggccagggcgcacagcgcat

SEQ ID NO: 23934 - DNA, 493 bp, Zea mays
  unsure at all n locations
  Clone ID: cC-zmle189054c11a1
acgactcggcccaattttagtgttatataagtaaatattcagaactccagctccaaactaacagaaacaactttgttcgcatcgacaaacttaaacaaaaatgcatgttgcacgactacaggtagcgataaatgccatagcacaaatactgatcgccgcataagatagcactacttcgatgggacgaaactttactcgtcatcctcgtcgtcgtcatctgcgccgcccgaggagttgagttggttgagcctttcaatgagactggccttcctctgctcgtatgtcagtttcttggggttgtacctcttgtgctcctttggtggctgcttggttgacttgaccacagaaggatcagcacggatggcagcatggaccttcttgtacagagcttccatgtcgncagcctcaattcccttcttaatgtactcactgaagtgagactggtacttctctggctcctcttcagcgaggttcctcatgtagtcagcaacat

SEQ ID NO: 23935 - DNA, 527 bp, Zea mays
  unsure at all n locations
  Clone ID: cC-zmle189054c11d1
cacccgtccgcggacgcgtgggcggacgcgtgggcttctctgttgagccagttttangttatgaggcctttccgcgctctcttggaggggggtcttattaggactacaactgggaaccgtgtctttggtgccctcaagggagctttggatggcggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaagaaggccagtctcattgaaaggctcaaaccactcaacttcttcggcggcgc

SEQ ID NO: 23936 - DNA, 428 bp, Zea mays
  Clone ID: cC-zmle189054c12a1
aaatgatatgggatggattcacgttaaggcggttgtgtattggatccgagtgtgtattaaatactattgggccgaataaggccttagctggaacaattccaggggtaatccgatagaaacgaacaagggcttagtctttgttctcatgtacaggcgaaggaacacacaagcgtgctcagccaggcctggcctagccaagctctttacgtagtgcgtgcatcccatcccatcgaagaaacaatattactgcatcatgcgacgctgaaggaggcggcggccttctcgactccctttctggcgcccttgaaccacctcttgtcgccggcctgcgccttgcaaatgtaaagcttgccgtcggagacggtggccgcgatgagctggtgcttgccgcccttgttgccgtccgccgttctggtgagcacggacac

SEQ ID NO: 23937 - DNA, 613 bp, Zea mays
  unsure at all n locations
  Clone ID: cC-zmle189054c12d1
aacacccgtccgcccacgcgtccgggcaggtgctccgctactaggacaacttcgatgccttcagcaacgngtccgtcatcatccaggccaggttcaataagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgtcgccttcttcagcgtcgcatgatgcaggaatattgtttcttcgatgggatgggatgcacgcactacgtagagagcttggctaggccaggcctggctgagcacgcttgtgtgttccttcgactgtacatgagaacaaagactaagacctggttcgcttctatcggattacacctggaattg

SEQ ID NO: 23938 - DNA, 119 bp, Zea mays
  unsure at all n locations
  Clone ID: cC-zmle189054d01a1
ttcttnnnttttctttactcactatctcttcccttccatgggcgcgctttttaaaaaaaacacccccccaacacccccaacaaagcgcacccaaaaacaaaacaaaccaaaaaaccaca

SEQ ID NO: 23939 - DNA, 306 bp, Zea mays
  Clone ID: cC-zmle189054d01d1
tcaaataaaaaacaacacaacaacaccacagctttatctctccaacccacaaaaaagccaaaaagagaggcttacctacaaaagaccaacccaacaacccacccatcaaacccgacccataaccaccacctaaaacccccccccccgacagcccaaagagacggggcaccgccaccattaaaaaacacaccacacagcacctcacaccctacccccgcaagcttaccactcaacgaacccccccaaactaatccccacccaactcacactcccccgcactaaaccacaacaactcccccacacccc

SEQ ID NO: 23940 - DNA, 445 bp, Zea mays
  Clone ID: cC-zmle189054d02a1
agcccgaatttgcattgacaagtacattacatacacgattcctcctttgctctccaaagttttccatggtatacatacaccttcccaagatccatgacggggggcggacacctagcagttagacactcgaatcactcgagctgagcgtaccaaaccccctggatcttgacatccttgggcgccttggccccgaggtcggtgtcggacggctgcacgctctcaaagacgccgatgacctcgccggtctccgggttgctcttggtgacgctcaacgtgatgttgccggtggaggaggcggcgttcttgatgttctccttctggagctcctcctcgtaacctctgcccccggcggggagcgcgacggcgttgtcttatccggtggagccgccgcggcccttggggtcgaggaaggaggagccacggtagctgggcacgaggaagggcc

SEQ ID NO: 23941 - DNA, 274 bp, Zea mays
  Clone ID: cC-zmle189054d03a1
ggacgagagcacaatttgggttgggaaaacattgaacacaatcaaaccgaaaaacatggcataacgctctgaacttgcgacgactcaccaaaaacgaagtgttctcatccggacacacatttccgcgcaacacaatccatgataatgctctaacctacagcgctctcgcccttcttcctctgtaacttcttaatgtagaactcaagctctttaccctcaagggtggacccattagctctggcacaatgcccagggccggaagaaatgcatgcca

SEQ ID NO: 23942 - DNA, 201 bp, Zea mays
  Clone ID: cC-zmle189054d03d1
ttttacaagcacgacaatttcgagggcgcgggttcatttactagccctgacgcgctctatgtatacttgctgagctcttgtactctgaactatcgggtaataaagctccggattagggtactacaatactgtactatctgtttcagatcccggtcggttatctttgatttagacctgttaaaaagtaagattttctttctt

SEQ ID NO: 23943 - DNA, 391 bp, Zea mays
  Clone ID: cC-zmle189054d04a1
tttattaggacatacggagaccacacagttgtgtacaaagaagggacaaaagaaaaaagacaccttgccgcctataaaaaaaacacaactcattgctaaaatggaatctttcaagctaactaaaaagttattttgctccaaactaacagacctaacttaatctggcaccacactcgcatgaatgttgaaacgccacctgattctccttcggaaataacccaatatagatcgctatcaaaatgatggagacaacccctatgtatataaaaaattatcatgccccattgcaaaaaggaaagtgggtagataagacaacctccaccaaaggcaaaaaaaaattccttaaaggaacccacccaccctcacccggggaaaaaaagtaaaccccaag

SEQ ID NO: 23944 - DNA, 524 bp, Zea mays
  Clone ID: cC-zmle189054d05a1
tttttaatagatttttcccaatcaattgctcacagaagactagatgtagttggatgcattatacagacataaaatacagaacatgccacaccttgtgttgtccaagacgaagcacagtgccacagcatggctatacctacacagtgcacaatagctggacacaggaagcaacatggggatccatacaacataaaacctcaaaaccttacagacttatcctttcagtggacacaggaagcatgcctggatggcttgtgcaccctcacctttggtctcttcttgcgtgccagccttcgctccagcaccttgaccttctcacttaggtccgtgatgacccccatctgatcgttgccggacgccagaagcttttgcagaagctctttcagcttctggttctcttctgccagcgtcttttcgtcgctggccttcggatcatcaagagctggggaggcagaagaagccttgttctctgtctgcacagagaggtcttttagggaagctttcgcttcagaggatttgcacct

SEQ ID NO: 23945 - DNA, 413 bp, Zea mays
  unsure at all n locations
  Clone ID: cC-zmle189054d05d1
aactcaaacaaagtcccaggatggtttcatcccatttttctctttgccngacagggggacaccagggaggggactgttgctcggaaagaagccatccattcagatgtcgctgagacagatgaatgcaccaagactcagaaggccgctctagcaggcacagagggagaaaattctgctgaagattctggtgtgccggtgtctgagatggacaaatgcaacgagatgccgaaggatgctccgacacttacagcagcaggtgcaaatcctgctgaagacgaagcttccctgaaagacctctctgtgcatacaaaaaacaaggctttttctgcctccccagctcctgatgatcccaatgccacacgactaaaagacgctggcagaagagaactcacaagctgaaagagcttctgcaa

SEQ ID NO: 23946 - DNA, 444 bp, Zea mays
  Clone ID: cC-zmle189054d06d1
gggggacccacccgtccgcccacgcgtccgcgcttcgcccactcgcttcagccgtttcacctcgccgccaccgccaccgcgaggatggcggggaagaggttcgtggagatcgggcgcgtggccctggtgaactacggggaggactatggccgtctcgatgtcatcgtcgatgtggtcgaccagaacagggcacttgtggatgcccctgatatggtcaggtgccaggagaacttcaagcggctctcacttactgacatcaagattgacatcaaacgtgtccccaagaagacagccctgatcaaggcgatggaggaagctgatgtgaagaccaagtgggagaacagcttatggggcaagaagctgattgtccagaagagggagagcatccctcaatgactttgatagggtcaaagtcatgctgccgaagattaagaggggcggtgc

SEQ ID NO: 23947 - DNA, 424 bp, Zea mays
  Clone ID: cC-zmle189054d07a1
ataacaagtccggttttagtataggatatggtatcaaatcatatcatccgcggaccaaataatatatggctacagcagatgcaattggatcaaccaacatgcacgtagacacacgtacgtacatgagcacaaagactgacgccaaacatgcagagagagatagcaaactgaaaaactctgtttctctctctctcacacacaccacacaatacctatgtatggcagccagctcggcctcccttattattgttcaaccaccaccacaagctagatagataataatcatatccatggtcgtcgatcgatgtgatcagcagttgcaggggtcgcacttgcagttgccaccacacctgcagccgagggcgggctcgcctgactccgccgcggactcaacaaactcgggcgcggccttcttctccggggc

SEQ ID NO: 23948 - DNA, 612 bp, Zea mays
  Clone ID: cC-zmle189054d07d1
cggacccgtgggcggacgcttggtcggacacaagggttgatattcgaagagatcgagcttcttttgcacgcgcagggtcgatgatgacttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgaaaaaaagagaaacagagttctttagttgctatctctctctgcatgttgggcgtcaagctttgtgctcagtacgtacgtgtgcctactgcatgttggttgaaccattggatctgctgaaccatatttaattggccccgaagatatgaattgatccatttatatactaaacccgcctttttt

SEQ ID NO: 23949 - DNA, 363 bp, Zea mays
  unsure at all n locations
  Clone ID: cC-zmle189054d08a1
gcccaacgccacccncgtatggggttaggttttatttttaaatttcaaacaaaccaatatctccaaaatttttgtggcccacatcccacaacaaagcgcacacgggtgaagaaccccccgcttcaaaccacaaaatacgcatccaccccaacagatcgacccaaaaggcaaaccacgaaaacaggaccagccccggagggggctcccgccccctctaaaaacaaatcttctaaccgccccaataaaattaacacaagcggtccccaggctcacaggaactccaccaccaacaccgctttttcctacttgccgcccgcttcaggaccaaagaccagccgcccccacagtgggatcaaccccacg

SEQ ID NO: 23950 - DNA, 358 bp, Zea mays
  Clone ID: cC-zmle189054d08d1
cgcgaataaacgtggctacgtaatctatcgtatgaatacttgtggtattacacgagctgagagtatgatcggggcacgaggacttaaaaaatgtatgccactctgatttacttaaaaaaaaaaaaaaaaaaaaaaaaaaaaccccccaaaaaataaaaaaaaaaaaaaaaaaaaaaaaaaggggcggcccttcaaaaggatccaagctaacaaaacgcggccatccaaccaaaaaaacccaactatatgtgccacctaaatacaattaacttggcccccttatttacaacaccctaaacaagaaaaacacccccccggaacccaactcaaaccaaattgaaaaaaacccccctttccc

SEQ ID NO: 23951 - DNA, 305 bp, Zea mays
  Clone ID: cC-zmle189054d09a1
atcttagaacaccacttcggatggggcgagtgtggtcatacaatatggaactcattttttttttcggcccatgcaaaagcacacatggaaaccaaatttaacgggggcgagaaaaagccccacggatttgtcctgaaacactattacgggtctagcaatgatagcattgcatgtgctactaactctctgaaccgcacactatgttgttcactgcaggggcaagtagcaattgaccattccgccctaggcatagccccactatcagggatagcggtcacaagaactagagcgacgtctgaggaccg

SEQ ID NO: 23952 - DNA, 544 bp, Zea mays
  unsure at all n locations
  Clone ID: cC-zmle189054d09d1
aaagtggcatggtgactgtgtaagcacaangatttaggatcatcatctatcctgaagaatgaggagggttaccttatgaatgatgcagcgggaacaataaatgaaattggggcaacaatccgaagggtgatgggtggaacaagtggaatcttgtatgccatactctgcaaggctgcgtatgcaagcttaaagcagagctcaactgtcactgcgaataaatgggctgatgctttagaggcctccattgctgctgttagcaaatatggtggtgccagcgcaggataccgcacaatgttggatgccctaattcctgcttctgctgttctgaaacagagacttgaggctggggatgatcccgtgacttgcttcattgcgtcttctgaagcagcatcagctggcgctgaatccaccaaacaaatgcaagcgaaggctggacggtcatcatacatcgctccagatctcctggcctcaatccctgatcctggcgcaatggctgcagctgcatggtacagagctgctgcccttgcagagaagaacaaagtgc

SEQ ID NO: 23953 - DNA, 310 bp, Zea mays
  unsure at all n locations
  Clone ID: cC-zmle189054d10a1
acctctacagcccccaccctttttaaactttttttaatatccccccccacaaaancaaaccggggcccgtctaatttaaaaaaaccaacccccaccaaaaacaaacctaaaatacataaaactatactacaatgtaacaacaactgagtgtgacaactaaccttacattccaagagactaccatgaaacaacgctatgaacgcacatccccccactccatgaccatggcccataaacccaaaaccccccctaacaatgatcccaaaccctacatcggatcaacgccccagaacaataacaagtacccccc

SEQ ID NO: 23954 - DNA, 464 bp, Zea mays
  unsure at all n locations
  Clone ID: cC-zmle189054d12a1
ttatttcttttctcttttttattggggctttttttttgagtntgggttttttttaaccaagggcaacacaactnccgggccaaaaaaaaacaaaactagtttggtgatacaggcagcaggccggccctgcctgaatcatgaccgatgcaacgcttcagggtcctttacaacacgcatgcctttagctttccacaaaaaacaactgggggggggggcagcaggtatgctgaagcaccaaccttttaggggaacttgaggctggggaacccctctttgttgacggggtccgcgagggggacaaacaggttctggaacgggcccacccccgggacgagcccccggaagaaaaaacccggggtggggagcatggcgagcccgcccgtcttgaacccctagggactaggcaaaatttattttctttttgggcttgcccaaaacaagcgggttaaaaaagggcccccccg

SEQ ID NO: 23955 - DNA, 333 bp, Zea mays
  Clone ID: cC-zmle189054e01a1
aaataaaaacaaccgaagtcaaaaaaatcaaaaaaacaataaaaacactaaaaacaaaaaaaaaataggagctaaaatattaacaaaaaaaaaaaccctattaaaaaagcgactaaaaagcatactacaaaaacctttattactttctgggaacaataaaatttacaaacacaaaaaaaaacaaaccaacaaccactaaaataaaacccaaaaataataacacaaaaacccaaacaggaaaaaaaaatacaataaaattatataaaaaaaataaaaattcttcttacccccccaaaaacccagaaaaaccctatccaaaaacaaaaagacccc

SEQ ID NO: 23956 - DNA, 348 bp, Zea mays
  Clone ID: cC-zmle189054e01d1
ggaaccacccgtccgcggacgcgtggggaggtgctgctgattttgaagagagtgatgctcccgtcatgtgctactagctagctagtgctgtgggtgtatagagtacagtgtagtctactattaagggttgtcgtttggactgttagtctatagagacagaaaaatgttgaagtacgtattaaagccaatcgaatagacatgtttgtcgccatgtaaaaaaagtataatcctacgtatactcgtacgcaacgatagtaatgcgtgcttgagtgttgtggacactttcgccaacaccttggcttgcgttgccttgcctgccacagaaaaaaatatatatattattatatt

SEQ ID NO: 23957 - DNA, 498 bp, Zea mays
  unsure at all n locations
  Clone ID: cC-zmle189054e02a1
ttttggttcgtaggatcttatttttcccattggcattaaaaatgaataatacaatacaaacactaccctcagtcctctgaaagaggaaaaagattaacaaaaaaagaggggtaaaaaaatgcagtctctactcttgttcatctcctaggtttttacgcctgcatcctgcatctgcatggaccccaggaagcagagctttggtgctcttccctcctctgttctgttccagtttcaggaagcagagccagagggctcggtcacatactacgccacatcggctgctacaacgcgcgggtcacgcgaagaagctcgcgatgtcgtctagatctatgtcgatgagcaggtcgtcgaggctgtcgacggcgggcggcggcgcgatggcggccacgagcgcggacaccactttctggtgctcggcctgcccccgccactcggcggcctcnaacggccggaaggaagcgacgtgggtggagcccgaggtcgcgggcgacacgcccc

SEQ ID NO: 23958 - DNA, 465 bp, Zea mays
  Clone ID: cC-zmle189054e02d1
gggtggacccacccgtccgcgccatcgcggcgtccctcgagagtcgaccacctcgacggccgtccaatattgcaacctatacagggcattctggtctgatggcgacgacggagacgatggagatgggcatgggcgtcgtcgtcgacggcgtcagtagcaacggatcaggcggctgcggcgggctggtggtgacggagctgagccacatcaaggagctggtgaggcagctggaggtgcacctcggcggctccccggacctgtgcaagcacctggcctcgcagatcttctccctcaccgagcgctccatcggccctatcacctcctcctccagcttcagcggcctcgacggcgcccggcggaaagcgcttcgcgggcgacgccggcctcgcctcgccggtctcggccccgcccaccagcggcgtcaccgacgggccggtcaagaacaccaagaagaggaaggcgatg

SEQ ID NO: 23959 - DNA, 543 bp, Zea mays
  unsure at all n locations
  Clone ID: cC-zmle189054e03a1
atattatattttttttttcacacccncttttttgggttttgtttttttttttttttcgaaaaaccaacccccccaattttcattaaaagtaacatacacaaatccccctcctttttaaaaaatttctcaagacggccccccccctttaaaaataaaaacaaaatacttgaggtgggcgaaccaaaccccctggatcttgacatccttgggccccttaacccccaggggggggtcccacgggtgcccccttttaaaaaccccaaaaacctccccggggtccgggattcttttggggacccccaaagggatatttcccctggacaaagcggctttcttaaattacttcttttggaaatcctttctatacccttttccctccggggggaaccccaacgttgtttttaattcccgtggaaccaccccccccctttgtgctaaaaaaaaaaaaaaccccttatcttggcacaaagaaaggcccccccaaactttcccttttcccggggcgaaaatttttttaatgaaaaaaaaggccctccccccccc

SEQ ID NO: 23960 - DNA, 373 bp, Zea mays
  Clone ID: cC-zmle189054e03d1
ggacgcgggacggacgcgtagtgcgagttctgagggcacgcctacattgtctgacctacgacgagaaccagagggagaggttcctggaggtgaagggcacggccacagcgaaccattgcccgaccatcgacggaggagtggactcgttcccgtacaagcccggcaagtaccagatgaagaagctgtgcctggagccgacgtcctttaccgccaaggcggagggcatcgccaagaacgcgccgcccgagttccagaagaccaagctcatgacccgcctcacctacacgctggacgagatcgagggcccactcgaggtccgcttcgacggcaccctaaagttcgaggagaaggacggcattgactaccccgccgt

SEQ ID NO: 23961 - DNA, 398 bp, Zea mays
  Clone ID: cC-zmle189054e04a1
ttttatatatttatattttttgcaccacatttttttttggtttgggtacaagtaaggcatcccccaatgttgctttccaaaaaaaaaaaaatcccgggacctgtgctttaaaaaaaaaacatcaaagcccgtgagaaagaggccccaaaaaaaagattaagaagagaagaaaaagagaaaaagcctcccttccccagttgctgatgtgaaacaagaacaatattgatccatgcaaaaaactaagcaatttttatttactgagaatgacacacttcgtgtggggggggatcaagggaggagcttctgctacggggggtatagaaaagggttgtcccctttggggctttccgccaccttccggaaccccaggctggaacgggggatttttttaatccccg

SEQ ID NO: 23962 - DNA, 584 bp, Zea mays
  unsure at all n locations
  Clone ID: cC-zmle189054e04d1
gacccacccgtgcggctggagctgctcacggtgaaggttccctcgcacgctgtcngttctaggaggggctcgacctgccgcggtgggggttttttgtagtgcgggaggagtggaccgccgaggtgttcgaccaggagctcctcaggtaccaaaacgttgaggaggagatggtgcagctcctccagctcgccatcgactgctccgcgcagcaccccgacaggaggcccgccatgtccgaggtggccacgcggatcgacgagatccgccgctccagcctcggcgaccggcaggtggccgacagcgccgaatgcgacgagccatctctataaccgccgtaacagtagctcctcccctgatccaccaccacacgtactgtgtcaatctcaatgaatgaaaattgcttagttctttgcatggatcgatattgctcttgcttcacatcagcaacttgtgcatggatgctatatctcttttcttctcttctttaatctttaattttggcctttttttcacgggctttgatgaatttttttctatagcacatgttactggacttctttatttctttgaaagcaacatttggt

SEQ ID NO: 23963 - DNA, 316 bp, Zea mays
  unsure at all n locations
  Clone ID: cC-zmle189054e05d1
agacgccgcaggaacagaccacgagaaaaacgcacccctttcggtttaaacagcaaagcagaacacagaaaagggcggaggagcgaaaaaaaagcaccgcggaccacgacaanaaggaaagactccgaaaaaccacaccaccgccgcgaaaaacagcgcaaaacagaaaaaaaaaacctaaaccaccaagaagcccccaacccccacaaaagaaaaagagcaacaaccccacgccaaagccccagaacacagaggacaaaaagacgcgaacacagcagcacacacacacagagatacccccccacgaaaaaaacca

SEQ ID NO: 23964 - DNA, 510 bp, Zea mays
  unsure at all n locations
  Clone ID: cC-zmle189054e06a1
ttttctataactctatttaaaatnaccccatataaagcgggcagggtgtgtttatccttgtacaactctgaaccacagngagcataaatggtttataagctaacaccaaaagtacagctgcactgaaaattcatgaaaaaaacgcaatgggcatactcgctgcaggcccatggaacatgcctagtctatcttcacagaagaataaatcaatcttgtgaagcagaagcaggcgtaaaagccgatcgtaccggtgagcacacagaaagcgaacgaggcaagaagcatgtagccaaagtacagcatgcccgacaccaccttagtgatctgcagcttagtgaagaagtaaaacccggcatacaggaagaggtagattgctgatgatcctgaagtcagaaaggacctccaccaccacaggtatgtcctcactgcacagttggaaatagcacagcacgattgtgatcttcgcacaggtgacgatgaggataatgaacaccaggaacaggaagccca

SEQ ID NO: 23965 - DNA, 93 bp, Zea mays
  Clone ID: cC-zmle189054e07a1
aaaaacggaacctgactacaaaaaaacacacgaaaaaggccacgaagccaatcatgtcaattaaaacaaagccgaacatcccaaaatattgga

SEQ ID NO: 23966 - DNA, 362 bp, Zea mays
  Clone ID: cC-zmle189054e08a1
aattacacgcacgcaaccttgaactctaacaccgaccgccctttccttttttttttttttttttttgaaacgaacacaaatattccggggcgggggaacatattgtaaccgcatcggacaaacctataaccagtgagtgcttacatgcatttggtcacctaaaggaaaaacataagctcctgccttatatgcacagaacaaaagggctatcttcagcccaatcgtggatgataacaaacacaaaaatccccacatcaaaaataacatggccgaccgttccctgctactaatggccacaccaaggatccttacatggggaacatagtacaggcacccccttgtgacctttatgaccttcacct

SEQ ID NO: 23967 - DNA, 290 bp, Zea mays
  unsure at all n locations
  Clone ID: cC-zmle189054e09d1
acacggaaaaacacgaccgacccactgaacaaaaaaaaaatacaataaggaacccagagcaaangccagcggcaagacacaaagaccgcccccgcccgcaccagccccggcacaccaaaccaacagcaccccgccaccagcgagacggcgagcgccgcaggagcgcgcggaacggaactacgactccaaaccgaagcgggagcccatcagctccaaccgcagcacccaccacgagaacctcaagcaggacaagcccaccaaccagcgcaccaaggaccagatcacaggaa

SEQ ID NO: 23968 - DNA, 501 bp, Zea mays
  Clone ID: cC-zmle189054e10a1
atatcttttcgagctgctttattattattcatgctatggaacagttaatcattgaaatccgtcaaatgagatagatgcatttacttcttctgtttaatgattttgcatcgcacaaataaactgtaatcaccagtaaattacttaggttcatcaacggatgagtggaggatggatggaactccaaaagggagagagagagaaaaaatcaacgtcaacaggttcccgactagactacagaaacgctaggtctgattcctgatgctccaggacggtggtggccatcgctcgtcggtaggcagccgatctcgcgttcctgacaaggacgcacacctcccggctctgcaaggttccatgcgtccattgctgtcgcctcaacgctgccagaagctttgcctcgcagaatgcgaccgccactgcgtcttgcccgttacttccatggatgaaaccactggtgacaaagcctatcggccacctgaacgcctcccgtgcgacgcctttcgt

SEQ ID NO: 23969 - DNA, 566 bp, Zea mays
  Clone ID: cC-zmle189054e10d1
gaacacccgtccggctctttctagtatctcatggtgcccattcaattggcttaagatagtgtctttggattgcagcaaagttgagagggccgtgctttccttatgattatccacatagcaaagcgtatgcatcatacatgtccaaagaagctgctggttttgataaagtagttgagcgccgccctgttgccaagagaccaccaagagttcctgtgccttctttatggcactgtatcatgacttgttttcgtaaagattatgatggcatattgggtgttcttgaagtagacgacttggtgcgggctaacatggtattacctaaaaactcttctgcacattgcgaatctggagacgcagaaccatcgcaagcaaatgttgcatccttgcaacttcatgtgccaagaaccacccaaatgttgagacagtatgtggaagaatttgataggaagtatctgagctcatcatctgacatgaaagtggattctgatgaaacccaactagcttctgattacactgtcggcatgacacggttcgcgagtgaattatgccttacaagggttctgatc

SEQ ID NO: 23970 - DNA, 308 bp, Zea mays
  Clone ID: cC-zmle189054e12a1
gaagccaagattgcctttgagggggttttatatcactagttccgttaccgaggaaagatcactcggtaaatcacatactattagggtcgtcggtgttcaaacgatttccattagctctataaaacattggtctcttacatttcgggcgagcggctgaggaggtgcaagtgcaagcgagaatgtagcaagtatacaacggcccgtgaagacgaagaccaaacaaaatgaaagcatgcttcatacgggcacaggggcgggtttattcaacgcaacaactcccggaagctcctttcctttcaacaattcca

SEQ ID NO: 23971 - DNA, 514 bp, Zea mays
  unsure at all n locations
  Clone ID: cC-zmle189054e12d1
gggagaagaatgacccagagtttgcacattagcttgcctccctttcagatctttatgcnaacgangcannnggaggagcggacaggtttcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgtcttacaaggcacaaggtctccctgttggtgcttcattggtcgaggaagacaaactcgagcttgcaacgtctctacttgcaaaggctaaggaaaagggtgtctcccttatgctgccaaccgatgttgacattgctgacaagtttgcccctgatgcttacagccagattgttccaccatctgcatttcctgatggttggatggccct

SEQ ID NO: 23972 - DNA, 504 bp, Zea mays
  Clone ID: cC-zmle189054f01a1
ttttacttacttctcgccttcatattacaccggtgacaatggggcagtattcagtacagccacaatgcagtcagcaattaggggaacacccaaacttctgattcctaaaaaaggttacaaaggagtgctaatgtcaccgatcatatagtgtatatatccagtgtgttcacaaaggaccaagtggagggatggagtaacaacatcgaaaacaatcaaccagaatcatcgcactccaatttcgctgatacaaataatttacgcctgcaatgaatcaatgacgttcctccggtccacaactccaccctaaaagatgctcccataatccttccttgtcgtaaatgagtgccctcttgttcctccccagggcacttcatcgcccatgccaaaactactaggccacgcaggctgcccattgtgatggcttcccattggccgcattggactggaagtgcctgattatatcgctgatggagaaatggctgttcatgacgaggacgggcattt

SEQ ID NO: 23973 - DNA, 464 bp, Zea mays
  Clone ID: cC-zmle189054f01d1
aggttctccttggctatccatatactactgcgtgctgatatgagggcattcggctgcatagttggggaggtgttactaggcttgccattgcttcctggagcaacagaatatgatgtgcttcagagaatggcgaaaatgctcggaggccaaccaccagatgaactgctaagggaagctaaaaacactgtaaggttttttaaacatgttggaagtatatatgctggcaatgcggcacctattggtctttctagtgcatacagaattttaagtgaagaagaggttgaagcgagagattccaagaggcaaaagatgggaaagtggtactttccacacctgaagcttgacagactcatatgtacctatccttggaacaattctgaactggcagagacagagaaaacagatcgtttgggattaagttgatttcttgaagggactccttgaatttgatccaaataagcgat

SEQ ID NO: 23974 - DNA, 388 bp, Zea mays
  Clone ID: cC-zmle189054f03a1
tttttatttttatatttttcagggaacgaaaccaagggggtgttttactttcacaacgggggtgcctcctttcacaaccctgcagttctaaccttgatgcaagcagggcctgtcaatgtcatgatcgtaaataaacaacaggcttgttaaacatagaaacctcaggaatttcactcggaaaacagagagaaggaaatcaatcttgtaccaaatgagagtcttttaactctgttctttcgcaaaaagctccaaaaaaagctctacctccctcaggaacagcctcctcagctgtttttgccctttccggtacactacacacaaacgggaggttgtatttgacttcctttagagcttctcgccgatttcactcgcgtaaaacctttggctg

SEQ ID NO: 23975 - DNA, 409 bp, Zea mays
  Clone ID: cC-zmle189054f03d1
tgggtggaaccacccgtgcgcggacgcgtgggaggaaatgaggaactactgtacctttatggattcgttgttgacaacaatcctgatgattatgggagggttcattatactttggaagctcttacacagatccagtctgctgatataaaaatgaagctactagagatgcataagggagaattgaggtgcctcctacccagaagtttgcttgataatggattttttggtatccgttctagtgaagataaggatagcaagaaaaatactggtccgttttcaagttttagttggagtggtcaacgcaaagttccatcatatcttccaaaaattgttttccctcatgaatttatgagtactctacgtactattgccatgcaagaacatgagcttgaacaggttgcttctttac

SEQ ID NO: 23976 - DNA, 262 bp, Zea mays
  Clone ID: cC-zmle189054f04a1
aaattgttattcccgaacttttattctttttaaaaccatgtccatgaacattgtttccaactatatgatcaaatggaatgatttttttttccctaccttcctgatttttaaaaaaatatctgacggttaacccttaaatttgaaagaccttacttttcacattagcctttggtttaacaatcactctcccaccaaggtttacttttcaaggcgggtgaattttttgattgaccctatcttttttttctttaaaaataaccaa

SEQ ID NO: 23977 - DNA, 304 bp, Zea mays
  Clone ID: cC-zmle189054f05a1
aagagaaccctccttcatggcgttggttattttatatcgaccgacacatcccatcccctaacaaggccgtatattttcaaacctataatcaaactctttctccaaccccaaccgatccttgtaataaatattcgacacaggctttaactcctcctacaaaaagcctgtcctaaacacaattttgacatcgaccaagaccttctttaagccgtacacgtgttccgagcacttcttacagtcaaaaacactgaaccccctccccccaaatcggccctaaactcgaacattcccaagatcctccctc

SEQ ID NO: 23978 - DNA, 212 bp, Zea mays
  unsure at all n locations
  Clone ID: cC-zmle189054f06a1
ggatcctctaaagcggccatccttttttaccctttttttttatttaacggaaacccnccaccagggcatggggtaatatatatggcatgacacagcccaacctctaccaagggggcatagtttcaaagatatgcgcaacccccatctctcaccccaaccgatacttgcataaaacctccgacgaaagcttgaacaacctcctacaccaaacc

SEQ ID NO: 23979 - DNA, 400 bp, Zea mays
  Clone ID: cC-zmle189054f08a1
atccactttttttttttccaacccaagcccacaaaaggcgagggttaatttatgcacctacacacataaaacccacaacatgccacaccatgtgtagtgcaagacaaatcacagtgccacagcatggctatacctacacagtgcacaatagctggacacaggaagcaacatggggaaccatacaacataaaacctgaaaaccttacagacaaatcctatgagcggacacaagaagcatgcctggatggtttgcgcacccacacctaaggtcttttcttgcctgccaacctccgctccaccaccgtgaccttctcacttaggtccgagaagacccccatctgaacgttgcccgaccccaaaagctatagaaaaagcccctccccctcctgggccccttctg

SEQ ID NO: 23980 - DNA, 291 bp, Zea mays
  Clone ID: cC-zmle189054f09a1
attcaacggacacacatatccctgggcgggtttacattattttacatgatcgaacaaacccaaaaccattgttcgctcacaagcattctgacacctaaaggtcaccggcatgccctacctaacttgccggtaacaaaattggatgcctaagcccaaccgttgttgctcaccgggacccccatgtggccatcgatgttttaaaacgggccctttccccgccacaattgccctgacgataaatcttaacattttagaacattgcgaggcggcccttctttaacttcttgacct

SEQ ID NO: 23981 - DNA, 115 bp, Zea mays
  unsure at all n locations
  Clone ID: cC-zmle189054f09d1
ggacgccnggaaaaaaaaaaaaaacaaaaaaaaacaaaaacataaaattcccaacccccaaaaaaaacaacagagacaaggaaaaaaaaaagaaccccncccccccccaccccac

SEQ ID NO: 23982 - DNA, 319 bp, Zea mays
  Clone ID: cC-zmle189054f10a1
aaaaaaacaccgcccgccaaaaaaaaaaaggggacagcagaggcaaaagaaacaaccaacacgcaagcaaacacacgaacgtacatgagcacaaagaccgacgccaaacaagcaaagagaaaaacccaaccgaagaaccctgttgccctctctctcacacacaccacacaaaacctatgtaaggcagccaacccgggctcccttattactggtcaaccaccaccacaagccagatagaaaaaaaccataaccacggcccccgaacgaagaaaacaaccactgcacgggccacacaagcaacaaccaccgcaactgcaac

SEQ ID NO: 23983 - DNA, 423 bp, Zea mays
  Clone ID: cC-zmle189054f11a1
atattgttattctgcgtgacgggtgaaacactggttgggaaaggttaaggatacagatatcgaacttgtcaagtgattatgtgcatttacagggttgtccgaggtccgttggacaaggacaactgtaggcgggcctaatgacttgggaggttccgtcacactttgtcttggcactcgttcagattatccatctttaggttggtccgactgacgacatcgttttgcggagatgcccactctctgcatcatcttgggaatgacttggctctgatcttccgcatcacgtgatcacttaacgtacctaaatgatatgcataatgcacatgaatgaacatacagaggaataacatactacaacatattactatttggacgaggattaaacacttaaagcatgcattaaaactttttatgggaaacaat

SEQ ID NO: 23984 - DNA, 506 bp, Zea mays
  Clone ID: cC-zmle189054f11d1
gggttgacccacccgtccgatgttagaattaagtctgattaaaactgtaagatcctgattgttgagatagaacgacataggtatctattgctggcctagaagagttttaatgcatgctccaagcgtttaatcctcgtccatatagtattatgttgcagtatgtcattcctctgtatgtccattcatgtgcattatgcatatcattcaggtacgataagtgatcacgtgatgcggaagatcagagccaagtcattcccaagatgatgcagagagtgggcatctccgcaagaccatgtcatcagtcggaccaacctaaagatggataatctgaacgagtgccaagacaaagtgtgacggaacctcccaagtcattaggcccgcctacagttgtccttgtccaacggacctcggacaaccctgttaatgcacataatcacttgacaagatcgatatctgaatcctttacctttcccaagagtgcttcacccgtcacgcagatattacat

SEQ ID NO: 23985 - DNA, 191 bp, Zea mays
  Clone ID: cC-zmle189054g02a1
acaattttcctccttttccagaaaaagccggaccccaaggaagcgtttttaaaacattgataccccactaatactttctgtctttgaataaacttggcgaataaaattattgttcaatttaacttcaataacacagggacaggatccctatcataatgtatcatacacagcctatcatgggtattagcctt

SEQ ID NO: 23986 - DNA, 370 bp, Zea mays
  Clone ID: cC-zmle189054g04a1
gaccaaaggcatttttttttggtgtgtggggggggtaacaaccctccctaaactcctttttaataacccaggggcactggggggctgctataaccaaaaagttatacaagctggggggactggaaacacaatggggtcaggagtttccaacgaaccggacaaagaccgaatgaggaaacttttaattgttatgagcatgatcatctttcttacccttattgaacatggaaccccccttttcgtatactttttcgaggggtgccaaatccttacgggccttagaaaaattgggctttcaattgcctctccgaatatcaaaggtcaaaggtcctcctaggggacatgaggttcaactttggggccgtggggg

SEQ ID NO: 23987 - DNA, 65 bp, Zea mays
  unsure at all n locations
  Clone ID: cC-zmle189054g04d1
aaagatnaaggacaaaaccaacagcccggcgaacagacaggcgagaaacacgacgaaaccaaaac

SEQ ID NO: 23988 - DNA, 327 bp, Zea mays
  unsure at all n locations
  Clone ID: cC-zmle189054g05a1
ggcnccaacacattaataggaaggggttgttttcaggttcagagaacaatcaattatttgcaaatcccaatccacccgtagaaggattggatcggatacttgtagaaacaacccaagatgtgatgggtgatgacccaattatttacaaacggacggacgcacacataactttgcaggaacacatattatttgccgaacacgtcgtgatcagacgccctcgatcagggctagggccgctagggcttttttactatcatcaccgngcattgcccttgatgggcacaatactcgcttacacttccaagaaccatccttttaatggcttcg

SEQ ID NO: 23989 - DNA, 262 bp, Zea mays
  Clone ID: cC-zmle189054g05d1
aacgaccaacccgcagaacaacacacacaccaacaccagacaaaaaagcaccacatttaaacttaaaagcgcacacaggagaaaaaacaggaagagcgtgataccaaaaaccaaccccaaaagaacccggagaacagacagacaaaaatgagagcgaggagtaacccccaggcccgacagcgcaaaccggcacgaccaagagagaaacgcgcagccgcaaggaaacccacgaccacgcagaaaaacacgcgcccccaaaaac

SEQ ID NO: 23990 - DNA, 383 bp, Zea mays
  Clone ID: cC-zmle189054g06a1
gaagcgaaggggcccaacccaacctttattccccgtatatataaaaaaaaaaaagcccgtccacaaaaacccgacccgatttttgaggggcggtccactaaacccgttcacctgtggagagactaaacaaaaaagggaccccccccccttattgcgcgcgggagggccccaaacaagcaggaaaaacagcccacgtgcccccgtacatgcatgcccattgcacacacctacacttactaacacccccgaacggaaaccccccaggaggcgacaacctttcccccgatggggcttttgaaataaccccccaagggggggtttttaacgaactggcaaaaccacccctgttgccccttgggggtggagccacaccacccggaggg

SEQ ID NO: 23991 - DNA, 312 bp, Zea mays
  Clone ID: cC-zmle189054g06d1
cccacccgtgcgcggacgcgtgggtggagagaagataatactctacagttttacatggctaaccagcagcagcagggcatgggggcagtggctctggaagtgctggcggcgctagccaccgcggcggccgagactgagtctgcagcttcatgcaacgccgggcaactggccgcttgcgcgccggcgatcacggccggcgcgaggccctccgcgtcgtgctgctccaacctcaaggcgcagcacgggcgcctctgccagttcgtgaagaaccccacctacgggcgctacatcaacagccccaacgcgcgcaag

SEQ ID NO: 23992 - DNA, 321 bp, Zea mays
  Clone ID: cC-zmle189054g07a1
catcggaccagagcacaatctgggtttgggaaaacatttaagctaaccacacactgaaaacatcccaaaacaatataaacttgagaccactgcccaaaaaaaaagtgatctcatcccgacacaaattggcgcgcaagacaatccatgagaatgctctaaactacagcgctcttgccctccctcctttgtagcttgaacaaggagaactcatgctctctaccctaaaggaaggacccattatctctggcaaacatgacagggcgggaagaaatgcatgccagaaaccgtccactgccaaattgttatacaatgtgtgggtca

SEQ ID NO: 23993 - DNA, 298 bp, Zea mays
  Clone ID: cC-zmle189054g07d1
ggggcgacccacccgtgcgcgagtatatcggcgccacgaacgctcgatgaggaggctttttgtgtttcgtcgacggagcactacagcgtgtgggaggtcgaatttaaacaactacgccgccccatcccgggaaagccgagtgtgtgcaaaaccacatggactgatgaggatggtcggcaggctgccatcaccgcagtgttaaccaataagagacagaggcatgggcttgatcaaggacggctcaaaacatgggggaatggaccatgtggtacaggcgactgctcatggggatgtgcag

SEQ ID NO: 23994 - DNA, 564 bp, Zea mays
  unsure at all n locations
  Clone ID: cC-zmle189054g08a1
cgccgcccttttttaattatatttatattaacggaggccgncaatcagtggatgggggggattaaaaaccccacaccgaaacaaaacccaaaaagggccatcagggcggaaaaaacaacaaacacggagcttttcttccctgggcaccaaacccaaagagccaactgagattttctgagctcccccaccggatttccgccccccacccaacgcaacaaaaaaagggcagaaaaaagcctgcctacttacaaagcgccccctacccccccgggaaaaacaaccccacgggtgggccccccagaaaaagccgccccccgcccggacgccccacactctttctctttgaggcggcataaaaacccggggcaaaaaaagaaaaaccccttcctcgccgaaaaaaaattttcccgcaaaaaatccccaaaacaaccgccgcgaaaaaaaaaaggaaaacccccgggccccccgagggaccgacccccccaaaatgggggggcgctccacccccccttttacaaagaaaaacccccccccccacccaaaaaaaaaaaccccccccccggg

SEQ ID NO: 23995 - DNA, 257 bp, Zea mays
  Clone ID: cC-zmle189054g08d1
gaaccacccgtgcgcggacgcgtgggcagacgcgtgggctatctaagacgaaggcagtttaaatgtcattagcaaaggcccacactaagaagcggttaaatttatgttatcgccatgaaaatgttcatttctaacttaaggatcgtttcatatgaaagtgcaagcaatataattctttttttcccacataaaaaataaaaaaaacgtcgaactctaaaatataaaactattctactaaacacaatcatacaaaatca

SEQ ID NO: 23996 - DNA, 445 bp, Zea mays
  unsure at all n locations
  Clone ID: cC-zmle189054g09a1
gaccctcaacagcggccgcccccatcccnggnncagttatatattttttcaacgcaagcgcgcacaaacgcgggaagggtttaattagccactcctcaacagagaaacaatgccccacgaagggccagggtgtcgccaaactgtacggacaccaactcgacagggtcagccaacctaatcagaggcgcttactggatcatggggaacggactcggcggatctaccacgtaaacccaaaaaaactcacaaaggaacaccggccaaaaggcacaagaagcatgcccccatggcaaaggcaccctcaccccaggtcacaaatagcaagccagcccatagcttaaaacctgagagcctgtgacttccgctcacgaagacccacccaacataccatcgcggggcatcaaaagccaatgctgaggtgccaaacgagtgggccaacttacat

SEQ ID NO: 23997 - DNA, 487 bp, Zea mays
  unsure at all n locations
  Clone ID: cC-zmle189054g10a1
atatttgtattttttnnnnnnntttttcaacagggtcgggcagcacatatttcgctgcagtttattgcccctcctttattcggcattcacggatatagatacaaccagttgcgttcgagcttccagctccagaatactcttgctaacagttctggcagctgaaacaaaacaactgaaatttaacgatacatgacataatattacaaatattcccatgaccgagtcatctatgaataacttgcgctcaccaacagaaaagaattggacctgactacagataaatacaggaaaatggccacgaggccaatctgttcaatttattcaaagctgcacttgccaaaatattggaacactgatcaacgatcagtgattcagtgggaagcatctctgctatagtactgggccaaggtctttgctggaatacggtggagaagttcgcgagggaagatccgaagcaatgtccatgcaaaatcgagtgactggaaaa

SEQ ID NO: 23998 - DNA, 600 bp, Zea mays
  Clone ID: cC-zmle189054g10d1
tgggttgaaccacccgtgcgcggacgcgtgggcggacgcgtggggtacttgactgtatctggttttgttgtgcctctggtcatattggataaagggaagggcccaaagtaccaagaaattgtaaacatccgacttggagatggcaccaatcgccgtggtcaagtcctggaagttgatggcgaaaaagctgttgtgcaggtctttgaaggaacttctggaatagacaacaaatacacaaccgtgcagtttacaggcgaggttttgaaaactcctgtctcacttgatatgcttgggcgcatttttaatggttctggaaaacctattgacaatggccccccgatattgcccgaagcctacttggatatctctggaagttctattaaccccagtgagagaacctatccagaggagatgatccaaactgggatatccaccattgatgtcatgaattccattgctcgtggacaaaagattccactgttttctgctgctgggctccctcacaatgaaattgctgctcagattttgtcgcaggcttgtctttgtgaagacattggagaaaggaaagcatgctgagggtggtgaagatgacaactttgc

SEQ ID NO: 23999 - DNA, 598 bp, Zea mays
  unsure at all n locations
  Clone ID: cC-zmle189054g11d1
ccccgaagagccaggaaaacccccaccaaaaaaaacacgaaccccccaacaacaaacgccaaaaaccaaccgacaaaaaaaagcaggaaaaaaaacaaaaaaaacaggggccaagaaaaaaaacaacaagcccaaaaaaacaagacaaaaaaaccggggggccccccagcgccaaaaaaaacaacaccaaaaccccccccaggaaaaaacacaacaaaacaaaaacccccaaaaaaaaaagggcaaccgaacacacccagagacaaccaagaaaaacccaacacaaaccccaaagcccccccagcccaccaaaaaagggaacaaacaaaaaccgggaaacacaaaaaacacccgccccccgggaaaaaagaacccgcacaaaaaaccacaaaaaaaaaacgccacaaaaaaaaaaggaagaccggggggcgccaaaaaaaaccaacacacaaaaaagcgggcggccacaaccgccaccacaaaaaaaaacggcccccccgcgcaaaaaaaacccaacccacgcgggaaacaccgcaaaaaagcccccaaggggaaaacgcccaaaaaaaaaaaaccaanacgccccacccccccccaa

SEQ ID NO: 24000 - DNA, 294 bp, Zea mays
  Clone ID: cC-zmle189054g12a1
ttttgaatatttttttgtccgaaattaacccagcccaaggggggcttaaattagcttgcaaccaggctcacttggggaggacgtccatccgcgcatctttggctgcggccaagtatatcccggcctccggggggcccttgaactctgcgggatggtcaagatcgttgttggcgctgaagagcttgcctgtgagactctcgaggctctgctttttctgcgtgggctaggaagcgaagacggtctgggacgtcgcacctccaagaaggaggcgccacactgcggacgtcagaggtg

SEQ ID NO: 24001 - DNA, 236 bp, Zea mays
  Clone ID: cC-zmle189054g12d1
actgctcgggccacgacatgaacaattgcgctcgcacacgttgagttgttccaagagcagaatgacagagggcagggcatggggtccaggacccccccctatcatggcagacaacgcagatcgcgctcctgcaacatgcacacgaccgccagggaacctagggcgtacacaggagcgcatgaacgagctggcccacgcgcctgacacgggctgcctgtcactggcatcgtcaaccg

SEQ ID NO: 24002 - DNA, 240 bp, Zea mays
  Clone ID: cC-zmle189054h03a1
tgactagtatacatgagtctagaaaaaaaaaaaagagctcccagaaagagctacaatcaaccaaagttacattcggacctgacgatcacatcaaaaccgtacatgaaaagcatatacccatgccgcccaataatacaacctgcaagcacaagactttccatgtacagagcgccagcccgcatgctattgcttacagagagactgtaccccaaccgacttctgaaccgtttgccggggcct

SEQ ID NO: 24003 - DNA, 342 bp, Zea mays
  Clone ID: cC-zmle189054h04a1
ctatatttaattttttaaatattatccaagcaaataaaccccccgggacgagttaaaattaaaagactccaacccaaaaacaaccaaaccatcatatacattcgacaagactcacagtcagtcctaacaaaaacaaagaaaagatcaccccacgaaaagaaccaacagaacaagccaaagaatcacattcggtacctgatccatacacataaaagaccgttacatgaaaagcataaaccccatgtaacccaatagtaacaacctgcaagcacaaacactttccaagtacagtagcgccaaacccccaagctaatgatcacaaagagactgataccccaaccc

SEQ ID NO: 24004 - DNA, 349 bp, Zea mays
  unsure at all n locations
  Clone ID: cC-zmle189054h06a1
ctctaggcgnctttttctttctttanggnccacacgcgcaccacgtggagggtggatattatgagaatcattacgacgcaccacctccaaaccaccagaatcaacccttgggccgtgcccaaactaaaataaacctccttctcggccgactccgggaggtcctaaatgctgtactacaaaggctgatcgccgcatacgatgagcttttttacgagggcccaaaatccactggcgctactcttgaccctcacctggcccgacatatgcaccactttggtggatcctttgaatgagaccgtgctctttctgcacgaagagccgttccttgcggttccaccatcattgcctc

SEQ ID NO: 24005 - DNA, 268 bp, Zea mays
  unsure at all n locations
  Clone ID: cC-zmle189054h08a1
attatatatattattttatttctcccacncccctttttttgggtttgggtacaattaaaggatcacaaaacccccctctccaaaaaaaaaaaaaaacctcctccccttctccaaaattcaattaaaaaagcctcctagaaggccccccccccttaaccattaaaacaaaaaaattaaggtgaccaccccacacccccaggattcttacctaatctggacccttatccccccaggccaagaaccaagccattttccttcactaaacacc

SEQ ID NO: 24006 - DNA, 65 bp, Zea mays
  Clone ID: cC-zmle189054h10a1
gggtccccccccaaggccaacggagtagataagctacatatctaattcctgctgcccgaataatt

SEQ ID NO: 24007 - DNA, 198 bp, Zea mays
  unsure at all n locations
  Clone ID: cC-zmle189055a01a1
nnnnctctttctatactcgccggcaaaagcaccacagacgaaaagctaaatttcagcnccccgccccggacacaacaaaccacaggccaacaaacggcgaaagacacccacccccagaaaagcccaaccacagcacaacacaaaaggagacaaggcaacaccacacaccgccaacgcaggaaccccgaaagcccaaaa

SEQ ID NO: 24008 - DNA, 397 bp, Zea mays
  Clone ID: cC-zmle189055a02a1
cccccttcttttttttttttggtttgttttttttttttttaacgcaagccttgttattattatcttccccaaaaacaaaggggtctgaaaccccgcaccaaatatccaacgggtaacatttgacctcaacccctttgaaaaaacaaacgttcatcaagggacagggttttcgggatacctgcttattaaaggggcggcgggttttttgaacaaccaaccatttacatgctggtgggtttgggaaggggtttttgaaccttggccaaaaactcctttaaccccggattcccaggcaggtaccttttcggaaatgtaagaaccgggggggaggacccccctgccccgggcccgcccgtgggcaaaagcaattttcaataaccccgcccggagcccccgc

SEQ ID NO: 24009 - DNA, 449 bp, Zea mays
  Clone ID: cC-zmle189055a02d1
gcgggacacggggcacacgagctcacgggagacggcgaattaggttgctcgcccccgagcgggcgaccaagggcccgccaccggatacggacagcagcgcgcaccaaaacgacaaggggaggaaccagacgcccgacggacgaggcccaccttcagcaccgcctccacgacggccgcggggcccccgctgcggcagagacggacctggtgcacacgtacgtgccgcggagcaagcgcgggcaggggctcgcggcgcggcacagcaacgctgacttcgcccacgcgcaggcccgcggcaagcgcgacctccccacccgctccaacaactccgacacgtacctgcctcggaaaccgccgacgaaggagctcgcggacaaggatcaagaaccccagccccaacccaccaccaggaacaaaggaggtagtccaagacacccaccgccacccaa

SEQ ID NO: 24010 - DNA, 430 bp, Zea mays
  Clone ID: cC-zmle189055a03a1
ccccaaaagaaggattaaattttggaattggccaaacaatttttggagggggggaacccaggggcccctaaatgggttggcatttgggaaaaaccaaatggttaaagggaaacatgggggggggggggggcccttttttgggggggggtccaggactccattttggggggcctttttttcctaagcttttcactaaacagttaaagggcaaatgttggctggggggggccccccactttaaaaatcaagcggggtttctactaaaaacccctttgtttttttttggaggggcatttttttcccaaagtggttgcttacccaattgggtggggggcaaacccggcaaacaaaagtattaaacttccaaaaaaaaggggaatttgtgtgggggaaaacccttttttgtaacaaacttacaataaggggaaaa

SEQ ID NO: 24011 - DNA, 512 bp, Zea mays
  unsure at all n locations
  Clone ID: cC-zmle189055a03d1
cacgcgtccgaattggcatcctatcataaatttcataagtgtagaataatttcccggccggaacatagngggtaacgtttgatgtcgtaattcgtttccggaagaaaatttaatttcaacatagaatttttttaccgataggtttatggtcttttaatatctacaggttgtggaaactgagatcattgtaactcaaatgagagcttggcacttagcatatagatgccactagaaccaatttggaattactgtgaggaaaaacggatatagagtgataaaaggcattaatgtaagtactacataaatgtactacttgtatttttcaataatcaatgcttcaaaagtctatatatatgctgactggtgtcagggttttcccattattgtaagtttgttacaagcaagtgctttccctcacacaacttcaccttttctttgcatgtttattacttttggttgctggttttgacttacagcgaattgtgtatgcaactactgtggcatatcagtga

SEQ ID NO: 24012 - DNA, 443 bp, Zea mays
  Clone ID: cC-zmle189055a04a1
tttggcttccctcaatcaaattgaaaatagaatagggggctttgttacaaaaagcagcatgatcaattacaaaaagcagcatgaaattgatctccagggtaacacatgctctcgtgcccctagaaattctaaatggacgaattgaactgccaagaaataaattgtcgaacaatatgtacagtaccgtcaaaaagcagcaagtattaagtaaacctgggcagtacgttctcaaacagtcaacagggcaaagtaccagtcaggccgtccaacggtagcgaaaacttaaaccttggtaacaaatcagttccatcagcatcgccatgacccatgattgaagcacactataaccaatgagttccacatctccacagccacgagccataacggatcaattccccatcagcgtagccacgatggaagcgcgccatgatcttcgttgatga

SEQ ID NO: 24013 - DNA, 276 bp, Zea mays
  unsure at all n locations
  Clone ID: cC-zmle189055a04d1
agaacaaaccaangtgggacgcgcaccccaccagcacgcaatttcattacgacccccagaaccaggaaggccggccncgtggaaacacaaggcacccgaccgcacccacccagcaacaaagaaaagaaaaaacaggaaacccggaagcctcacgaaaagcaggcacagacctgaaagcaggaaaccagcaacaaacgggctcgaaaagagctaggactgggagaaaacaacaaacccgcgatggaacctgaaacggacagaccaagccaacaagga

SEQ ID NO: 24014 - DNA, 611 bp, Zea mays
  Clone ID: cC-zmle189055a05a1
tttttaatattaaacccaaacagattatttattgggaggttttttttaaaaattctggccgcgtctataacaaattgttttattaaaattatttataaggtaaaaaaaaatttacttcctccaaaaaaaaaaaaaaaaaaggggggaaaaaaaaaaaattcaccacaaaaaaaaatttaaaggaccgaaaaaaaaaagaaaaaaaccccaaacccggggaaactccttcgataatttaaaaaaaaaaaacaagcaaaaaaaaaaaaccgggtaaaaggggggaaaaaaaattggcaaaaaaacagggaagaaaaaacaatatgacacaagagggggggtaaaaaaaacccaaccaaacccctcttttgggggggtgcaaaaaaaaaaaaaaatgaaaatccccaaaaaaaaaaaataaatgtgggggggccccccgtgaaaaaaattgaaaaggagaaacccccccctaaaaaaacccaacccccttttttgggccaccaaaaaaaaaaaacacttaaaaaaacaaaaggaaaaaacaaatcaccactcttaaaaaaagggaaaaaacacaaaatcctcccttaaagaaaaaaaaaacaggagcgcggaac

SEQ ID NO: 24015 - DNA, 382 bp, Zea mays
  Clone ID: cC-zmle189055a05d1
cagacagcaaagttcaaagcggccgaaaaacacccgaaacaacaaaaccacacagccaaccagcacatcacgcggaaagcaaaggccgcgaacggagacacagacaggacccaccaactaaccggacgaaaaaacgaagaaaaaacccagcggcagaccacagacaccccagcaagcgatccaacaccaaaggagaacccccaaggacagcaccccaacaagccacacaaagggaggtaaacaaccccaaaacataaaccaaaaatccccacaaaacggacccacaaaaacacaagagcagcagacacaaaagccagcgcccccaccccgaaaaactgaacccacaggaaaaacacaacacaaaaaacagcaaaaaaaggaa

SEQ ID NO: 24016 - DNA, 232 bp, Zea mays
  unsure at all n locations
  Clone ID: cC-zmle189055a06a1
tnnnaaatatgataaacaactccggnattcaacgncaaggaccgtttaacttaagatagccgcatgcaacaccattatttgttccgttaaaaccgtggcacagaaatgtaacgtcggacaaaatttaaatatgacaacagcagacaacacaacgctcggtgacagcagcagctgggcgcccttcacttcccaccaaggcttgggaactgagcttgatcttcaatggatggag

SEQ ID NO: 24017 - DNA, 413 bp, Zea mays
  Clone ID: cC-zmle189055a07a1
aaaaaaacccccgcttttccattatataaaggctgggccccatttataacagcatggccccccccccccgcctgaaaaatcctaacaattggcccgggggggtttcatttaccccaaacccgggggggggggggtcacctacgagcagactccccccaacagggggccaacaaaataaacagggtagggtcgatggctgaaaaccgacaaacaagcaattttgcttcgagcgaccgcccccccccagttccaaaagaacgagaagaatgaccggttcaggggttaccccttcacgtccccgcccttgagggggaccgggggcaccccgttcaccctggccttggggggcacgtcctccccgtaaagcatgccccccttgttccgggggatcggggctgccccctttttttccg

SEQ ID NO: 24018 - DNA, 448 bp, Zea mays
  Clone ID: cC-zmle189055a07d1
acccgtacggaccagaccagcagtagcccattcgaaccccgcctcttctctttcctcccgggttcgcgtgaggctgggtgctggtgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgttccgctctgggagctcgtctggttctcgctcgtcgccaacaccttcattaccgggatgaacctcagcctcatgcttaactccgtcggattctaccagatcttcaaactgagcatggattc

SEQ ID NO: 24019 - DNA, 448 bp, Zea mays
  unsure at all n locations
  Clone ID: cC-zmle189055a08a1
ggagagccacgcaacgccattttaagtatgggatgtatgccaaagagtacacaatagcggaatggcaaatataccaaattatgaacagcgtaacaacaagatagagagatgatccatgacgattgcgacggatcgaccggcgctagcagtacaaagcaagctactagaccatgcaaatggagaagctgagcttagatcttgccgcgcgggcccggctgcggcggctcctgaggtcccttcttgatcggcaggaggtccggtgacgccgacgcgctgacgtaggccagaagtgagccgccgcccagcagcaggaacttgagcagcagacctctcttggtgaacggagccgcgaacgtctcgaagaacttgctctgtancgggttgtagggcgagggcgcgtcagagccgtagaggtcccactgtccgngtggtgttgccgatgtcgtcg

SEQ ID NO: 24020 - DNA, 518 bp, Zea mays
  Clone ID: cC-zmle189055a08d1
cgtccggcgccactgtccagtgcgcgcgtcaagcttgcttatctagccttcatggcctccctcgccgccgtctgggtgaggcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggaccttctgccgatcaagaagggacctcaggagccgccccagccggccccgcgcggaagaactaagctcagcttttccattgcatggtcttaaagcttgctttg

SEQ ID NO: 24021 - DNA, 414 bp, Zea mays
  Clone ID: cC-zmle189055a09a1
ggttgggagcaccaaaaagcaccattttttccttaagattaacttaaaataaagcctgacgggggtaacagcattcatcgatccgcaatccatgctgtttgatgcatgggtctgctgaaaccgaggatgaacacagcactaacaactgacacagagcgaccttgcaatcaaaaacacagatgggcaacaacaaacacgacacgaacgaagataaaccctttggactagggtaaacatcacgggagcgaacaggataacttggccgcgcgggccccaccggttagttcctccagttcccgtcggagttgccgtaaccgccgccacggttgccaccgccgtagccgccggcaccaccaccgtagccggcgccgccaccgtagccgccgccaccgccgtagccgccaccgccattac

SEQ ID NO: 24022 - DNA, 589 bp, Zea mays
  unsure at all n locations
  Clone ID: cC-zmle189055a09d1
ccgtccgcccacgcgttcgcgcccgtcggtcttaccttttgcgatanagtactccggtgactaggtcggtcggcgcgggggggtagtcagggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggtcgcaacatcaccgtcaacgaggcccagtcccgcggcggccgtggaggcggcggcggtgggtacggtggtggccgtggaggcggcggctacggcggtggcgggcgccgtgatggcggtggcggctacagcggtggcggcggctactgtggcggcggccgctaccgtggtggtggccgcggcttctgcggt

SEQ ID NO: 24023 - DNA, 524 bp, Zea mays
  Clone ID: cC-zmle189055a10a1
ataagacttgcatatgttgattgctgtctaggagtgaatctgaaacacaatatctccagtatctggtaggacgcatggacatgggcatcgtctttgccaagttcggacactatatttgtgtgccgtcgcaacgcacgggcactatactagtacatatataagcattaattatttatttacgcagaggctggccggtcagcggtcagcggcccatcccctgtgcggacggaggcagcatagtggcgttgcggtcccagccgaggacggggtcgaagccgcgggccttgagctccttgtactgctggcagagcgcgcacggctcgcagcagaagtggacgaggcagtcgcagcagggggtctcggggaggccgagctgggcgcgcatcttggcgcggtacgtgcacgagtagatccactggcagcccgtgaagtaggccagcaccgcgtacagcgccctcgccgtgccgcacgacgtcgcgccgcggtccacgatctccgcccgcgcccgaacgtgatgcacgggc

SEQ ID NO: 24024 - DNA, 440 bp, Zea mays
  Clone ID: cC-zmle189055a11a1
aaaaacaacaatccacgcccgacacgggcggtggacacagcccatccaataatctttcatgagtacagtgtcggagtcatcggccaatttcttcaaaattatcattaatttatgatgttcatgtaactatagtcataggataaggcagggccggtttggtttcatcacgcggatgggagcaccttcttgacgatctcatcactgagcgaggcgatctgggcgtcgagcgccttgacagcctcctccttctgcgcctcgagggtggcgagcgcctctacgagctcggcctccacacgggtgcgtccctcgtccagcttggcctccagctccgcgggggtctccttcttcatcttgttaagcgccgccgcgatctcggcgcgcgccgccttcatgatggccgccgcctggtcctccagctgcttcaccttctcggaggcgcc

SEQ ID NO: 24025 - DNA, 468 bp, Zea mays
  unsure at all n locations
  Clone ID: cC-zmle189055a11d1
cgggcgcctccgaggaggtgaagcagctggatgaccaggcggcggtcatcatgtatgcggcgcgcgccgagatcgcgggggggcttaacaagatgaagagggagaccaccgcggagctggaggccaagctggacgagggacgcagncgtgtggaggccgagctcgtagaggcgctcgccaacctcgaggcgcagaaggaggaggctgtcaaggcgctcgacgcccagatcgcctcgctcagtgatgagatcgtcaagaaggtgctcccatccgcgtgatgaaaccaaaccggccctgccttatcctatgactatagttacatgaacatcataaattaatgataattttgaagaaattggccgatgactccgacactgtactcatgaaagattattggatgggctgtgtccaccgcctgtgttgggcgtggattgctgtctaaaaaaaataagagtaaagaccaatagg

SEQ ID NO: 24026 - DNA, 487 bp, Zea mays
  unsure at all n locations
  Clone ID: cC-zmle189055a12a1
ntttattatattttccttgttttttttttttttggttttggtttttttttttttttcttttttttttttttaatttttttttttttttttttttttcaaaaaaaaaaataaaggggcccaaaaacccaaaccccattttaaaaaaaaaaccccaagtccaaaaggggggggcaaaaaatttccccccaataaaaatttttgaattttttaaaaaaaaaaaaaccccccgggccaaaaaaaaaaagggcccccccaaaatttaaaccaatgggggggaaaaaaacccaaaggggccctttacttttcgcccccctaaaaggcccccccccctgaggccttttttggggttttcccctacccccttccgggggggcccccacccaaaagggggggaaaagaaaaaacatttttttttttttattcccccctacccaaaaaaaaagggaaatttaaaaaactgcctccccccccctgtgggggcccctcc

SEQ ID NO: 24027 - DNA, 579 bp, Zea mays
  Clone ID: cC-zmle189055a12d1
gacccacccgtgcgggacggccaaccgcgccaccctgccgcggcagccatggtgctttttaattttctaccgcaactatgggaagacttgcaagagttcaatgcggccgtatgagaaggagcgcctagatgctgagctgaagctggttggtgagtatggcctgcggtgcaagcgtgagctgtggcgcgtgcagtatgccctgagccgtatcaggaatgcagccagggagctgctcaccctggatgagaagaacccacgccgaatctttgagggcgaggcgctcctccgccgcatgaacagatatggtcttcttggtgagggacagaacaagcttgattacgtgcttgccctcactgttgagaacttcctccagcgccgcctccagaccatcgtcttcaagaatggcatggccaagtccatccaccatgctcgtgttctgatcaggcagcgccacatcagggtgggaaggcagctcgtcaacatcccgtcgttcatggtcagggtcgaatcagagaagcacattgacttctccctcaccagccctctgggtggtggccctgccggaagggtgaagcgaaa

SEQ ID NO: 24028 - DNA, 215 bp, Zea mays
  unsure at all n locations
  Clone ID: cC-zmle189055b02a1
tttttnattctttcccnncnngggacgacacacaaacagaggggctctttattaatccacttattccaaagaacaaagttacatctcggtactaggactaacacagaaatgaaagtggcccgtctctgatcagtgcttgtaagccagcttcttgagaacattgccgaggtcagcctcggccttgatgttcttgacccattgggcattgatcctca

SEQ ID NO: 24029 - DNA, 538 bp, Zea mays
  unsure at all n locations
  Clone ID: cC-zmle189055b03a1
tttttnttgctaaacatttctcaagtttcaagcggaaaggtagcatctcccaaatatgtaattacaatgcaactttgcggatctatcatgcaaccccataaaaccctaaactgtacaagaagttcaagtttatagctgaaaacaaaagaaaaacaagccaataaactggctcaccactcacgaacaatttgtacgacgaccaaactcagatactagtagtacttcgtatctgttgactttaaccctgtagtgtccaacagcctagtggatgctactgcaagtctctatcggcaatggacgcatcccagatcagtctgccatctcgacaatgatctttccagtggcatggccctcgatgctcttctcccacgccttgctcacctcgctcagcgggaacctcgagtcgatcagcgtcttgagtttgccgtccttcagcagcccgaccaggaactctaggtccgccttgttgggcgacaggagcagtggcacgagccgcttcctggcgaaggtcacactgtgcagcgccgatttgaggatg

SEQ ID NO: 24030 - DNA, 331 bp, Zea mays
  unsure at all n locations
  Clone ID: cC-zmle189055b04a1
tttttnatttttttcttttttttttttttttttggtttgggtttttttttttttttttttctttttttttttttttggccgggcggggaaaccccccccaaaattattttttatcccacaagaacttttttgttaaaaaattccaaaaaaagggttggaatgcaaacaaaaaaacttgggcccaaaaaaaaaaaagacctgcccacaaaagccgttaaaaaaaagggggggggttccatgggccaaaaacaggcccacgaaagccttcccgggggaaaatttttttttaccaaattcccccaagaatcggggggcttttgcggacccgggg

SEQ ID NO: 24031 - DNA, 346 bp, Zea mays
  unsure at all n locations
  Clone ID: cC-zmle189055b04d1
aagagaccaacgaatcatgtgagaaattggcatacagaaattttccatctttacagccctcgaaggcctgagtgtgncctatggtttccaccacattctcttgaactgctttcgtgagcatgtcattttgcatgctgtgaccatgcttcttcgtttgcattccaaaccttttttacgaactgtttaacaaaaatgatcttgtcggataaataatgattctggtgcgagtttaccagatcggtcaaacaaaaaaaaaaaaaaaaaaataacaaaaaaaaataacataaataaataatactttaccttaaatacaaaaaataacaaaaaaaaagggcgccccttttaa

SEQ ID NO: 24032 - DNA, 396 bp, Zea mays
  unsure at all n locations
  Clone ID: cC-zmle189055b05a1
tttttnatacttttccnaggatgacgaaaaagggggatggaggattttagcttattgtcccaattcgcacaggagctgagtgcgtgcacgtacgatagccaagtacgatgaccctgcacaaccagtcaaccacagacatacataaggcacgcaggcaggcacgaacgggcgtggatgccggccgccgggcggatcagttagccctggcgaggaagctctccctgcgctcgtggacctcgccggagcaggtgttgatgtcctccttgaccctggtttcgcgcaccacgaaaccgtggccgccgtggtgaccatggtggtgtggggggtgggttggcccccgcgcctgagaccgtgtcgacctcctcgaacttctccttgacgacttggctgttggac

SEQ ID NO: 24033 - DNA, 483 bp, Zea mays
  Clone ID: cC-zmle189055b07a1
ttttctttttttttaacagctgaagggactactcaaaagggcgggttatgcctggacatcggttccttatcaccatagtatgcagagagtagatctgccagatttccttacacccaaaacatcactacgagctagttgagctgcagaagaagaaaaacagcgcactcctagttactgagtgcaccttcaggggtactgatgatgaacccatctagacagaacttttttcttgagaagcttcagaaacaatctcgtctgtgccctcttcctccagcttcctcagggctcccctcagccccaaaacgataaacaggttggtgagagtcagcagcgattcagcgcccccgtgcagccagtcaacgttggacagtgaggtaccataatgaacttttgtggtggcgccgacgaagacgaggaggaagtagaaaccgaagagcgtgagcccgggcgcggtcttggacctggtcatgaagtaaaggaatc

SEQ ID NO: 24034 - DNA, 259 bp, Zea mays
  Clone ID: cC-zmle189055b07d1
ccccggcacagccgccaagagagagcccggggacacccccttggagcttggacccaaggccgaggatgtcatcaagccaatgaatccgaccaccttgctctttcgcttactcgaaggaacgatatgtgctgcctactatgttctggcgcctatttacatgtggataaaggaccaaatcgtgccaaaacgcataccaatctgagtgaaccgaatgagccgcctgtaacagaggatagccaacctctgaatcctactcttc

SEQ ID NO: 24035 - DNA, 488 bp, Zea mays
  Clone ID: cC-zmle189055b08a1
ttttatgtaggtttatagcttattggcgtaattcgtacaggaggtgagtgtttgcacgtacgatagccaagtacgatgaccctgcacaaccagtcaaccacagacatacataaggcacgcaggcaggcacgaacgggcgtggatgccggccgccgggcggctcagttagccctggcgaggaagctctccctgcgctcgtggacctcgccggtgcaggtgttgatgtcctcctcgaccctggtctcgcgcaccacgaagccgtggccgccgtggtgaccatggtggtggtggtggttggttggcgccggcgcgtgagaccgtgtcgacctcctcgaacttctccttgacgacgtgctgctggacgccgccttcgtggcggccgaagccggccggggccaccgacctcaccttctccgagcagtagtccacctcctggtagtaagccattggtgccgacgcttggtgtgtctgtgtgcagcgcccgtgcg

SEQ ID NO: 24036 - DNA, 365 bp, Zea mays
  Clone ID: cC-zmle189055b08d1
cgctgcaccggcgcttcacacacacacaccttccgataccaccagaggaagactaccacgaggggggcgacagcgctgaggaggggaaggcgaagcccccgaccggcggacgccgacacggacgcggcgtccaaaagcacggcccaaggagaagctcgaggaggcagacacggacacagacgccggcgccaaccaccaccaccaccaccacggacaccacggaggccacggcgccagggagcgcgagaccagggccgaggaggacatcaacaccaccaccggcgaggtccacgagcgcacggagagcatccacaccagggctaacggacccacccggccgacaggaaccacacccggacggaccg

SEQ ID NO: 24037 - DNA, 521 bp, Zea mays
  unsure at all n locations
  Clone ID: cC-zmle189055b09a1
anatttaanagattcaattattaaccgagcacaaccgcnaancgggaacgttttgtttacagataccacccgcaaaatgaaaagngttatgcttgagctaaaactgttatacaaatgaacaaacctgacttgtattatcttggcatatacaacttgcttgacacaacaccggaatttgaatttcttttctgtagtctgtacacttaatatacacaactaaaaatcactcttcagcaagaaagaccagatgtgtgctgaatcctgtgctcaatttatgcttcagccttgaaatattggtggagcacatgcctgtgtggtcatcttgcttcttagcttttcaaaagctttcatgctttctgcatcaaagcctccagcaaattgatgaaccccgaaagcgaaccttacaccctgaaaaagcaaaaactctttattgggctttttttagagccttctaatgcataaaattttgaggcaaccatcttcatatacttgtttgcaagctaaacaaatgccactttgat

SEQ ID NO: 24038 - DNA, 405 bp, Zea mays
  Clone ID: cC-zmle189055b10a1
aaacgataattgatgatggatgggttaacagagttttgaaccatggagcactttggaagttttacatgactggggaaaaaaaggacatgggattgtagcttttatgagcactgctactagtaatgttcacatagcatggctctgtaataatactgttgatcaccacatccaccagcagcaggcaattcggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttctccacaaatgcccaccttcaagttaggcctagctttgcggcccctttctgtagcaagctttaccagctcggccac

SEQ ID NO: 24039 - DNA, 477 bp, Zea mays
  Clone ID: cC-zmle189055b10d1
agcaggagcgggcgctcctgtcccaccgcgcccattcccgtcatgatggacacggagctcaacctggggctgatcgattaaaaggccgccggcctggcaaccaagagcggggagcgcttcgcctacgactccttccgccgcttcctagacatgttcggcaacgtcgtcatggacatcccccgctcactgttcgaagagaagcttgagcacatgaaggaatccaaggggctgaagaacgacaccgacctcacggtctctgacctcaaagagctcgtgggtcagtacaaggaggtctacctctcagccaagggagagccattcccctcagaccccaagaagcagctggagcttgcagtgctggctgtgttcaacttgtgggagagccccacggccaagaagaacaagagcattaaccagatcactggcctcaggggcacctgcgtgaacgtgcagagcatggtgttcggcaacatgggg

SEQ ID NO: 24040 - DNA, 402 bp, Zea mays
  Clone ID: cC-zmle189055b11a1
tattttataatgtccagagcacaagcgccgactggctgggtttgattttatctttgtccgtccagacaacgatctcatctcagcaactggtgagcggatcctgcagagactcccggctgccctctagccagcagtacaccggtggcagcctgagcgtttccatgaccccgcacgcgttccatcattaggggtcggcgagcagtgctccgttgtccccgccggccgccttcagctcgaccccagacatggttatgtccgtgcaggctaccgcctctctgtacgcaaggcgaatggtctcgcccgcctgcgggttgtacgcgcccccgatgtccctgtacgcaacgccggacacactcaccgtggaggtctggttggcgcacccgtggccgaggcaatattact

SEQ ID NO: 24041 - DNA, 607 bp, Zea mays
  unsure at all n locations
  Clone ID: cC-zmle189055c01a1
nnaanctttttttttattaaccacacaaaaataattttttgggtttagttttttttaaaaatttttatccggtactacaccaaaatagattatttaataatataaccaaaacaaaagaaacataaaaaaacacatcatcaaaaattaaaaaaaagaaaaaaaacccatattaaaggcgaagcagccaaaacaaaaaaaaaaaaaacatgtaaaaaaaaaaaaaaaaaaaaaaaaataaaaaaaagagcccccaaaaaacctaaagttggaaaaaaaaaaaccaaattaccacaaaaatagaaaaaaaaaaaaaaaaactttaataaataaaaaaagaaactccactaaaactcaaaaagacgtaaaaaaaaaaaaaaaattatttaatcaaaaaaaaaaagaacactattacaacaaaataaaataaaaaaaaagcaaaatattatccagaaaaaaaaaaaagggaaataatccgcaaacaaaaaaaaaaaaaaaaaatattactccaaaaaaatgcacaaaaaaaccacagtaaaacaaaaattattaaaaaaaaaaaacaaacaccaaaaataagatgaaaaaaaaaaaaatatccccaaaaagt

SEQ ID NO: 24042 - DNA, 397 bp, Zea mays
  unsure at all n locations
  Clone ID: cC-zmle189055c01d1
aaaaagcgcaacaaaagatcaacaacgtctactagaaaccaccccaccaaangccccgggcgggggccgcataaggagccaacaccgacaaaccccccacaaagcacacaaacaccaaaagcaacacccacaacccccacacccaccagaaaacgaagccccaagcaagcgaaaacccagaaccccaaccccaaaggcacacaacaagcaaacgcagcacgcaacaaaccaaaagcacccacgaaacaacaaaccccagacccagcaacggagcacacaaaggaacaaaccatcagggcacaccaccagaaacaacccgagccaccagagaacaaccaagaagcacagacaaaccanncncccaacacacagcaacaacaaactcccccaaccaacc

SEQ ID NO: 24043 - DNA, 336 bp, Zea mays
  Clone ID: cC-zmle189055c02a1
gaagcacaacgcaaatatgatggacttggcagttttcaaatatagtttggaaagcgtaatgtaaacaagacaccatcaccagtccaagcctctgaaaaatgtgtcgccgaggcccatcacactgaaagatcttaggtaaatcagatgagaagcttctcaatcgagtccttgagaccctgtatctgttgtttcagctggctaccctcattgctggtcactgagcaagcaatgacgggtcttgtcacaccacaagcacggccaagagcttgtttcgatggaacaaatacatatgggacgttcttatcctcggctaacaaggggaggtggagcaggatc

SEQ ID NO: 24044 - DNA, 355 bp, Zea mays
  Clone ID: cC-zmle189055c04a1
atgggagaggcaaggggatattgatggagacgctgttagaacgtacaaaaatcaacatgacttcatgcgaaagaaaagcatccactactttggtatcagttgtcaagtactacaatcattacatgggacgcataacacagcacatgcttgtggagtgaaggcaagattgccgcaagcagtcttctttgaaaggatttcttcaaactgcaggtgcaagctgatcttgctgctcttcaaatcttggtgggcttcaatctgccaatatcgaaagaatttgtaaagggcagtatctcaaactcaagttgatgttattgggtctggctcggttcttctggcaaagtgggagcattaaact

SEQ ID NO: 24045 - DNA, 476 bp, Zea mays
  unsure at all n locations
  Clone ID: cC-zmle189055c04d1
tctgggtctattattatcgtttggtaataagatactaaacattagatctttcccacccgccgcagnggaggagggggagctacttccgcgcagcatgctgtccacaccataaattggtggaagagaagtttgatgctaccactttgccagaagaaccgatccagacacaataacatcaaactgagtctgagatactgcactttacaaattctttcgatattggcagattgaagaccaacatgatttgaagagcagcaagatcagcttgcacctgcagtttgaagaaatcctttcaaagaagactgcttgcggcaatcttgccttcactccacaagcatgtgctgtgttttgcgtaccatgtaatgattgttgtacttgacaactgataccaaagtagtggatgcttttctttcgcatgaagtcatgttgatttttgtacgttctaacagcgttctcatcaatatcccattgaatct

SEQ ID NO: 24046 - DNA, 273 bp, Zea mays
  unsure at all n locations
  Clone ID: cC-zmle189055c05a1
nnnaactttataataataaacaccaccaaaaaaaccaaaggaaaagtgacatttaagaanacgacccgaccaaccccaaacatncacggaagctacaccaaaaacaaacaacccccaaattacacgacaaaccacaaaaaccacaagccaagaacaaccacagaccaaaaagccccagcagcaaaaaacaaaaaaaaacaccacccacaagcacccaacaagagaaacaccccaaaacaaaaaaaccacacagaccaaccacccaaacaaacc

SEQ ID NO: 24047 - DNA, 561 bp, Zea mays
  unsure at all n locations
  Clone ID: cC-zmle189055c06a1
tnnaaaatttggatgtatactttcccattcaagngaaagggggggtataatcttagtacgattacatcatgtctaacttatggaacagagataacagggatactttcttttgctcaaacacgggaaataccttctaagcgagttacctaatcgccgcgactttgttagtcacacacacacacacaccagataatcacaaggcaggaaggaggaaaatgaaacaaacatatcgctcaatgccttgacaaagagatgagaactcgttgcagccgagccgccagtaaacctagagggggtggggaccattcatgctgttccactgaagcaagacgcgacgatgataaagccatggcaccttcgcccttgtttcttcatctaccgatgattagatcacaaaatggagcacgcccccctctgcacctttttattcttcttcgccttaggcggctgcagcacaactcttatcgccgcatcgaaaacgcccttcacgtttagttgggtcttcgagcttcattcgatgtattatggagcgcctatttgctttcttagctcctctccctg

SEQ ID NO: 24048 - DNA, 385 bp, Zea mays
  unsure at all n locations
  Clone ID: cC-zmle189055c06d1
aaccgaagcaagacgcacccgggggggggagaaagctcgaagggccaacgcccgancccccagacgacaagacaggccaagcggaccacccaggcgcagaccccaccacaacggcccagggagaggagccaagaaagcaaanaggcgcaccagaccacaacgaaggcagcgcgaagacccaacaaaacgcgaagggcgaccacagaggcggcgacaaagggagcgccgcagccgccgaaggcgaacaagaagaaaaaggcgcagaggggggcgagcaccacaccgcgacccaagcaggggcagacgaagaaacaagggcgaaggcgccaaggcaaagcacccncgcggacaagcacaagggaacaacaagaaagggccccacccc

SEQ ID NO: 24049 - DNA, 460 bp, Zea mays
  unsure at all n locations
  Clone ID: cC-zmle189055c07a1
gggatcctctacatcggctgccctttttttttttnaacctttttatttttttgccaaaccacgcaccaaggggaccgtttattttaatttacgtatctgctttnccccaatttatcccatgacaaaatttgtggtcttttaacaagaaacaagataggttttatttacacagttgcttcctcccatattaactattttccaataaccagaagacgcgtacctacaataacttttggggtggaggcccggacaaattacgttgagcgtattacaacctttttatccagttacccgccttttttttgttttgatcattggatttcaagtcctttcaaatccactttgggacctttttgaagtttccttctgtttttaaaactttttttatatttttgaggattttatcttttttcttaatttttggctttttttttttttccagtaccatctttttttaatt

SEQ ID NO: 24050 - DNA, 341 bp, Zea mays
  Clone ID: cC-zmle189055c07d1
tttccatcccttacaatatcgcccgcgggctgtaatatattcaccttcaagggatcgagcactcagacgtcaaaccctataacatcttatatgatggagaattctgctctaaagatgtcaattttggaatggctcgagaagaaacatactgacacttgataggggatgaaccacgttcatattagatggatggcaccatatatgtacaagcacaatccctatttccgtaaagatgatatgaatatctatggtcttatcttgagggaaatattcatcccttcacttcccttataaaaatattacttccattcatgcacctttttcctttgtttataaaaacc

SEQ ID NO: 24051 - DNA, 469 bp, Zea mays
  unsure at all n locations
  Clone ID: cC-zmle189055c08a1
nnnctttggcctaatggggatgatgataataatgagagacgggatgtttttcttacacaatacggcaactgctacatggagagggagggggccttgaaaccgcacaaaaagaatctaagctctttctcggtttagaatcctcatggagactacactccgccagctctttcttggttcttccacgtgtacgtcttggcagcaagatgcttgtggagatgttagatcctcgtattaaataactgtcatgtacatcaaaacactattccttcggggggattttttaacttctcatagcaatccagcaagcatggtaccagggtcattgtatgtggcaggtgctgtagtaggcaactgtggctggactgctgcgcgaggtggagcgacctgagtccttgggatatcaaccaaatgttccttgatgaactctttcaactcgaatgtcaaatattggtcgcccgaggcaactgtt

SEQ ID NO: 24052 - DNA, 395 bp, Zea mays
  unsure at all n locations
  Clone ID: cC-zmle189055c08d1
gggcgagaacaacccgaacaagcgggttgcaagcacgacacttttaattgaagcaccacgcgccangcaccgggcgacgcgagaggaaacagacccacaccacaccacccaaccgcggcnaacaggagccccggacgaccaacaaaagacacccgagcagaaagagcccaccaaggaacacccggacgacaacccaaggacgcagggcgaaccaccacgcgcagcagaccagccacagcagccaacaacagcacccgccacaaacaaagaccccggcaccaagcccgccggacagccacgaaaagccaaaaaacccccccgaaggaacacgcgcangaagcacaagacagggaaggaacacgaggaaccaacaccaccacaagcacccagccgcc

SEQ ID NO: 24053 - DNA, 353 bp, Zea mays
  unsure at all n locations
  Clone ID: cC-zmle189055c09a1
cnnnnttatattatatttaaccacacagagacaccaagggggcggtttaaatttaaggatccgcgtcggccaaaaccccaaaaattaaacttttggaattaaaatgtgggaccaatatttccgaaaaaagaaaaaagcgccccgatctaaaaagaagggagtatatataacgccagcgtgggataaaagaaaaaggaaataaaggacgtttgttttataatcaccacaaccccgattatagggagggaagaaagcaactgccagttggggaacaagaccacccaaatatccaacccaaaaactgttagttcggagggactttgggggggtacaagaccggtggggctacccgg

SEQ ID NO: 24054 - DNA, 130 bp, Zea mays
  unsure at all n locations
  Clone ID: cC-zmle189055c09d1
acacactaaaaatgcanccaataagatcgcaactgtatgattcatacccaccgacccgccccacacgagacggttgaattcaaacagccgaacccacgaagccaacaaaactagaaaaaaaaacccctca

SEQ ID NO: 24055 - DNA, 463 bp, Zea mays
  unsure at all n locations
  Clone ID: cC-zmle189055c10a1
gccggaaccacagagcggccgcccattccaactatagaatcttcccccccaccgcccccccggggnggggttaaaaaaaaaaagcgggccccgaccaaaggaaaccaaaaaagcccaaaaccaaaggggaaaacggccccgccacgaaaaacgaaccaagaggcccgcgggcgaaacaaaccccggcaccccagggaagaaaggggcccaaaaaaaaggggaccagcaaacaaggagcccccagaaaaaaaaaacccgggccccgggaccagaaaaaaaaaacaaacggagccccgaacggaaaccagccacgggcaggggcaacagccccccaaaaaaaaaaggaccgccccaaaaccaccaacaccacgggccgaagggcccccgcaaaaaaacacgaaaccgcccccgaacaagaaaaggcccccagagaaggacaggggccccccccgcaaaagggggg

SEQ ID NO: 24056 - DNA, 269 bp, Zea mays
  Clone ID: cC-zmle189055c10d1
gcgcgccgatatgcgagtgcagggtcacgtttacgaccgtttgattactttctcgcaaggcgcgcgccctgggcaagtgcgactttctgttcgtgtgccgggacaacatcctcaacttctgcaagctccgtctcactccgtctactgaagatgatgatgctgagacttaataatctaagtggtcaaataaccttgccaattaataatttcagatcggagcttcatttgtatctttcttcaatatgcagacgacagggtttaaataatca

SEQ ID NO: 24057 - DNA, 530 bp, Zea mays
  Clone ID: cC-zmle189055c11a1
ttttaaatatatagaagtgaaagcttatgatttacatagcaagggtaacatttataaacgagagaaaatttctctctatatatatatagtttcgggccacaaacacctaaatagcaattagcaaggacacaaactacatactccctccgtttctttttatttgtcgctggatagtgcaaaattacactatccagtgacaaataaaaagaaacagagggagtatattatatgcactgcacagtgcacactatacaacgacgttgatgagcaacagcctgaaaagtgaaaaaccccaacagctagctactcttggatggttggggggtcgcgtgtatgattttgcacgagccatcgtataacgacctgtggacgggccaacgaccaaccccacggcccacagcccatggcccacgcccgcaggatagagatgagcagagcagcaggcaaccaccacagccgctctggcggtctggccccgatcccggcgatcaccgacgacgtggtagatcgagcctgagtaggtaggcagg

SEQ ID NO: 24058 - DNA, 563 bp, Zea mays
  Clone ID: cC-zmle189055c11d1
gggttgacacacccgtgcgtgcccatccccatccaagaaatactacgcccatcggatccaccgtcgagtttatggcagaggagcacacaccccaggggctgatgaccggtttcgccatggccgccaagaagctggtgctcaagctggacctgcacgacgacaaggacaagcagaaggtgctcaaggcggtctccaccctccacggtatcgactccatctccgtggacatgaagggctcgaatctgacggtggtcggcctggcggaccccgtcgacgtcgtggccaggctgcgcaaggtcgccgccgccgaaatcgtctccgtcgggccagccaaggaggacaagaaggagggtgacaagaaggagggggacaagaagaagaaggacgacgagaagaagcagcaggtcctgtggtacccgcacccgtggcacgccgccgccgcagcgcagcagtaccacccccacccgtacccgccccagtacgccgtccacagcgccgaggaggaccccaactcctgcgccatctgctgatccgaatacccggtcccgtattctttttgtaca

SEQ ID NO: 24059 - DNA, 327 bp, Zea mays
  unsure at all n locations
  Clone ID: cC-zmle189055c12a1
tttttnatanttttcttttttttttttttttttgtttgggtttttcttaaatttccattccttccctaacattaacttaaaattaattcccgaaccggggtaacatttttcctctctccccatcccacccccaaaaaaacccccccctaaaaaaaccccaaaaaaacccagcactaacaaccgacacaaaaccccccggaaaacaaaaacacccccgggcaaccccccccccgaccccaccgaacaaaaacccccccaacccccccaaaacaaccgggaccaacaaaaaaacccccccccccccgccccaccggtgagtccccccaa

SEQ ID NO: 24060 - DNA, 422 bp, Zea mays
  unsure at all n locations
  Clone ID: cC-zmle189055c12d1
gtccgcggacgcgtgggatcctagttcgtcgtcaccgtttgccatgggtccatttgctcgtcttggaaacctgcacttggggaggccatctatcgtggtttctagctatatccagagttttgtgctaagacaaatcagtcagtcgttttgtgaacctattatgatggagctttatttgctgctnaaaaaaaaaaaaaaaaaaaaaaaaaaaaaaaaaaaaaaaaaaaaaaaaaaaaaaaaaaaaaaaaaaaaaaaaaaaataaaagaacaaaataatataatgtctccaaatcaaaataaaaatacaaaattaaaagggggggggccctttaaggggacccaattttggccccggggggggggggggaaattttcttttatgtgggcaaaaaaaatctaattaaccggcccgggggtttaaa

SEQ ID NO: 24061 - DNA, 303 bp, Zea mays
  unsure at all n locations
  Clone ID: cC-zmle189055d01d1
aaagaacccatccgtcccaaaaaanaaaaaaaaaaaaagcccgacggggggaacaacaaccaacgaaccccaacccaagccganggaaccaagggaccgccgaaacccaggaagaacacagcactaacaactgacacagagcgaccttgcaataaaaaacacaaaggggcaacaacaaacacgacacgaacgaaaataaaccctccggactaggggaaacataacgggacccaacaagaaaacttggccgcgcgggccccaccggtaaaatcctccagttcccgacggagttgccggaacccc

SEQ ID NO: 24062 - DNA, 252 bp, Zea mays
  Clone ID: cC-zmle189055d03d1
acaaaaccaaacataattacacaatgcttcacttacttctaattccattattttacatttcctcccaccaaattcttcaatgatctttaaacacctaactattcaatccaacatttcaacatcaatctctattctttatctttttacaaacaaccaattttccaattgcaacaacaaaccttgtcacatctaacaatacaatccatctcaacacaacataaacaacaatacctaccaacacttaaccaccta

SEQ ID NO: 24063 - DNA, 461 bp, Zea mays
  unsure at all n locations
  Clone ID: cC-zmle189055d05a1
tattttatcctgccaaanataaaatacaccacaggtatagagaattttagggtatgggaccttgctgctgtggagaacaagaacaaacattcttcttttctccgcaaaaagaataacagtaaaaaaatgtacagccattgaaggggtatcagtagcctctatagtagggcgccccgccacagatatcagcagcttacttggtcaccaacgaactacaaatataacaacagcagttatagccaatcaatgaatcgacagctagggggggcttcagttgcgactaattcgcatggtgtgagcacgaccagccgccaatcgaagcgattatgcaacaggagggcacgcttcactgtccttcgaggtgtcgacctctgaaggcggcatgaactgccacattgggtaccccggatagctgacaaagggcatcatcagcttctgccctgcagcttgcccctgggcat

SEQ ID NO: 24064 - DNA, 472 bp, Zea mays
  Clone ID: cC-zmle189055d06a1
accagccaactgttgggttaaaagaaagacaggaacatagtacgaggtacaaataaaaaaaactgttgttgccggtagctaccaggatcacccctatcgttgagaaactgtagcggcaggtcactgactgtacaactgggcaagggccatctcgtatgccttcttgatcacctccctcttgagcttgagggcagccgtgacgaggcctgactccggcgtccacgggtccggtatcagcttgattttggcagggatctcaaacttttccaaccgtgcttgcttaccagccttcaccaaagattggaggacttctttgactgtcccttgcttgtggcacaaatctgagaaatcactatatgtcattccttgttttgaggcccaggatttcagctcactctgtgcagttacaacaagtgccacacagtatctgtggaaggggtcaacatggatcatgatctggtcaacgtatgag

SEQ ID NO: 24065 - DNA, 526 bp, Zea mays
  unsure at all n locations
  Clone ID: cC-zmle189055d06d1
gtgatgcttctgttctgaagccaacgttaatgactgctgtttttgtatacttgagcgngcccgtgatggggtgcgagttaatgtatatgcaaaaggtgggttagcgaagagattatttgatattgcctatagccgtcgtctagctgctgtcaatggaagctggttgggtgcgtggggactagagaagcttttgtgggatatgctcgtcttccgaaaggttcgtgcaatcttgggaggacggattcgctttattcttgcaggtggagcacctctgtcaggggaaacacagagatttatcaatatatgtcttggggctccaatatctcaaggatatggcttgactgaaacctgtgctggtgggacattttcagagtatgatgaaacatctgttggtcgcgttgggccccctttgccttgttcatacattaagttgatagactgggccgaaggtggatacttaacaaccgattcaccaatgccttcgtgtgaaatagttttggacgtccaatgtaactaaggcttcttc

SEQ ID NO: 24066 - DNA, 255 bp, Zea mays
  Clone ID: cC-zmle189055d07a1
aaaccaccgaaccaacaaaaagcgaggaggcaaaaaaaagaaaacgccaccgcccaccacccaccagaacggagcccccctaaggcgcccaccaccacccgaaccccgacccaacccacaacaccacgcgcaacgaaaacgacaggaccccaaccacggcagggggcaagaccagcgactcgagcaccacaaccaccgacgcacggcccgaaaccatcatggccccaacacagaagaccccaaccggggggcagc

SEQ ID NO: 24067 - DNA, 342 bp, Zea mays
  Clone ID: cC-zmle189055d09a1
caccaacaaaaggttctaacgcggatacaccggggacgacaacgataaattcgagcagcgactgggccagccagccactgtagcaaacacactagactgacacaaaccgcttagtccacctcctcgatcttggggccagggccaccgattccagccggagcgtccttgtccatgccgccggagccttccatgttggcacccgcgccctggaacatcttggcaaagatggggatgcaaaggctctccaactccttcattttgtcatcgaactcgcccgcctcggcgagctggttggcgtccaaccagttgatggccgcgttaaaggagccctcaatctttttt

SEQ ID NO: 24068 - DNA, 438 bp, Zea mays
  Clone ID: cC-zmle189055d10a1
tttcttccggaacccggatgttttctgccccaattgggggtgaaaaaaccttttgagtcacccattttcatgaaaacatacactggccgggtgggttccacatcaccaggaagggtgaacaactttttcgagagccaaacaacacccatggagagcgggggggtgctttctttgaggatcaggaccaaccctttacgaggtcaaggtaggggtccttgacccacctgaagtttttggggggggagcccttaaccctgcctttaacgcggtgcgccttgtacgccaccacccggcgcttggggaactatgtcggatcccacaaccaccggcattataattggcttcggtttaaattgtaataacccgccccggggatttgtgacctcaactggttgaccaaggaggaggacggtcccctccctcccagttttttaaaat

SEQ ID NO: 24069 - DNA, 514 bp, Zea mays
  unsure at all n locations
  Clone ID: cC-zmle189055d11a1
ccacacaaaangccccaaggccagtttgatttataacttcctatcctcaaacaactactgttcatatttattatcctcacacttttcccttcctaactattgtgaagtcctacatccttaccctcaaaactgtatctttctgacaaccacctgttgatggaacaaaatacatttcatatttacttgcaccggttaacagtgaatattaacttcaccgttcataaaatcctccctcgatgtccatttggtttttattgcattaatcatccttcccccctatgccaacacctattgttggagccggttcctttcctttgctaatatttaccattattgattctccttcttgtattatgcactacacactatctttaatcaccatatcttttctatacccttaacctttttttgataccagtgtacaccagtctcttattcccctttaccacctttttaaccccttctagttttttctgttacaaaatttttatacaattcttatagcttcacccca

SEQ ID NO: 24070 - DNA, 513 bp, Zea mays
  unsure at all n locations
  Clone ID: cC-zmle189055e01a1
ttttaactancgaaccgaaattctagttcttatgaatagtattccacttgaccaaagtgatgtggcaccagcaacataacgacctttgaaatgagctagtgtacaaaatacatacaccatcgtggccctttaacaattgcattttaaaattactttagctaattccaacagcatttgaggccatgcaaacgtaaccattaaactatagctcttccaacggcaccgccgaagtttggaaccatattctttgtggatggcattccagcaacaacgccctcctcgatgccacattcatttttgccccttatgatcttgaagtatccatcatcgccccagcctctattccactgatttgccagaagccagtaatcttcttcagcatcactggttccccatccaatcaacttgacggcatggccacccataatgccaccggtgatgtgcttgtacactccagatttgtagtgtgcgaaatcctcgtaaactgtgaaagcaacttttacaggaccattt

SEQ ID NO: 24071 - DNA, 434 bp, Zea mays
  unsure at all n locations
  Clone ID: cC-zmle189055e02a1
gcaagaagcaagcaaatgaacatgtgaaggtaagaagagacttggtaataaaattacacaaggatcatcatgcacatctcaaatcatgccaccaccgtaccagcagctaaattacaatatactgtaattaatagaagaagaagttctttaatttggatcccggctggggcgtgcggcgtacgtgaagcgtgattagtcgaaggtggccttgccggtgaacttgacgtcgatggggttgacgttcttgccgatgctgcggaagttctggccgacgccctccctgccggggttgaccttctccgggtagacgccgtccttggggtggaggtactgcaccttgccgttggggaagacgcggtagaactggtaggtgatcttgtacttggagcgcnacctggtgccgagcgccaggcactgctccttgcgcgccagct

SEQ ID NO: 24072 - DNA, 475 bp, Zea mays
  unsure at all n locations
  Clone ID: cC-zmle189055e02d1
ggacgcgnggacggacgcgtgggcggactcattgcaagaatacaatgcccatggccanggccacccaagcgggcgcggtcacgcgccacctgggggccgccaccagcgcgccggaggcgaaaacgcggcagcagagcaccgcagcagcgcagccgacgacgacctcccgcgggccggccccgctccgcgcgtccaccgaggaggcggaggaggcgcctaaggggttcgtggccccgcagctggaccccagcacgccgaccccgatcttcggcggcagcacgggcgggctgctccgcaaggcgcaagaggaggaattctacgtcatcacgtggacgtcccccaaggagcaggtgaacgagaagcccaccggaggcgccgccatcaatgcgggagggccccaacctcttgaagctggcgcgcaaggagcagtgcctggcgcttggaaccaggttgcgctccaagtacaagaacacct

SEQ ID NO: 24073 - DNA, 488 bp, Zea mays
  unsure at all n locations
  Clone ID: cC-zmle189055e03a1
ttttcgctaatcatgatctttacttgccattagaggaagaagtaaacaagcaacatatttatgccattgttcaaggagacccgatcacattaacagtactagcagccatcgtcgccggcaccacagagcagcaacacatactcaaacatgccagagctgccggcgacgagattgatatatagttgacacatctatcacacgacacatgtaccagcagtataacaacggaaatcagcagcagactaacagtacaccgcaggccgactgcggcagccgccaggccggagagcggcgatttgattgattatagatcgggtcggcggatgggattgaaaccgaagggaattgtgccccatgcaggcgggcgagccaaccaagccagcaagcttacttcttgaggctgccgcggacgccgggcttgggcttggagggtggtggcctcngcagtggcggcggcggcggcaacagcagcgggggcggaggagtgc

SEQ ID NO: 24074 - DNA, 281 bp, Zea mays
  Clone ID: cC-zmle189055e03d1
ccaaccggggcggagaaaggacaagcaggcggaccggcaggggcaggacaagggcggacacgcaaaaccggcgggcccccacagccgaaccccggcgcccgacaacaagaccaagcagaaccaccacgaggcgcgccaccccaagcgccccaacgagccggagaagcaccacaaccagcaccccgccgcccccgcagcagccgcacgccgccggccacacagaccaggccaccacccccaagccccaaacccggcaacccgaggaagcaccaaaaaacaac

SEQ ID NO: 24075 - DNA, 258 bp, Zea mays
  unsure at all n locations
  Clone ID: cC-zmle189055e04a1
tatacgattatttaccaccgcacacccccancgagcgagggatttaatttaagggaccgggccaggccaaaaaccaaggaaacccnancacaagaacagaaccagcagcccccgcaaccaaaaccacaaaccagcaacacacacccaaacaggccaaacccgcccgcaacaagaagaacaaaaaggggacacaacaaacacacgacacaggnaccaaaaccacaacaacggaaaccaacaacagaacaacaaaacacc

SEQ ID NO: 24076 - DNA, 394 bp, Zea mays
  unsure at all n locations
  Clone ID: cC-zmle189055e05a1
tttttnttttttttttttttttttttttttttttttttgggggggggccaaacataaaacacagcagcatgcttccggtaattccacaaatatagcacaagggcagcgcactgcgcactaacttttatggaaattacagggattattttaaagaaatggggtagcagtccttggcattagcactgatcaatcacaagatatttttagcctgggggccagtttatttgcctgcctccgaggagaagaacggggatgggggaaacagaatgacatccacttgggcccgcattgatgaccacgcgaaagccatctttaagtcctttctggtttgcaacaaccttggcaaaataaaggaaaaggccaagtttttttttgggccttttttaaacctttg

SEQ ID NO: 24077 - DNA, 394 bp, Zea mays
  unsure at all n locations
  Clone ID: cC-zmle189055e05d1
tcccgatggactaactggcctggcaaaggctgttgagaggcacatagtaatttttggctatctcctctatgttgccaaggttggtgcgaagcaggaaggacttgaagatggctatcgcgtcgtcatcaatgacggcccaagtggatgtcaatctgtttaccacatccacgttcatctcctcggaggcaggcaaatgaactggcccccaggctaagaatatcttgtgattgatcagtgctnatgccaaggactgctactccatttctctagaataatccctgtaatttccataaaaagctagtgcgcagtgcgctgacctttggctattattggggaattaccggaagcatgctgctgtgatctatgattggccacaaaataaaaaattatataa

SEQ ID NO: 24078 - DNA, 447 bp, Zea mays
  unsure at all n locations
  Clone ID: cC-zmle189055e06a1
ataaccaanttatttatatccccaccccaggncacaccccacccagggggggataaaagaaaattacccgaccaaaccaaacccacccaaggccaaaagaaaaaaacaccccccccccaaaacccaaaaaaacaagccaccccaacccctatccacctcacaagaaccccccccccccccccaaagaaaaaaccccccacaacccacaaaaaaaaacgacccccccccaaaaaagagaacaaccaaaaaccaaaaaccggcacggcaaaaaaacagcaccccgacaaccccacaaaccccccccaaacccccgggacaaaacccccccaacccccccaacggggagcaagaaaccccaaaaaacggcaacaaagggaaaaaaccccgccaataactccccaaaaacccccccaggcccaccccccgaacccaaaaacaaccaccccc

SEQ ID NO: 24079 - DNA, 72 bp, Zea mays
  Clone ID: cC-zmle189055e06d1
ggacgcgaggggcagagccccagagcctccgaacccccccaataagattcccaccagaggaagaagcccaag

SEQ ID NO: 24080 - DNA, 388 bp, Zea mays
  unsure at all n locations
  Clone ID: cC-zmle189055e07a1
cnnactaatatttttctcttcccagcagcaccaaaagggtgggcgggtcaaaggaaaacagcggaccgagccacaaagcaatggaaaaagcccccagcaaattcatggcgaggaggaccacccatttccacacgcaaaagaggcaacacacccaaggggaaaaagaggatccagacaaagagaacccacgagatcaccccagaacaacccaaaacacgcgggggacaactccaggtcaagaacaagactcatgagccctactacccaaacagaggagcaaagaaacaagaagagggggggcagaaagaagagaacagcccaccaaaggcggggggggcccaaccaaaaacgacgggaaccgggcggaggccctaagagccacccgcca

SEQ ID NO: 24081 - DNA, 233 bp, Zea mays
  unsure at all n locations
  Clone ID: cC-zmle189055e08a1
tnnttttttttatcttttaccggnnnnttttttttttggggagggaaaactgtaccatttttacatataaccccccacaaaattttttgccaaagaaaaatcttccaaaaaaagatgggacgggtggggtcaagactcgttgaaaaaaaacatccgggggccaaccaagtcacccccgtgaggcgaacctgcctattattattgacaaatttggggattttggaccccacaag

SEQ ID NO: 24082 - DNA, 546 bp, Zea mays
  Clone ID: cC-zmle189055e08d1
gtgcggaggaaagcacatgtgttcatatcttgttcagagggctacaattaatgacatcgctgagagtgtaatgggattgagtactatttacaaggacactggtctttttggtgtctatgctgttgctaaggctgattgcttggatgatttggctcttgcaattatgcatgatatgagcaaattgtcataccgggttacggaagaagatgttatccgtgcacgtaatcagctgaagtcctctatccaactccaccttgatggttcaactgctgttgttgaggacattggcctgcagctgctgacctatggacgaagaattcctacccccgagctttttgcaagaatagatgctgttgatgcaagcactgtgaagcgtgttgcaaaccgcttcatctttgatcaggatgttgctattgctgcgatggggccgattccaagacttccagactacaactggttcagacgccggacctacatgctccgttactagattataagcccggtgtacccatgtttaccgtttgccaaagacaagataaaatttgc

SEQ ID NO: 24083 - DNA, 464 bp, Zea mays
  unsure at all n locations
  Clone ID: cC-zmle189055e10a1
gatcctctagatcggcctcccttttttnaactttttgaatgagtaccgggaaccaggcaccaaacgtnncgtttctttttaaactacattactcagcaattctaattgtgcactgaaaaccaaaaccgcatattggttctaaaaaactctaaacattggtaaaacaagaaccgatacgactgccagcgacataaaagtttccagcgcagagtgcaccaggatacaagctcagttcaacggttggccttggcaacacgctcaatctcgtccttcttcttgatggcgtaactgttggatgagcccttggcagcgttgatcagctcatctgcaaggcactcggcaatggttttgatgtttcggaaagcacttttcctggcaccagtggtgaggaggtagatggcctggttcacccttctcaggggtgagatatccacggtctgtctccttacaacaccagcggaacc

SEQ ID NO: 24084 - DNA, 561 bp, Zea mays
  Clone ID: cC-zmle189055e11a1
tttttgatcttggaaccatacagctcactgttgagatgggaagtttcatacagctcactgttcaaatctgaaagggacgggaaccaatatgcttactgatatcttttattgatctaaacttgctttctgcatgaaccagctgcttcaacttacttcagtactgcaatctgaacttcttaagaataaagtttatactcagcatcttggcagcgatatttccgaacgtaaaataaaaccaccgggatgttcggtcacatatagcaatgtgggagcattatgatctataaacaaaatctctaggaacatttcgatatttcacttctgggaaaataagaaaggagagtaaaaagatacttaatactattttagagaagagattaagttataggtaccattttagagaagttaaatttatagatactagaagagagaagcttgtttaaatgaatattataatagcaaaagactccatcaactttcagcagcagatgcagctctggcaggcgtgagatggtccagctcacacactggtggtgtagaattgatctttatatgtcgagt

SEQ ID NO: 24085 - DNA, 571 bp, Zea mays
  Clone ID: cC-zmle189055e11d1
cacccgtgcgacaaactcgacatatgaagatcaattctatcaccaccagtgtcttagctttgtaccatctcacgcctgccagagctgcatctgcttctgaaagttgatggagtcttttgctattataatattcatttaaacaagcttctctcttctagtatctataaatttaacttctctaaaatggtacctataacttaatctcttctctaaaatagtattaagtatctttttactctcctttcttattttcccagaagtgaaatatcgaaatgttcctagagattttgtttatagatcataatgctcccacattgctatatgtgaccgaacatcccggtggttttattttacgttcggaaatatcgctgccaagatgctgagtataaactttattcttaagaagttcagattgcagtactgaagtaagttgaagcagctggttcatgcagaaagcaagtttagatcaataaaagatatcagtaagcatattgggtcccgtccctttcagatttgaacagtgagctttatggaactcatattgaacagtgagctgtttggttccaggttc

SEQ ID NO: 24086 - DNA, 370 bp, Zea mays
  unsure at all n locations
  Clone ID: cC-zmle189055e12a1
tttttgttatccaatnncacagatatacgaaccggacggaccaaatcaaaggattgccaaagtatgaagcactgagcattaactccgtgtactaggaaagtggatcttacctaaccgattaaagaaaggtgctcgttgaagcgaggatggggggagtagatctcgcaccggcgtcggctatcggacagggggaagaaggcacggagggcgaagaaccaccacaacggtgacgatggtcacggtagttagttgctgcctgtcgacctccggccccgcttcgacaccaagcccgccttctgcttgtactcctcgacactggcgacgtccaacggagtcgacgctggcttctttcgccaagcacgccttcacc

SEQ ID NO: 24087 - DNA, 372 bp, Zea mays
  unsure at all n locations
  Clone ID: cC-zmle189055e12d1
cgggtgaaggcgtgcttggcgaaagaagccttcgtcgactccngttgactttgccagtggcgaggagtacaagcagggggcggtcttggtgtcgaagcggggccggaggtcgacaggcagcaactaactaccgtgaccatcgtcaccgttgtggtggttcttcgccctccgtgccttcttccccctgtccgatagccgacgccggtgcgagatctactccccccatcctcgcttcaacgagcacctttctttaatcggttaggtaagatccactttcctagtacacggagttaatgctcagtgcttcatactttggcaatcctttgatttggtcagtacggttcgtatatctgtgaaattggttgacaaaaa

SEQ ID NO: 24088 - DNA, 529 bp, Zea mays
  unsure at all n locations
  Clone ID: cC-zmle189055f01a1
ttttgtataaggagaatgaaattaatttctttggtgaggtttatagctggatcctgtagaaacatcgtcatacaatacaaaaaacgctatatcgtggaattcgcctctggtcaaatccaacagctctagtaggcgcaccaaacaaaaacaacacatcaaaccactcttaacacgctgtaaggatgccacaaggggtgatgaagcacaggtgcaaataacctcctactggatacctagggtccatgcgggctcagtaacggataatatcactcaagatgctgaagaaatggttgatatctatcttgtcttctccggcataaattgcttctgcacttcctccggttggcccctgcgcagccatctcaacaagcgtgtacagcttcttgattggcatatcatccagtgcttctgctgctgcatcaaggtccccgccatcgaacacatcaagatgatgcaatacctttttcgcatcctcctttntcagcttggggacatggtatgtcacagagaacacgtcacacattccaac

SEQ ID NO: 24089 - DNA, 354 bp, Zea mays
  Clone ID: cC-zmle189055f01d1
ccgtgcggtttcagcttgggattctgctactgttttcagatcttttccctcctatgatagcaagggggctctgctggctggggttctatagtatgccaaggcaagagccaaccgaaatgacgagctggatgctgttgtgcttgcccaacaactccgtaagaggttcctggatcaggtcatgaccttggggcaaagggtgccatttgaatttcatggaacaaactatgtattcaatgtcaatcaagctttgctagagggtcaggagagttctacaccattggatagaggattcttgtcaagtgatacatacatcatatttgaggctgcttttaattcaggaattatggtgatcaa

SEQ ID NO: 24090 - DNA, 232 bp, Zea mays
  unsure at all n locations
  Clone ID: cC-zmle189055f02a1
aaaactatataaattattaccaagaaaccaatcccttgggggaagttttaatttaaagncccccacccgcacccccccacaaaacaaaaaaagttatatacaaaaatttgtctattgacaaaaccaaaaattcaattatgcacaccaaacaaaaacaacacactaaacaactcataacaccctataatgatgccacaaagtttcatcaaacacaagatcaaataaccttcaa

SEQ ID NO: 24091 - DNA, 397 bp, Zea mays
  Clone ID: cC-zmle189055f02d1
ggaccagaccagcagcagcccaatcaaaccccgccccttactattcctcccgggcacgcgagaagccgggggcgggggggaggcaagacccgcgcccgccccaagcacgcggagaagaagccgccggcggcagcccacgagggcgcgcgggcgaagaacgaaagcagctccagccgccgcagcagggccaacaagcaacacaagcccccccccggcgacgccatccccttcgccaccacgcgcaccggggtccactacaccgccacggcgcccgtcgggcggatccccaacgccaccggatactccgacaacaagcacggcccgctctgggagcacaggtgggtctcgcaagtccacaacacacccatcaccgggaagaaccgcacccataagccca

SEQ ID NO: 24092 - DNA, 469 bp, Zea mays
  Clone ID: cC-zmle189055f03a1
tttttgatttttaacaaaaaaaatattattattattgggaagcccatgagtcaacgaaggcacacaaagataatgtacaatcctggtaccgcggtggtgggcatgaatagattgagggtgatgctaacagtatgttgcgttgctacggactagggactacggttgacccgacggtttcaggaaactgtagcaatccagctgcagcatttctcctccgttgactggatcaaaccggcatttgtagaagcttccatccatgccaacaactgccacggtatttttctcatgtgcaaatgcaacaatatagtgttcaccctcctgcagcctgaattgggctactgaccattcagagtgaaaatattttggcagcacacccttaatgaatgaaagagagggccttatatgaggaacttcacgatccggagaaggcataggcttgtcatttgcaagtgaacccacatttatcttt

SEQ ID NO: 24093 - DNA, 468 bp, Zea mays
  unsure at all n locations
  Clone ID: cC-zmle189055f03d1
ctcgagaacaaaacttccccctttaacttcgcggacttttaagtagttgcaccacaccgacactatgagggaccgcaagggtctctgcgccgggacacaccancccgggaccacagagcgagagcgccccggcgcccagaaggggcacgacacggaggaacactataagacaaggaagaccaagccaatcaatgcacacacttcccgcattgcgtgctttgcgatgtcgcaagaagggaggctcattgtgactgctaccactaaggggactcttgttagaatcaacaatgccagagaaggcaatctcctacatgaagtaatgagaggtgctgataaagcataaatctatagcttgtctttctcgaatgatttgcaatatttggcttgtctcagtgataaaggaacaattcacgtcttcaacttaaagaaaaatgttggagaaactgcaaatgacaagcctatgccctt

SEQ ID NO: 24094 - DNA, 539 bp, Zea mays
  Clone ID: cC-zmle189055f04a1
tttttcatgataccgatggctcttccattcacggggaagtctttatattattccctccaaggcgtatcttacatttgataatattgattgggtggtacaatccaggacggtatagctgcatgagccgtaggtatacagatctgcaatccatgcagctcagcttacactggtttgtatcagagtttgcaatgatggatcctaagtatccacaactctactagtgcaacgcgcaagtatgagatcatatccactgctctaatggtggtgcaagtaggagatcatcttgctcaccggtgcaggtagtctggtgaaatacgtacacgtatatgcttcatgtatcacatgatcacaaacttgcactgataagatgtatggaccacgtttccttgccccccacaaaaaaaaggatcgaactgaagctccttcattcctcggaatcagactcgagtgggcaggagccgtcgtcgacggtggccagcgggtccaacatgtccgagctggggtccgtgcacccgctcacgatatccagcttgcaccga

SEQ ID NO: 24095 - DNA, 592 bp, Zea mays
  Clone ID: cC-zmle189055f04d1
gtccgatcgccatcaccagctgcgccatggacttttacctcgacgaggtggggtcatcggagcaagctggatatcgggagcgggggcacggaccccagctccgacatgttccacccgctggccaccgtcgacgacagctcctgcccactcgagtttgatttcgaggaatgaaggagctccagttcgatcctttttttagtggggggcaaggaaacgaggtccatacatcttatcagagcaagtttgtgatcatgtgatacatgaagcatatacgtgtacgtatttcaccagactacctgcaccggtgagcaagaagatctcctacttgcaccaccattagagcagcggatatgatctcatacttgcccgctgcactagtatagttgtggatacttaagatccatcattgcaaactctgatacaaaccacagtcagctgagctgcatggattgcaaatctgtatacctacggatgatgcagctataccgtcctggattgtaccacacaatcaatattttctaatgtaacatactacttggagggaagcttataaagactttcccctcaatggaaaacaatctgtctaataaaa

SEQ ID NO: 24096 - DNA, 494 bp, Zea mays
  unsure at all n locations
  Clone ID: cC-zmle189055f08a1
aaccggggagccacaagagcggccgcccacgacaaacacccccccatcaaatccccacccgaagcagccccacccngggcngggcaagcccaaaaacaccggccacccacccccaacagggacacacacnccgacaccagaaaaaacacgacgccgacaggacccaaaccaccagcaacaaacaacaccccaaggacccccgcacaggccaagacgcaccgagccaacaacaacagagcaagcacagcccaccccgcgaggcaagaancaaacagagaaaccacacccgaagcacaggcccgcccaaggacagcggacaaacccgcaaaaacaaaaagcccaccaccaaaaacaacccccaccaaaccccgcgcaggaaaacccaggcacgccagaaaaaagggcaccagcaaagcccccaacaccccaaaaaccccccaagcgaccccaacgccccaagcaccgggaacccagacaaaccacccacaccccaa

SEQ ID NO: 24097 - DNA, 473 bp, Zea mays
  Clone ID: cC-zmle189055f10a1
tttgggataataaaagctatacatacaaaaaggggggaggctggataatagttttgtccagaattaagctcaggaccagaactgctgtcctcctaaggggcagggccatagccgagccccgtccggatccacaaacaccatcaacaatgaaaactctggtacatgaacagctcgagggttcaatactttctagtcgtctagctcaacaagctgagctcttctctcagccgccttcttcctcacaaagatgacccaccgcatggcagccttgatcttgagccacccgacgacggctttcccgggcgcgcgggtgcggtcgtcctcgtagctcacgttcggcgaaggcgcaggcatgtacggagggaaattgaagccgtcttcggctaggctggttccggcaccgcccatgctcaagagccgcaacatctgctgcatctcttcgtttccaggatctcgtgactcctcattcggat

SEQ ID NO: 24098 - DNA, 409 bp, Zea mays
  unsure at all n locations
  Clone ID: cC-zmle189055f10d1
cggactggangcacgttgtagaatttgatgtcaaggcactatagtacttcaagccgaaaaagaaaacgggggcgacattaagttacagngcctcagccgcaacaagcaacccngcnacatanggaccggccaaaccacagaaacaggggccacttccagcaaaagctggacaaacttcctcagcgggtactatgaatgaagcagatggaactagaaatgcatacaacgcaaatggaaaccagtcagcaagatatgcagccaacactcacagcattcctgcaaacgtcggcatgcaatacgacgggagtgcagtgtcgcctgaaatccagtttagtggttcatccctgtagagtcacgttttcaagagggtccaacatgctaccattgggccctccgcaacaacattaaa

SEQ ID NO: 24099 - DNA, 497 bp, Zea mays
  unsure at all n locations
  Clone ID: cC-zmle189055f11a1
aanattttttatactttaccctaacaaatatattaattggttggttttaatttaaaaaatcattaccccacaaccaccaaatttaaacataaaaaaccactcacacccatcctttacaacaaacactactaaaaacacatacaaaacacaacacccaaacaaacaaaaacttatttaataaacacaaacccacacacaaaaaaatcacaaaacccaaaagaacaaaaccaaacaaacaaaacgaccaaaccccaaaaaaaaaaaaaaaaacacgcaaaaaccaaaccaccaaaaacactacacggcccggaaacaatttaagccgaaccaccaaaacaaaacaaaaaaataaaaaaccaaacccccccccggccgtgattcaaaataaaacccaaaacacaccaaaaaattgttgaaatcccacctccataccaaaaaaaaataaaaaacaccaaacccactgcaaaaaaaaccaaaacccccactcaagaacccat

SEQ ID NO: 24100 - DNA, 244 bp, Zea mays
  Clone ID: cC-zmle189055f11d1
cgcccacgcgtccgaaaaaaaaaaaaaaaaaaaaaaaaaaaaaaattacattaccaacaaaaaaaaaaaaaaaaaaagagaagcaaaaaaaaaaaaaaaccccccccacacaaaacacaaaggacacgaagaggccaagagccaccccagcccgcacggacaccgaacaccaacaaggccacaccaccaaacacaaacgggggccgacccgaaaacaaggcccaacacaccgccccggaagcgc

SEQ ID NO: 24101 - DNA, 459 bp, Zea mays
  Clone ID: cC-zmle189055g02a1
tttttaatttcgagggtccactgcaaccagtcatgctcgggaaacatgagaacatcgatgtcttagtattattaattaccacaaacaggaacagcagtgcaagaagtaaatagcagaaggaaaacaagaggtattaatacaaaacaggcaggaagcgtctaatatagagaagagtaaaattcagacgttggctatcctctcttccatgcagctcattcccttcactcagattggcatgccttttggcacgatctggtcctttatccacatgtaaataggcaccagaacatagtaggcagcacatatcgttcctacgaggaagcggaagaggaaggtgatcggattcactggcttgctgacatccttcggcttgggaccaagctccaagggagagtcaccgggctctctcttgacgcctgtgacggagcagcccatgatgaagccatgcctttggacacc

SEQ ID NO: 24102 - DNA, 523 bp, Zea mays
  unsure at all n locations
  Clone ID: cC-zmle189055g02d1
cacccgaccttctggctgaccctcttcttttccgacatgtggattctaatcccaaggaggaagagtacatcgaggggntgaggaagtctgggtttagggatgtcaagctgaagaggattggaccgaagtggtaccgcggtgtccgaaggcatggcctcatcatgggctgctccgtcacaggcgtcaagagagagcgcggtgactctcccttggagcttggtcccaaggcggaggatgtcagcaagccagtgaatccgatcaccttcctctttcgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaatcttactcttctctatattagacgcttcctgcctgtattgtattaatacctcttgttttccttctgctatttacttcttgcactgctggtcccgtttgtggtaatt

SEQ ID NO: 24103 - DNA, 481 bp, Zea mays
  unsure at all n locations
  Clone ID: cC-zmle189055g03a1
tttttnatanggttggattctcgttttggttttgataggaaagtttgattacaagcattgacaagagagggacaatgcatactagcatgcatatacagcaagtctctcttctgagttattggcgcccacgccagttctgaatcatgatcgcacggacaacagcagcagggaggaacagaggtttgttatttgccaacagattacacacatgattggcattccacacgcaaccgatcgatatgacgattatactcctatttattagcaccagctatatatatatagccatgtctggagtctggactagcaagcaaccgagatcgatgatacagagatagattcatcggtttgcatgagcatgacttgttggcagccactatgttacaccaccatccaccaacgcatgtacaaaagttctgcatcatcatcgcatcgcctccgcctgatgatgatagatcagtgcagcgccgtcaggacagta

SEQ ID NO: 24104 - DNA, 231 bp, Zea mays
  unsure at all n locations
  Clone ID: cC-zmle189055g03d1
caaccccgacgaaccagagccagcagcgcaggcagacaagcaacgacaccaacgaggagcaccacgacaacgacgcctacaacacgctgaccaaccgcacgccctaccaggccagcgncacgcacgaccacctcaccggctcctacgcctacgaccacttcgacaagaacaccaactccctgctagacccaaccgaccccgagggcagggtgcaaactcttctgggcatca

SEQ ID NO: 24105 - DNA, 378 bp, Zea mays
  unsure at all n locations
  Clone ID: cC-zmle189055g04a1
tttttnattttttgcaccgnaagtagtaaaattgaacagttatttttatgactgaaatcaacaaaacccgatcaagcaagttgagaactgacacaaaaaaaagtaaagaaagaaggaaacaaaaggtaatgaaacaagctattcattaagatgttctaaaagccctgttggcttctgctactgcacagttcttaggaagaggctcctctgctcctccctcctgtcatggagacgacgacagggctgctgccgatccgatcagacgtgtatttgatgctcttctcctaatggatagcagaggcttggcactgcggtgtcaataatgtcgacttgtattggacgctcttctcctcatggatagtagaggcttggcattgc

SEQ ID NO: 24106 - DNA, 367 bp, Zea mays
  unsure at all n locations
  Clone ID: cC-zmle189055g04d1
cagtgccaagcctttactattcatgattagaatagcgtccatancaattttacatcagcgacaccgcagcggcgagcggttgctatccattagcagaagcgcatcaaacacacgtttgatcggatcggcagcagccctgtcgtcgtctccatgacaggagggaggagcagaggagcctcttcctaagaactgtgcagtagcagaagccaacagggcttttagaacatcttaatgaatagcttgtttcattacctttcggtaccttctttctttactttattttgcgtcagctctcaacttgcttgatcgggtattgttgatttcagcccccaagataaaatgttaaattttactacttaccgcgcac

SEQ ID NO: 24107 - DNA, 471 bp, Zea mays
  unsure at all n locations
  Clone ID: cC-zmle189055g06a1
aaccttggatcctctacagcgagccgccctctttcttttttnnnntttttttatattttacacgcacaggncnatcgcgggcgggtttaatttagaaacacaatccggccacccccccgggggacgcatggacaagggcattgccttagccaaaatcggacactatatttgtgtgccgaagcaacgcacgggcactatactagaacatatataagcatcaattatttatttacgcacaggctgggcggacaaaggtcaaaggcccatcccctgagcggacggaggcaacataatggcgttgcggtcccaaccgaggacggggtcaaagccgaaggccttgagccccttgtactgctggcagagcgcgcacagctcgcaaaagaagtggaccaagcagtcccaaaagggggtctccgggaggcccaactgggcgcgcattttggcgcgggacgtgcacgaatagatccactg

SEQ ID NO: 24108 - DNA, 495 bp, Zea mays
  unsure at all n locations
  Clone ID: cC-zmle189055g07a1
tttttnattttttctttttttttttttttttttttatggggaagaatctcaatcaatatattgattatttctaggaaacacacgttggtatgagggccccattatcgagtacatctcatatgtaatctaaaagatggcccctccaacgatgggttgctgcctcgacaagacaggattcatcaaagagaactggttgtatggcaacaattgttgctgctgtaggaaggcggcgaccaatgggttagccactaccaatggattaagtaactgttgtcgctgttgtaggtacccaacaaagttcgacagaatcagttggttgaatggaaacaactgttgcaagtaggcaacagggtttgccacagcttgttgagtcagagctggtacaatctgttgcaacaattgttgttgcaggtatgtaggtgcattgcccacagcgagcgggctatatgaaagcagttgttgttgttgtacctaggcggcagggttcaccatggc

SEQ ID NO: 24109 - DNA, 521 bp, Zea mays
  unsure at all n locations
  Clone ID: cC-zmle189055g07d1
cgcagaaacacaccaagtgaagcgtactanctaacgaccttcaactatttctaccaagacatcacccctccgtgcggtttttgttctttttgcgagcgcaacaaatgcgttcattattccacaatgctcacttgctcctattgccattattccacagttcctcccaccagttactttaatgggcttcgaacacctagctgtgcaagccaacatgcaacaacaagcgcttgcggcgagcgtattacaacaaccaattgcccaattgcaacaacaatccttgccacatctaacaatacaagccatcacaacgcaacagcaacaacagttcctaccaacactgagccacctaaccatggtgaaccctgccgcctacttgcaagagccgcttgcttcatccaacccacttgctctggcgaacgtagttgcaaaccaacaacaacaacagctacaacagtttttgccaacgctcattcaactagccatggtgaaccctgccgccttacttacaaaaacaacaactg

SEQ ID NO: 24110 - DNA, 404 bp, Zea mays
  unsure at all n locations
  Clone ID: cC-zmle189055g08a1
cnnngntngttttttttttgggtccgatcccccccaaaaggtccttgtcaaaaacttgggatttaatatgaacaggaaacgggccattttgccggctccatatgaacaaacacaagtccgaaattacggggccatcgttaacccatttattagcttccatttaggctagctgggggaggacgtccccgagcgcatttttggttgctgcaaaatatttttcggcctccggggggcttttgatctttgcggcatggtcaaaatcgtcgatggggctgaaaagcttgccggggagctccttgaggctttgcttttcctccttgggcttggaagcaatgacggtcttgaggtcctaccgcaggtaggaggcccggaggcggaggttgttctggacgtacggccacccc

SEQ ID NO: 24111 - DNA, 552 bp, Zea mays
  Clone ID: cC-zmle189055g08d1
gtgcgacgaaataataaagcgcgcgcgcgcactcggagaggctcggatagctgagtgagatggcacaagccatggcgtggatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgttcgcgcaggacatcatcaaccttcaagccacttcatcgacaagaaggcgtggccgtacgttcagaacgacctccgcctccgggcctcctacctgcgctacgacctcaagaccgtcatcgtttcaagccc

SEQ ID NO: 24112 - DNA, 219 bp, Zea mays
  unsure at all n locations
  Clone ID: cC-zmle189055g09a1
ggnccttctactccacctcgtccggtggttgcatggngaggncgaaccccaggccggcttccggtgaggcgtccaccacggatgacgacgacccggtgtcgctctgctcgtcttcacggcagcaggagtatgctgcctgcttgctggcgcccgcgcccgcggcagcagcggtcggccggcgaggcacgggcgccgccacggccacggtcaccgcgagcc

SEQ ID NO: 24113 - DNA, 370 bp, Zea mays
  Clone ID: cC-zmle189055g10a1
tttattatctttttccttttctaccattcaactgtgggggttaaagaaagactgcgctttttctctgtcaaataaaaaaaaccccaaaaaactttttctaccaagaccacccctttttttgaggagcgaaaacggcaggacaccgcccgggcaaatgggttccgaccaaaaaacaccccccaaaaaggcccgtccaaaaaaccgggggggcggcccccacgaaaaaaaaaaaaagtgtgcttggccccaaaaataacaaaaatggggaaaaaaaaaaaaacttgggggggaaaaaaaaaaaaacacccttcccaaggggtgggaggccctcttttaaaaaacttagaacggggggaaaatggacgggggc

SEQ ID NO: 24114 - DNA, 349 bp, Zea mays
  Clone ID: cC-zmle189055g10d1
gggcgggagcaactgctctgtgaaggcttgcagtacccgatgtggcatactaaggcgagccctggctccatcgagccgttgcgcttggaattgaaatttgaaacgcccgcgatcagatcccagccgttcaactagtttgaaataggagcatcctagcctttcgctatgcttctttttttttcttccctccttaactcttctttttctaacctctgttgaacttatttggacaaagcagagttttgtaaattacagcggagcccgccctaccagtgtattgaacaggcaattttggagtgtaatttctactggaaagcgattaacacgagcttactactgtcttgtcaac

SEQ ID NO: 24115 - DNA, 329 bp, Zea mays
  Clone ID: cC-zmle189055g11a1
caacccacaaacaaaaaaaacggccgccgacaggacaaacccacatcacccccacccccaaaaaaacaaaccccaaggacactgacagaacaaatgaacaaacaccaacacgcatcaccatctagacaaccccccacttaaacaagaaggccaccaagaaaaagccccaccccgccgacacacaagaccaaaacaatgggaacctggaacggaaaccaaaacaacacaaccaagccgggctaccagccacacacaaaaaatggaggacaccaccgacaaacccccgcctggggcacaaagcaaaaaaaaccccacacccgacaaccctg

SEQ ID NO: 24116 - DNA, 373 bp, Zea mays
  Clone ID: cC-zmle189055g12a1
tatcttctattttatctgatgctttctattatggggtgggtttttttttatttttctacatagaaacaatttttcctgaggcccagggttaaaacaccatatacaaacgggaacttatgatgcagagtcaaccgaagaaaccgtgctaaccgacgcattgggaacgggcgcgccggaactccaggagtcacccacgaaaccggggaacaagcagatgcgaaaatgcatacatggtgggctaccggaaaccaaaaaaaaaaatgctttggccacaatagggggggaagccccaaccaaattgccgcctaaaaagggacccgtcacgggccccctcctcatactaaacctaagcataaaacgcccagcccggggc

SEQ ID NO: 24117 - DNA, 601 bp, Zea mays
  unsure at all n locations
  Clone ID: cC-zmle189055g12d1
accacccgtccgcggacgcgtgggcggacgcgtggggactagttctagatgccgttgnctttctgagcatggcggaggggttgatgatgaccccgcccgtgctgggccctgcccctgcggcggcggcgctggacggcgacgaggaaggtgtcagcctgtgggatcactcctgatgcgctagctggcgaatcacactactgcttcgacttcgagtagtggcaggggcaggtggtgtaatactgtaatgtaagatgaggacgcgcgccacgtgccgtcccattggagagcgtacatgtggagggcgatcacacacctgatgtggacagagggatgtgtaggtggtagccggtaggccaacatgtatacgctctgcgatgcacttgtacgcacgttacgttgatgaatcatggaatgcatgcagacacgacacgaatacgcacgtataacgagtttgctacgtatatactggagctatagatgccgttgatatggtgcattgaacctccggcttgatgacctaggattcatatcctgaacatcttttggttcatgggataaattgtagattttgcacatagaaaagccctcggacacttgggcg

SEQ ID NO: 24118 - DNA, 337 bp, Zea mays
  unsure at all n locations
  Clone ID: cC-zmle189055h01d1
gagcggaggcgggcaaacacgggagggggcgacagggacgcccccacacagaaacaacggccccgaagggccaagaaaacaacaggcgcaccgaaacaaacccagcaggggcagccagcagcaccagcggagccgaccgaagcacggcgaacacacgcgccggaacgccggaggacacccaaanaaacgggaaacgggcagaggcgccaatgcccacacgcagagcgaccgcacaccagcagggctcacgcccgacgacaaggcagaagcaggggcatagcagaaccccgcgagaaaaaggaaaccgcacacaaggccacacaacaaacgaaccgga

SEQ ID NO: 24119 - DNA, 394 bp, Zea mays
  Clone ID: cC-zmle189055h06a1
caaacgaaaacgaacagggaggggataactttaatttgaaccacggagcactttggaagttttacatgactggggaaaaaaaggacatgggattgtagcttttatgagcactgctactagtaatgttcacatagcatggcttctgaataatactgttgatcaccacatccaccagcagcaggcaatccggttgccaatgaggaggtagcctcaaacaagcacctgagctgcagctagcctatcaatctgaacccttaaaggggagcaagaaacttaatccaccccaacctttgcgaagaaggccacagaagaaggctctccaccgggttctttcacaaaagcccacctttcagttaggcctaactttgcggcccctcttttgtacaagctttac

SEQ ID NO: 24120 - DNA, 269 bp, Zea mays
  unsure at all n locations
  Clone ID: cC-zmle189055h09a1
gggggggccaaggcaaaaaaccccggaccccccccnccccgnnaaaaccacaaaaaaaacacaagggcaacgccacagcgcacaaaccnnaaaggaaaaaacagggaaaaccccaaaaaaaaggaggacccagccccggcanaaacaccgaccaaacacaaaaaaaanccaacccgggggccaaaacaacagccccccccccaagaaaaaaacccggaggggggaaacaaaacgacacccacccgggcccccaaagaaaaccacccgaa

SEQ ID NO: 24121 - DNA, 332 bp, Zea mays
  Clone ID: cC-zmle189056a01a1
ttttgtgtttttttttttttttttttacctatctgaaaggaggatagcagactactggtgtctataaaatacagttttttttatgtacacatacaccagggtacaggattctttacgaggaataccaggctaaattaaatttcatttgggatgcctaatctgggttgattataagccgagggaaaacacatattttctttgaccttcatagtagtgagtcgaggtatgaatagttgtagaggcggccaaactgaagcaggctgccatatgtcctgtccgagattccaacataaagtgtgtccggggcggggctgaaggacataccggatacc

SEQ ID NO: 24122 - DNA, 171 bp, Zea mays
  unsure at all n locations
  Clone ID: cC-zmle189056a02a1
aaaagagtttggttcttccgccaacaaactatgacccgggaaggggcacattacactacgcagcccaaacgacacaaaaggacactgaacacgggaacccaanccgacaaggaaacaaagagcgagccacaaacaagagggccccccaaccccaaagaaccncgagaccaa

SEQ ID NO: 24123 - DNA, 400 bp, Zea mays
  Clone ID: cC-zmle189056a03a1
ttttaagtttaatcttcaaacttcataaggattcaagccgtacggctgcataaaagtttttgggcacaacacacaggacacaacatgttcattaaaccaacgaagccactaccaccactcatgacacacaaaccacagatgtttattagacaaccacatccatatggaggtacaccacagggctccagacgacgcagatgccaaaggacagtatttgttaaaatgacccttgttttactgaccaccagggaggcgttcccccagggggaaagggctccccttttaataaaaaagggggggggggggctttcttcctccagctgcttgccaaaaaaaaacagactcttctgttttggggggatgccctctttgcccagaaaacccccccccacggggcccc

SEQ ID NO: 24124 - DNA, 520 bp, Zea mays
  Clone ID: cC-zmle189056a06a1
gttcatcgaaccagccgctagctttatgggagggatgaattggcatatgccgccagggaacatgcctgtcatctatactttgttgaaaacagggaaaaaatgaactgagaaatgcaacatccacactgctcaatttgctggagctttaaatcaatttgctgtagcttactagtcatactttccctggacatggtacttgcacatctttttctgggcgcagatgatgagaatttcagcggagtcgatacctgaaagataggctccatggacatagccattgtagtgctcgctggtgtgctcaccggtgaagtataccctcccaaccggtgccctaagctggtcgtattcgtagcggttgacgccaactggccagttggagaaggtgcccttgtagaacctgttggaccaccatcttgggacaaggatgtcggtggcgtccgggacgtccctgccggggaacatcttccgaagcacctgcatgatctccgccttggtctgctcgtacgactgctgctcgatg

SEQ ID NO: 24125 - DNA, 417 bp, Zea mays
  Clone ID: cC-zmle189056a07a1
accataatgaaaaaattttggatagagttaactcatgatatacatcatacgaacaccacaggaactggaactcatgacatccatacatagattcagagtagacaccaccagtagacccaacatacgcaaagtttgtgaccacattccaccatcctacgacattacgatcatattgacaaacgccataattcttgtaacccaattttatttcacagaacgaccgaggcgaactgccgttcctcaaaccacgcaggtacgacgaccgcagaccgaggtctagccggagatctgaatggacttcacttcaggcttcttggcgtcctccttgggcacagtgactgtaagcacgccgttctccatggcggccctgatctgctccgtcttggcgttctcgggcagtcggaacctgcgcaggaa

SEQ ID NO: 24126 - DNA, 407 bp, Zea mays
  unsure at all n locations
  Clone ID: cC-zmle189056b03a1
cnaaccacgaataancatgggaaagttaatggaaaaaacaagtacattcagagctatacaggaaagaaactatggtcactagctgatgccaaaacaaaacaaaaaagggcggctgcaaaataagggtggggtgtcctcccggtatataaaaatttttttccgccgcgcacaaatgaatcaaattttctggaataacattctacaccagggggaatctaacatttattccctggaggcaatgaaattcgaaatgtcatgaaccccaccctttttgtaacattcagaaatccgatccacaaccttgtcccagttaccatccacggacgctaaattcattaagaatgccgcctcagaaaaaatcacctgttctggagcctttcctcttttgagggcctcgcgcttaccct

SEQ ID NO: 24127 - DNA, 387 bp, Zea mays
  unsure at all n locations
  Clone ID: cC-zmle189056b04a1
ctctatctataacttctctttttttattgancctncgaaggcggggaaggctataattgcgaaacaggggggggacacaacccatccaataatctttcatgagtacaggggcggagtcatcggccaatttcttcaaaattatcattaatttatgatggtcatgtaactatagtcgtaggataaggcagggccggtttggtttcatcacgcggatgggagcacctttttgacgatctcatcactgagcgaggcgatctgggcgttgagcgccttaacagccttctccttctgcgcctcgagggtggcgagcgcctttacgagcttggcctccacacgggtgcgcccctcgtccagcttggccttcagcttcgcggcccacgcgttcgt

SEQ ID NO: 24128 - DNA, 549 bp, Zea mays
  Clone ID: cC-zmle189056b05a1
gtctacgaggcagcagacatctttggggggggttctataaaacgcgaaaaaaagtaactgttctatacatacaggcagatggtagtttggcactgctgttatgtgcaaaaccatatgaagttccgaactaataatgctaataaattcacccctcaacattttggagtgcaactgccgttcaattgtcttgcccacatacgaagcatatcccatctgctgaacttttttgaagtttggaactcatatgcggagcaggtaaccgatacaggtaccaagaagcgccacgtacaccacaaagagcagggggaaacccatttgactccttgcggttcccttctttcttaggaataccatttcttgctgtagctcatcccgctcctgggtggtatttctgctctcttctcttagccttattatcatcttttcagcctcttccaattttgattcaagattgttgagctttgatttcatattctgaacatcttctgttacatgggataattgatgattctgcacattgaaaagccctcggtcacttagcataacagc

SEQ ID NO: 24129 - DNA, 420 bp, Zea mays
  unsure at all n locations
  Clone ID: cC-zmle189056b06a1
ctaaaanaaaaaagcacaatggtccgatatactgactaactcatgcggaacaacgggcgcacacatccatcacacatgagagctttccggaggccggtcgccggcggcggcggcgacgggtacaggatgcgacggagacgcacgcgcggtcgctctcggccgcaatcgacgcacagaacccgcggtcggaccagcgacgggcatcttacaccaaatgatgagaaaagggggggcttgctagagccgcgccaacgtgcggggggggacggggacacaattcccgggccgaaggcgggcgcgcgcccaccctatttacagggcccgacgtttaccatccacaaccaggacccacttgtccctttttcctgcttgatcgggaaacgcccccggccggtagcagtccactaaagattccaggga

SEQ ID NO: 24130 - DNA, 263 bp, Zea mays
  Clone ID: cC-zmle189056c01a1
aatttttaggtagtagccgacacaacatataccaagggggcggtgataacataaggtccaacaccttaacatcaacatactggaggcaaaagcctagtgcctaaaaaggataaactaaaaatatcgccagaaacaaactcggaaaataccaagccctgccataaactccacaacctttcgtagccttcaaaacaaaaaaaaaggtaatatttacgagaaccataatacgtcacattcggccaaactccaaatcggacgcgtgt

SEQ ID NO: 24131 - DNA, 349 bp, Zea mays
  Clone ID: cC-zmle189056c04a1
acaacccagaaaggtggggtccctacttactgcgttttatctatgaaaccaaatacaatcccgcaaaaaccttgggtgccctcaaccagcagacaaatacagtgcaagaaacggtggttatcaatcaatccatcacgatcacaaacgacggagggggaataccaacagttccaccaccaccaaagacagcgggcatgcgaacagctcggaaactagcatgtcactcaaaccaaaattgccttgaaacaacaaacaccagcccacattaagtgggttcacaacatcaaggggggccgacccgtgggcctacccaaaaaaacccgaccggtgcctgcaagcgtaccaactt

SEQ ID NO: 24132 - DNA, 463 bp, Zea mays
  unsure at all n locations
  Clone ID: cC-zmle189056c06a1
ggaatatgaaacagtttctcataacaatataacacacattttgtatataagttatcgcagtatattggtattatatatttccgttgcaacgcacgggcattcagctagttaaacatatatgatcatatatagatgtctacatgtggagacggctagggtgaagcaaattaaacatatttgatcatatatagatggcacgtcggccatgtctacatatggatcagtcatcagtccctgccgtcgaagccgaactttcgatctaagaagtggccggcggcatggaacaccgggccgaagaacccgttgcctctcttcgtcctcttgtcgncgncgttgctgttatcgttgttggacacacaaggcatgccgtacacgtgcaccgcctgggtattgatgtacaacggcgacctggcgccgtcctggggagcccanaaggcggcgggagcgttgttgtatggtgcgt

SEQ ID NO: 24133 - DNA, 558 bp, Zea mays
  Clone ID: cC-zmle189056c07a1
gctcatcctgtacatgtataaatattatacggtacgattaatacaacgtgtggtgattcttgatctatcgagttctcactctcttcaagagggatttcaagaaattccattgcacgttttcctgagttctgcaatgacatttctatacctcctagctcgccatatatcccaacagatgcgaaggttgttactcccattgagttcggagagctgtagttttaggacatctgaatgcatagatcgttaaacttttgctgcttccgctggtacaccagccctctcagcaacaatctgttcatagaggtctctaatcttcagtccaatgatggtctggaagagacctgtcccgttgttgctacctgggaagtctgcatgctttagcatttgttgtgtcacctctccgtagaacttggttgaaaggttgcttagatggctctccacgtagatgagctcatctagtctgtcgaaatgcccatccatctccagaacagatacctcgtttccgaagaagtgtccgggccataggaaaattgatgccagggaagagcatgtgagctt

SEQ ID NO: 24134 - DNA, 222 bp, Zea mays
  unsure at all n locations
  Clone ID: cC-zmle189056d01a1
aaaaggaaggagcccgcaccacacacacccaaaaaacagaacacgccacaccccgggggggccaagaaaaaaaacagagccacagacgggcgaaaccaacacagggcacaacagccggacacaggaaacaacacggggaaccaaacaacaaaaaaccacaaaaccgaacagacccaaccccncaagggacacaggaagcccgcccggaaggcncgggcaccc

SEQ ID NO: 24135 - DNA, 459 bp, Zea mays
  unsure at all n locations
  Clone ID: cC-zmle189056d02a1
gatcctctagagcggccgccccgtttgctgtggagacactctgttctttcgcaccagcggccgaacgaggggcgcgtttgatttggagccgccgccgcccaaccacgacanggacgagccgcgggcgctggccggcaccttctagaggccagtacctgacgataatgcacaggagagtacttaccggaatgcacggagcttaagtcatcgtctgtgtcgcttaaaagtgtaccagtcatgatctacaccaacaaagttttttttttttgcacaagaatgcacataagatactgggtgattttcacaggactattcgcttagtacctttttcacacttaatttgagcactttgtgtaaaaaaaaaacttgactattattaccttcgaatttttttcccaaaaataattgcataggacgtttcttttaaactccgcaaagatagttaatataaatataaaa

SEQ ID NO: 24136 - DNA, 450 bp, Zea mays
  unsure at all n locations
  Clone ID: cC-zmle189056d06a1
nanaattttatttttatttccaacaacgaacaaactagggacgggtttttttttagaaacccgcacgaaccctaaaacaaaaaaacattgaagggccccataccccggaaaggccaaacttgcagcgctggaaacaattataagggggggcgccaattcacattaaagccctgcccaaccctagtattacgggggggggcaggcaagggccaacttttgccaaaaaaaagggagacaacatagggccccccctaggaaaaacaaatccaggtcccaggggcgcccccaaatggcacccttatccaacctcaacatcataaataacccttcaacaacccaggattttttgtgcctttttgaaaaccccccctctctacatatctggaacaggtcccttcaaggccgaaactttgcgggctaaggctttgaacaaacttgaaaacctggccc

SEQ ID NO: 24137 - DNA, 109 bp, Zea mays
  Clone ID: cC-zmle189056d07a1
caaagcgcccgctccaaaaaaaaaatttgaattaccaacaacaaaaaacacacaaagggacgggcgcaagaaaaaaaaccggcccccaacaaccaaaaaaaaagaggaa

SEQ ID NO: 24138 - DNA, 313 bp, Zea mays
  Clone ID: cC-zmle189056e01a1
aaaaaaacttacccccatactatagggggggggaccgggccaccccaaattggagaattttggaccccaaaaatttggtttggggtttggctaaaaccaaaaaccaccttccccccaaagggccccacctttttttacttcccggggggcctgggggcgggggccatgggggtacataaaaaaaataagggcaccgggttcttaatttcgggggaaattattggggccccccctcggggggggcgggggggcccgcccccttgggagaatgggacccacccctccccggacccctggggggacccctgggttc

SEQ ID NO: 24139 - DNA, 68 bp, Zea mays
  Clone ID: cC-zmle189056e02a1
aacaaaaaaaataaaaaaccgggggggggttagattaagggaagggcggacccgcacccggaagcaac

SEQ ID NO: 24140 - DNA, 497 bp, Zea mays
  Clone ID: cC-zmle189056e03a1
ttttatattgtaactcgggcgactggcatcattgggttgaggttttagaatgaatacagtaacaaggtactacggcgcgctgaccaaatctgagaacaatgctatagcttgtgtgctgcagccggctccaccataagctcctacagtcctacacctacaatatatactagcactaaattaacccctccctaatttcatcatgtttttatacaggtcatccagctgacgagctcaggtaacccagcatacagcggagtgcccgactgacaagaccacgacaggaaaaaaaaccgcaacaaagccaaaaccactactcagttcggctgacacatgttctccacattgttctacgacacaaccagaggggaatagcgtttcttcgtcactctgcttatgatgtcgcctaatccaacaacccagcaaggatgtctgcctcacgaactcaacaaatgatgtggatgacaagtgtagctaacgtcagcagctgatctcccctt

SEQ ID NO: 24141 - DNA, 446 bp, Zea mays
  Clone ID: cC-zmle189056e05a1
attattttatttttgttttcaggccgcaacaaaaacgggggggggttattgtgtttgccattgacaagacactctacatatttaggaattattactgctcccgtacgtatggggggagcacccctttcagaaaggagtccaataatactaatgctctatcagcctgggaagacggaaccatatgaccagctcctctgacagaggcaaacgtgaatcctccctggtattgttgaacatatcctccgacctccatgtttactgtccacgggcgccatggagtggtgacgtgccggttaagatcatggatggaaaacctcgtagcaggaagtgggcccccggaatcaaaattgccactaaaaatccagacgggctgttttttctcaatcacccctgcgattgttggcaccatggaaaacggtgcctcccccccatataaagcccccccc

SEQ ID NO: 24142 - DNA, 114 bp, Zea mays
  unsure at all n locations
  Clone ID: cC-zmle189056e07a1
ttctttttnaaaaatttttatttttttccaaccacaaacaacacacgggaaaaggtttaatataaaaaaaccccccctttccctttcaccattaattatcctatacaaaattta

SEQ ID NO: 24143 - DNA, 420 bp, Zea mays
  Clone ID: cC-zmle189056f02a1
tccccccaccacaacaaaaaaggcggggaaagatttaagaaacgaaacccaacacaccaacaccacaggaaccggaacccaagacacccagacaaagagaaagaggagacaccaccagaaaacccaacaaacgcaagaggggggaccacattccaccatcctacgacattacgatcatattgacaaaccccataattcttgtaacccaattttatttcacaaaacgaccgaggcgaactgacgttcctcaaaccacgcaggtacgacaaccgtataccgaggtctaaccggagatcagaatggacttcacttcaggcttctgggcgacctccttgggcacagtgactgtaaacacccccctctccatggcggccctgatctgctccgacttggcgacctcgggcagtcggaacctgccca

SEQ ID NO: 24144 - DNA, 313 bp, Zea mays
  Clone ID: cC-zmle189056f03a1
gaaacagacgcacgcacaatgagtaggctgagtccagaacaagatacctccacaatgcaaccactcaaccgaacagggaggaaccataatttgtcacaaccagaagccataactttggcgttctgatggattctcgttacacaggccacaagtttattcagtcatgtagtttgggtgcagccgaaaccaacgtcactgcaattgcttatttgggtgtaagggggaggaagcaaagaagggtaaaacaaacatctctcagcaggagatggactctccagctcgtcatgcctaactgggaaaagcataaataaac

SEQ ID NO: 24145 - DNA, 440 bp, Zea mays
  Clone ID: cC-zmle189056f04a1
gacagcggccgaccacaaaacaaggttcattttacccaccgggaaaccgccaccagggaggggcaaagagcaaagcacggccccaaaccaaaacaaagcacacacaaaaaccagagaacacccaaaggacacaacacaaaacagaacgccacccccagcggaaaaacacaagccgaccgaccaaaaacaaaaaaacgcccacaaacacgggcggggacccagacaaacccacaaaaaacaccggccggaaagccaaaacacacaaaaaccacaaaacagaacaaaaaaacacccgacgacaaccacaacagaaggccacaccacggcccccgagaaaaagaaaaaaaagccccaaagcccacaccacacccaccagaacccacaaaaaaaaaaaccagaggcagccaaaaaaaacccccaacccaaacaaaacaacccac

SEQ ID NO: 24146 - DNA, 241 bp, Zea mays
  Clone ID: cC-zmle189056f05a1
aatagacgacacattataaaccaaggcaggggtgataatagaaggttcaacaccttaacaacaacatactggaggcgagagccatgtgcctaaacagcataacataaatctatcgtcagtaacaaactcggcaataactagcaccagccataactcctcaacctttcattgctttcgaaataaaaaaaaaggtaattttttcgagaaccataataagttacattcgggcaatctccaaatt

SEQ ID NO: 24147 - DNA, 358 bp, Zea mays
  Clone ID: cC-zmle189056g01a1
cccacaggacggcagcatatgggtcaggttacattaagacaaccgtgtccaaaaccagcatggatccagcgtccagggtcaccgtttacatttattctcaacatacacaagcagtaaagttggtctgctaccaaaggccattgggacgacccttttttgggaggcagaaatctatttgtctcctagccttctgggtcttgaacatttgccggaatatgtttcaaccgcgggtgttgtatctctaatcgtttgacgcactacgacacgatcttgttcaagttatacgcgttgattgagccgggttttcacaccctttacctgtcaccttacctactttccctatagggaggccttttta

SEQ ID NO: 24148 - DNA, 427 bp, Zea mays
  Clone ID: cC-zmle189056g02a1
aatgtttttttgtcatctgataaaacggttgcaaacggtatggtgctatctaactttgcgaacgaaggattgacaaatatggccttgacaaaacagcagcttaactaacaacatattcgctattgttatcttacagtaagcaccagagcaaacacactgtgcataattgactgaagaaaccaatcacctgtaatggacagggtattatacttttaatcccaaacttcgaaaacctaactaacaatttcaccttaatgcaaccggaacaaattctcaatggaagggccaatggacataacttcatacacccttaggttcacgtggggcctggaaagggtcaacaaggccaagccattggtggtgaccttggcacacccattgatatgcacaggttcaaggcgcggacagtcattgccgagggccagca

SEQ ID NO: 24149 - DNA, 404 bp, Zea mays
  Clone ID: cC-zmle189056g04a1
accaccaacaaaccatatcgggggggggtttaatttaatttccggtccggcaccaaaaaggaccccaagaggtgtataaaaaaacaagactagcctaccggccccccccacaaaaaaaaaaaatttgcaaacctcaaagggccaaagggaaaacaaatttcataccgaacaaacgacaggcaaaagcccaaaccccaaatcccatatttctccgggtcccaaaaaaacaagcttattgcttttcccccccccccaaagacaactttttataaccgaaagggggtaaaaaaaacgggaacaaaaacctaacgaaaaccatcgcccaccattttttccccccccctacccagacccctgggcgcacccctgggcggacccccgggcccaccccgaaaaacccgacc

SEQ ID NO: 24150 - DNA, 352 bp, Zea mays
  unsure at all n locations
  Clone ID: cC-zmle189056g05a1
cnnannnnnntnnnngcccggagaggattaaatgtagttggatgcattatacaaacataaaatacagaacatgccacaccttgtgttgtccaaaacgaagcacagtgccacagcatggctatacctacacagggcacaatagctggacacaggaagcaacatggggatccatacaacataaaacctcaaaaccttacagacttatcctttcagtggacacaggaagcatgcctggatggcttgtgcaccctcacctttggtctctttttgcgggccagcctccggtccagaaccttgaccttctaacttagggccgggatgacccccatttgatcggtgccggacgccaaaa

SEQ ID NO: 24151 - DNA, 320 bp, Zea mays
  Clone ID: cC-zmle189056g06a1
gaagcgcggaacctcgagagcggccgcccacatcacagcttttttgtttacccaccgagcgaaagccccaaggggggggataaaatgaaagggaccaccccacacaaaaacaatggaccaaaagggcacaagaaaaacgccagaaggaaaaagacacgaaacgcaccaacggccagacaacaacgacaaccgagcacaacaggataaagaagaaaacaaacaccggatcgcccgaggacaaacacaaaaacggccaccgggaaaaaacccaaagcacacaggcagcgcggaacgcaaacaagaagggagcacccccaacg

SEQ ID NO: 24152 - DNA, 438 bp, Zea mays
  unsure at all n locations
  Clone ID: cC-zmle189056h01a1
ctnanttaaaactttttttttcttaccccgcccaagcagaaaatgaaacagggttctttttacaatataacacccattttgtatataagttatcgcagtatattggtattatatatttccggagcaacgcacgggcattcagctgggtaaacatatgtgatcatatatagatgtctacatggggagacggctagggtgaagcaaattaaacatatttgatcatatatagagggcacgtcggccatgtttacatatggatcagtcatcaatccctgccgtcgaagccgaactttcgatctaaaaagtggccggcggcatggaacaccgggccaaaaaacaccgtgcctcttttcgtcctattgtcgtcgccgttgctgttattgttgttggacacacaaggcatgccgtacacgtgcaccgcctgggtatttgatgtac

SEQ ID NO: 24153 - DNA, 83 bp, Zea mays
  Clone ID: cC-zmle189057a02a1
gacttatagaacaggaactcaaccaacacaagacacaacaagctgcagccgcggcaggcatggggcaccgcgcgcactgacac

SEQ ID NO: 24154 - DNA, 491 bp, Zea mays
  Clone ID: cC-zmle189057a03a1
aattgttaatcgacgatgtattgaagaacggagtttttaaccatggagcagtttggaagttttacatgactggaaaaaaaagggagatgggattgtagcttttatgagcactgctactagtaatgttcacatagcatggctcttgtataatactgttgatcaccacatccaccagcagcaggcaatccggttgccaacgaggaggcagcctcagacaagcacctgagctgcagctagcctagcaatcggaaccctgaaaggggagcaagaaacgttattcagcccagcctttgcgaagaaggccacagacgaaggctcttcaccgtgttcttcacaaatgcccaccttcaagttaggcctagctttgcggcccctctctgttgcaaactttaccagctcgcccactccctcttgggccaggacctcgaaggggtcatgttggaggatgcccttgagcagatagacgggaatgaacttttccacattatccc

SEQ ID NO: 24155 - DNA, 553 bp, Zea mays
  Clone ID: cC-zmle189057a04a1
cctcttgctgccttttttttgggtggggttttgtttttttttccggtttttttttttttttaaaaaaacaaagggggcttaattcccaagacccccacccggttttatccccctaaccctttggcaagggtttttgcccccccccaaaaccccccaggaattttccttctcacaaaaaaaacttttattcccctctcggggggggccccacaaaaaaatttcccttgggaaaaaccaacttggggggggttctgggcaaaaaaccctccccaggggggtggacccccgcggtactcttttggctccccaaaaaaaaacccccccccccccccccctggggggttcacccccccctttaaaaaccccccccccctgcgcccccgcaaaagtgttccccccccctttcccaaaacaccatatatccctctttttggggggggggaacccctgataatctaccaagggcccctcccgcgcggtgtttttttaaacacccgggggtagggggtgggggaccacccacctcgccgggggggggccccccccccccttt

SEQ ID NO: 24156 - DNA, 342 bp, Zea mays
  Clone ID: cC-zmle189057a06a1
agcaagggggattatgagcttaaggaaacatgccttgagtgacccaaaagttacaattactttttaacaaatctttgttacaagcattatttaagttctcacagggatggattgcacttagccaaaatatcatatacttatcggattaatcataccaatttatggcaggtggagatggttgaacacaagaaaatgaaacacttcaagaatcacatgtcaactataagattggggcatcacctagatgaacaaagctgttactagtgtgcgcgcatgggaccaaagctactagcctaaaatccatagattttgaagtcaatttggcagtttacagtaagatcc

SEQ ID NO: 24157 - DNA, 465 bp, Zea mays
  Clone ID: cC-zmle189057a07a1
atcatatatggagagcattgaaacacgaaaatcccttgaacatatatggagagaagattgttgcagtgtcataatacaaattccctcggcggtaagttataatcaaagcaccgttatatgaggataaacaaactccacgaccaagagagtaaacgcagtcaatggagaccggtctttaatttctttgtacgcatggaagcgtgaacatggctatatcagttcttatcgtcttctgttttgtctgacgtgtcttccttcttctcttgctctccctggctgtgcaacgatgccagcaaatctttaacagatggatcattgggatcaacaccaggaagcgaattaaggatagatgacacaaacgttctgtcttcaaacaccttactcatatcagtgtcactggacatgtttgcatcctggacagacatttgaagagccaatgccaagtcagggtcaactgcaccagct

SEQ ID NO: 24158 - DNA, 578 bp, Zea mays
  Clone ID: cC-zmle189057a08a1
atgatctgccccattattattcatactttgtaagggttaaataccgaaacccgtccatgtatacaatccataaacatataaaggggaaagaacctgcatctcacaaacaaactgtaatcaccaccaaaacgcttaggccaataaactgatgagtggaggacggggggaactccaaaagggcccgagagagaaaaacaaaactgtcccgggtcccagactagactacagaaacgctaggtctgattcctgatgctccaggacggcggtggccagcgctcgtcggtaggcagccgatctcgcgttcctgacaaggacgcacaccttccggctctgcaagacaccatgcgtacattgttgtcgcctcaacgctgccagaagctttgcctcgcaaaatgcgaccgccactgcgtgttgcccgttacttcaaggatgaaaacactggtgacaaagcctatcggccacctgaacgccttccgtgcgaaaccaatccgaagcaaatggaggctggtcgtgctgggacaaaccccgagaaataggaactaacatgggactgaggaagctggagctccatttttcta

SEQ ID NO: 24159 - DNA, 429 bp, Zea mays
  Clone ID: cC-zmle189057a09a1
atattttatattttttttctatcttttatttatttttttgtgggttttatttaagtattattatcagtataaaaaaaatattattattaatctaataaaaaaattaattataaaaaatataaattaaaacggggccccaaaaaaatatattggtggcaaaaaaaaaaaaaaaaaaatttcgcaaccaacaaacggttaaaaaaaacaaaaaaaaaaggggggacgcggggttctaaaaaatataataaaaaacacaaaagggggagctccacaaaaaaaaaaaagaggagaatcataaaaaaccccccggaaaaaaaaaaaaaaaaggggggtcccacaaaaaaagaggaaaaaaaaaaaaacccacccccccccccacacatattaaaaaataaaataaagaacatgaacagaaaacaataatacaaa

SEQ ID NO: 24160 - DNA, 381 bp, Zea mays
  Clone ID: cC-zmle189057b03a1
cttaataagaaaatcttaatgggggcgagcccataaatcctaacacatttctcttttatccccccttcggaacaacaacgaatactggaatactaggaggagatattctcttactttgacattccgggagcaccttgttttgttcacaagttcgcacctttgattaaattacaatgcagggctaaacgaattaacaaacagagcaaatctgtagccaactaattaaccagcaacccaaacatgctgaactgctgacgctcacgatgtatcctccaaagttgagaggctgtatgcgcgtcgccgccccctcatttccgccaattagccggcccgggggggaacacgggcgccggcctggggtacttcttgttgagacgcccg

SEQ ID NO: 24161 - DNA, 284 bp, Zea mays
  Clone ID: cC-zmle189057b04a1
aatataataccacccattttttttttcaaccagcagaggccaccaataggggcggggaacgtcatggacacccccacagacaaacaaaggccccgataggccacgacaaaaccagacaggcgagaacgaacaacaaaaagacatccaaccccaggagccgcggggaggaacaccacagggggaaaaaaaggggcgagggagggcacccttaaaaaccccccacccgcaaaggcgccaaaaccaaggcgctgagaaaacaaatgggggcaccccacacccccgcc

SEQ ID NO: 24162 - DNA, 353 bp, Zea mays
  Clone ID: cC-zmle189057b06a1
atccttattatttcttttccagacacaagcccaataagggggggggtatgcggtagcaaaacacagcttataacatatatagggggccacactgctgatgcatatgggagcaacaggggcgtaattttatgcattcatattcgtaacaggcagctaggcaagcagcatactgcataagcctgcatgcaaatgaaccgatccattggttaagctattagatggggttcacgtaaagcccgatcgcttccaggcaattttcaaagcggccaaaaaagccagcgacggggccgttgttatcaccttgacacggaacggggtgcccttgtcccttccgaacggtacgaaagcccgtt

SEQ ID NO: 24163 - DNA, 355 bp, Zea mays
  unsure at all n locations
  Clone ID: cC-zmle189057b07a1
ctaacattttcgacttttagatgattataanccccgagcatgctagcgagaggagccttttcacaggtgtgggccgaacaccacacaccatggataatacaattttcctcagggggatgttgtaatacaagcacttccctgtgccgagaggcggactccaagagcatgagatggatagcgctgaatggagaccgatatttactggatttgtacccttggaagagagatcaagggtttgtcaactcttatcaactactgttttgactgacgtgtagggcttctgctctaacaaatcctggcggagcaaggatgccttcacaggtcaagctgaggacggatgcatatccacaccaaa

SEQ ID NO: 24164 - DNA, 514 bp, Zea mays
  Clone ID: cC-zmle189057b08a1
agcagcaatctgaggacaaatagaagtcctcggaacattgaacttcactgatccaccaatctaataaagacgccacctatattacagtctctggtcgctgccatgtgtgtacactcgattgtaactgacattggctaccgaatgaatatcatgcccctctagcctgtgtaagagcacctgtggttcggttaagggagtaaaactaaacccgttgtagagatgcaaataaataaataattacagtgtagaatgccacggacaatcgtccttggaattgttatatttgcaaattatcaagcgacagttcctcggttgataacatcttcagtttagtgatgaactgcggggggtcatcaagactagaggagccaaggataatttctcttttcagtttgcctgacagcttatgggcaacacgcaacttagaccgagtagcacctccaattacaaagataaataggcgctggcccaactttctgaagtcacttgatgcatgctttagtacagagtcact

SEQ ID NO: 24165 - DNA, 479 bp, Zea mays
  Clone ID: cC-zmle189057b09a1
aataaaggaccagttattaaagtattgtcggcggcttggctgttttgtatatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaaggagggagagagagagaggaaccaatgcaagaaggtgatccgatcaacaggcagaggcatggccatgggtcgatctaaccacggtctctactcgctgtcggggggcttgtatgcgatgaagctgacgcactgcgtatgcctgacgttgtcgaaaccgatgactcggtggaaggcgtccggttacgcggtgatggcctcctgaagcttcttgtacacctgcg

SEQ ID NO: 24166 - DNA, 392 bp, Zea mays
  unsure at all n locations
  Clone ID: cC-zmle189057c01a1
tttaaaataatgccttctcaatcgcatngatttcattcttgggtagccttttccatgtgagctggcttacaacattatcaaaaactgggcaaacagaagacaagcaggcacaactgctatcttcgttgccaattgccataggcataatgtgaacattcagtattacaagccaggaaatgtatatgtatatctatcgtgcacttcattcttctcgtactgctgtacacatggattttttaggtaactggctgtcatggaggtggacgcactcatgaaccttaaacttgaggggtctgttggctaatttgtaggctcaatgactgcgtgcaaaactccatgacagtcagtttcctaaaaaacgatatgtatatttttcgggcacttatattctt

SEQ ID NO: 24167 - DNA, 349 bp, Zea mays
  Clone ID: cC-zmle189057c02a1
atataaaaaattttttttttttttacagaaaaagcacacacaaggggaggttttaagcgggggacacccccggaacacaccaccggcaccggaaggaaaccaaaaatccataataagagggaaaaaaaaacccgggggaaccaagaaaaaaaaaagaatccagggggaaaaaaaaacccccaaacaatcccacacaaaaaaccatccgcaccaataaaaagaaaaccccgggaagcccaaagagggaaaaaacctaaactaataggggcaaacacaaagacaaccttcaaataaagaaaacagtccacccgcccgcaaaaaagagacggccaacccacgggaagagggg

SEQ ID NO: 24168 - DNA, 436 bp, Zea mays
  Clone ID: cC-zmle189057c03a1
aaccgtccctccaaatcacagctgtatatcacaaaaaaatcaaacccccaaaaacatttgacttttccattaagaaacccccccccccccggggggggggggggaaaaaaaaaaaaggagggccccaaaaaacctgtgcccccaaaaaaggggtccccccccgagggggggaccacaaaaagcaaatttacctcacaagaaaaaaaggaggccacaaaaaaaaccccccctgggggccccaaaaaaaaaaaacaacccccacaaaaaaaaaaacactaaagggggggggaaaaaaaaaaacccccggggggggggaaaaaaaaacaccagggacccaccccgccccaaaaaaacacagcaaaaaaaaaaaatcacgcccgaggggggcgccgacaccaaaacccccccaaaaaaaaaaaaaaagaggcccccaaaa

SEQ ID NO: 24169 - DNA, 272 bp, Zea mays
  Clone ID: cC-zmle189057c04a1
tttttcagggtcatatctttgtaatgtggatagagaaaagagggaaacatttaaaaccaatcctagggaaatggtttcagaaaagccctctgggcaacttggtagtcttgtattatacaggtaccagaaacttaacattttagaccaagaaaaagagaaccgtgagcgttctgcacttctgccgcctgttacagtggtcaattatgtgtttttgcattccaaaaaaaaaaaaaaaaatacaaaaaaaaaaaaaaaaaaaaaaaaaaatttaa

SEQ ID NO: 24170 - DNA, 397 bp, Zea mays
  Clone ID: cC-zmle189057c06a1
accgggggggattcatttcattattgcaataatccactttcaatggaattatgcggcaggcaatgaaatcacatgaatttgggtaagcatcggattaaagcccgcgtttggactgctgcagctgtaatctatttagacaaaaacattatagaagtagtagaagtcggtaccaattaaagccgtttaatggctcaaaaacggagctttgtatcaaccattctgtcaaaacctacaagcagcagcctgttaggatacacttcgacgtgaccaaaagcgctggttccaggaggacactccaaggcagcctcaagggggcgggggtgcacaccgggtgagtccacagagtgcccacgcgtccgcggacccctgggtctacccgggaatttcggaccggtac

SEQ ID NO: 24171 - DNA, 375 bp, Zea mays
  Clone ID: cC-zmle189057c09a1
ttttatatattattttttttttttctttttttttttgtgtggggttttttttttgtttttccttcccgtccctttatcaaaaaaaaccccgctttgcaaaaacctaagccccaaatcaccccaaatggaaaaacaacctggaaaaaaaaaaatatgggggacccccccaaaaaaaaaaaaaacttttggacccaccccatttgcaaggccgccccccgtttttctttttttccacaaaaaaatttttttatgggttaaacccccccccgccccacattaacttaaggggccaaaattcattgggaaaggaaacccccccccccccccccggccccgtgggttcacccggaaataccggaccgggccccgggggcc

SEQ ID NO: 24172 - DNA, 295 bp, Zea mays
  unsure at all n locations
  Clone ID: cC-zmle189057d01a1
gatcctcaagagcggccgccctanatataaaaaaatgacatttgnattcacccacaaaccgacaaaaaaaaacagcgggccacaagacaagaacaccaggcgacaacccaaaaagagaaacaccgaaacaccaccccacaaacacgacacgaaaccacagacaaagaacaccaccccaaccaacaaaacacccaaacaaaccccaaaggacacaccaacaccgacacacacacaagaaccccaacgaaaacacccaagaaaaccaaacaaaaaaaaaaggaagcgaaccaccacc

SEQ ID NO: 24173 - DNA, 411 bp, Zea mays
  Clone ID: cC-zmle189057d04a1
ttattttttttttttttttttaccgagcccgacctttacacgggggtgggttttttttttttaaaaagaacccgccctgttttttaaaaaaagcaacggtggggtaaacattttcccatatccacaacccctccaccgccggcgggaagaagaaacccccgaaggaacctctcggtttccgccgataaatttttgtaaaacccgaattttttttatagcttggggaggtttttatcccccccaaaacggggaaaacgcaggattaaaaagggtccgaaagggttttttcgttaaagggaaaccttcttggcccaaggggcgggccccctggttttttaaagacaacagggaaccttttttttcgggggaagaccacctttgggccgggcccctccttccattcttaccccc

SEQ ID NO: 24174 - DNA, 317 bp, Zea mays
  unsure at all n locations
  Clone ID: cC-zmle189057d08a1
aatcttttangtgtttgaccacggaaaacatacgacggggcggggttacatacaataattacgtccgtaccgttcggagcatatgatatcaattccatgctcattatttcatataacaacggtttctttatatatatccctcatgactactattagattatattcttatcgaaagccctgcaatcctactctgttgcatgctttatttccttacgagctttccgttctgaaccttatgcccccggatctctgcctctctttgtcatttgtaatatcgtggctaccacttaattccaagtggttcttaccgtctaatc

SEQ ID NO: 24175 - DNA, 340 bp, Zea mays
  Clone ID: cC-zmle189057e01a1
tttaatttttttattttttttttataatatttttttttttggggtgtttttttggttttttttgcgtttttttctatcttttttaatttttttttttttttggggaaaaaaaaaaatccccagaaaaggctttcgcaaccccctttaaacccaaaaacccccaggggttaaaaaaattttagaaattttggggaagggtccccactgaaaaaaaccccacaaaactttttgggatttaattcaaaaagcccccccccccaaacccgggggggggaaggggaaaggggaaaaaaaagaaaacaaaccccggttgggggggtatttcaaagggacccccccc

SEQ ID NO: 24176 - DNA, 352 bp, Zea mays
  Clone ID: cC-zmle189057e03a1
ggggagggtttttgttttgaacaccaaccccaaaaaatggatgcggcatttttctttttaacaaaaaaaggggagaaaacctacattgacggtaaccaatgagctgatgaaaaaaaaaattcggggggcgtgaacataaaaaagaaaattggggcccccattggggaatgtccagccccaagggaacatttgggtatgacccccccaggggggtaaaccccaccagaccacctgggctttaaattggcacccaaaaaaaaccctccacggttcccggggggaaaaccgccccttatttttgggctgagcacataggggcctttacctccgggcaaaaaaaaaaaatttttgg

SEQ ID NO: 24177 - DNA, 441 bp, Zea mays
  unsure at all n locations
  Clone ID: cC-zmle189057e04a1
tttttatttttttttttttttnncagcaccaaaaagcaccatggtttgcttaagattaactaagaataaagcctgacgggggtaacagcatccattgatccgcagtccatgctgtttgatgcaagggtctgctgaaaccggggatgaacacagcactaacaactggcacagagcgaccttgcaatcaaaaacacagatgggcaacaacaaacacgacacgaacgaaaataaaccctttggactagggtaaacatcacggcagcgaacaggataacttggccgggcgggccccaccgataagttcctccagttcccgggggagatgccgtaaccgccgccacggttgccaccgccgtagccgccgccaccaccaccagaaccggcgacgccaccgtagccgccgccaccgccgtagccggcaccggcatcacggggcccccc

SEQ ID NO: 24178 - DNA, 492 bp, Zea mays
  Clone ID: cC-zmle189057e06a1
gccaataacgaggatgaacttcatgccagggacagttttttttcaccaaccttgcaaatattttccaagtatcaactgggaaccgacaagcagcggaaaagcaggggaggggggcaaaaaggctttaatttaagatcacatgatggaccgacagccattacgagacaagtcttaacaaaacaagacccaggccccagcacaggtaatgacacacctacgccaatatgaacagggcagataagttgaacgccggtaaccattacggtggaattgttgtagcacacagataagctgctataataataaggcgcacgagaatctccattcttcgtcaggatggagaagacaaaataatgtcccgtataagactcctgcagaccacaatacgccacgtaacaacatttttctacctcccacgcttaacctggtcctttaggtgcaccctcatgttgacccatttgtggcccaagcatctgcattacagttcttaaa

SEQ ID NO: 24179 - DNA, 487 bp, Zea mays
  Clone ID: cC-zmle189057e07a1
attacaaaacagcatgcagattgggcgaggcttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttcttgtcggcgaactccttggacagcggcggctggggcgtcaccttgaagttggggtcccttatccgcttcagcgtgtaggcctggaacacgtacagggtggtgatgtaggggttgggcagcaccagcccctgctttag

SEQ ID NO: 24180 - DNA, 402 bp, Zea mays
  Clone ID: cC-zmle189057e08a1
aaaaaaaaagggaaccgtgcacaaacatttttttaattgctaatagtatcctaaagaggactacaagtgtacaaatgaactatgtttcagggtattattacaagcgcaggtgacacaccacgggaccacgccattttattcagtagactacagtacaggttaccccagataactagattaccatcatctcgccctttttacgaactttttatgcgaaacttccaaaccctaatgtggttttcaccatgcgtgggcacaatttttttcatcccaaccgatagggtggtaatttgagggcgcaaacgcctcgggataccgtccaactgtgcatgagggtcaatccttggaacacgttttttttttttttgctggcgggatctaaatgtggcttctgctgggaga

SEQ ID NO: 24181 - DNA, 343 bp, Zea mays
  Clone ID: cC-zmle189057f02a1
ttttggcatttatttttttcccaatagctcaattgaagcaatttaagcaacaaggacaatggggagccggacgtttccataaccataataacaaggttaaccttgtatagtaagaattgaacctttggatctaacaacaaacaacacatccaccggatgaggaaggatttcacctttgaggccaatcctcacaccgtggaaggtttcttgacgtccctcccccgtccgccgccaacgccaccgagcctgggcacatcgaggcctccaccgattccgtcgggcatgaacgaggcaggtcgattctcgatgacctcgtcgatgaggccccagtcgcgcgcctctt

SEQ ID NO: 24182 - DNA, 171 bp, Zea mays
  Clone ID: cC-zmle189057f03a1
tttaaattttttttttttttgcaaaccgcaacttcaatcagggggggatttatataaaaaaaacggacgcactacctcattatacagcataacaaatccaatcacattactattatcgtataaaatacaaccatagggaaaacacacactaacacagaagtaatttcatcc

SEQ ID NO: 24183 - DNA, 383 bp, Zea mays
  Clone ID: cC-zmle189057f07a1
aaaaaaacaaagggggacaaactatattaaatacctattaaaaaaaaaccccccccccgggggatactcccctctcggcgggggaaatgcccatgaaaaaaaacatgcccatccattcggtattatgggggggtcattaattcgggcatcccaactttaaggggccccacaacaaaacccagggggaacaggcgtttcccttgtcggcaaaaaattcgaggggggggagggccttggggacggaaaactctagccggaacttgggcccccaataatggtccaagaaggggcggaaggcgtcctcccccaagggggggaaaaatttccggggtgccacccccacctgcccaagaaaacgccacccgaccccggggtccacccgg

SEQ ID NO: 24184 - DNA, 518 bp, Zea mays
  Clone ID: cC-zmle189057f08a1
ttttattaaattatcagaagtataattttgagtaatcaatgaattgctgcagtccgtagctatgaacttgatacatataattatataaatgaacaaaatggttttaactcagtcaaccttttatacaacataggttgcaagagaacaactgaaaattaacacaagacaaaatggacactaaggaactacagctagcacagtccgtgtttgatatttagcctcgtttaacttgtccatcaacatagtttgcttaacatcagcattgctttacttcctgtccattgtagatgtatttgattttgtatttaactaaacatgttagcaaatattgaagtaaacctcagtcaacaatccataaatagttgaaaatgttgatatgtgtttgattttgtattgaagtgaacttaaacatccttgcaaatatttaagtaaacttcacattcaacaatccataaatacttgaaaatgttgatgggaacagagccctctgaaaaggcagcataccttaagccatggaa

SEQ ID NO: 24185 - DNA, 545 bp, Zea mays
  unsure at all n locations
  Clone ID: cC-zmle189057g01a1
ttttacaggttgnatcatcacaaaatgcccggaagccaatcgggatcgacatctttatatctcagagaactactgttcatatttattattctcacactattccgtttggaactattgggaggtcctacgtccgcacactcaaaactgtatccgcctgacaaccacctcatcatcgaacaaaatacagtagagatgaacttgcaccgctaaacagtgaagatgaacttcaccgctaaaaaaaacctgcattgatgtgtatgtgggtgtgatgcattagtaatccatgccacccatgccgccacccattgctggagccggtgcctcttccttgggaatctctacaattatggattcctgggttgtcatcagggacgacacacttccatcattcacccaagcatgtttgttaaccctttagcggggcaatgataccggtcttcaccatggcaacatattcacctttagcaccttcattacccagttaatatttttttggtcaaaaacttttctaaactactgctccctccacccaaaattgtaggcaa

SEQ ID NO: 24186 - DNA, 319 bp, Zea mays
  Clone ID: cC-zmle189057g02a1
ttatctaatcttttcttacacgccccggcacaacaaggggggggaacttgtgacagacaccctgatggaaacatgtattgcagccctgctacgcatagtagccaaccatgacataattatgcatctgttacaatctaggccagtacaacagatttgtttaacgatgtgagtgcctacacattcgccaaactaacagacctaagtttgacgaacagagggactgttcggctcgtggctaactgcgtcacactttgactaaagtttagcgtcccaattgaaaaactaaccttaagcataaaatccattcaaagaatgacaa

SEQ ID NO: 24187 - DNA, 476 bp, Zea mays
  Clone ID: cC-zmle189057g03a1
aaaaagacataccgagtttctttgagctttttcacagaaacaattatgaaacagacaccgccaagaaacccaacaagtaccagatatttatacttctgtagcaaactaactatttacaacagaagggttctttacctatgggttggttgttttttccttttcctaatagattttccattggttttccttttgatacttttctatggagaagggaaacgcaaggtaagctaaactaaaagaacagatatattttgcctatttattggctaagctacggtcaaaattttcaccatagcaaattgaatcatgtaccccaccgaaagctgcatccgacgaatatcagcgttcatcgttcaagccttccagtgaccacaagcatgccgatgcgagacttctcccatgtccaccacctcttctgctacgccgcctctgcaggtagatgcacggcacctagcccggctagtcgtcagccattt

SEQ ID NO: 24188 - DNA, 406 bp, Zea mays
  Clone ID: cC-zmle189057g04a1
ttccgcctgtttattatcgtacaaacaagccagacccgggggccaggatacaataaaccaaacgccacaccgcccgccgaaaacagatcctagaaacacaggacgaacacgagactacacaatgagacacaacaaccgaacaacccaaaacacagatggcccacagccacaaatacacggacgaagaaaacccgcccgcagcaagttaaacaacaccggagccaacaagccacctgggccgcgcggacccaacacgggagacccatcaaaaggcgcaaaagaacccggaaaccccaaccaggcagccaacgacgtatccggggccaccaccacaggaagccggaataaccacgccacagactccaccaccaatgagcacaccgacagaaagacggcaccacacctc

SEQ ID NO: 24189 - DNA, 399 bp, Zea mays
  unsure at all n locations
  Clone ID: cC-zmle189057g05a1
cnaatgattaactgagaataaagcctgacggggggaacagcattcatcgatccgcagtccatgctgtttgaagcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgtcacggttgccaccgccgtagccgccgtcaccaccaccgtagtcgtcgccggcaccgtagccgccgccaaccgccgtagccgccaccgtcatcacggtgcccggcaccgc

SEQ ID NO: 24190 - DNA, 263 bp, Zea mays
  Clone ID: cC-zmle189057g06a1
gggaaggggttcttacattacagaggggggggaaaaaaaacaacctggtggtccgaaccacacctattacacgtccggtaactttggcatggggggagtccccaaaaaaaaaaagaggagctttacagggggggggacacacccaaactgaccaccggccggggcccgacccgacacgagcagtcgattgtttgagcaaaaaaacgggagtggctggtgcaagcaaaaaggcaagggagccccaccccactaatattagtatg

SEQ ID NO: 24191 - DNA, 425 bp, Zea mays
  Clone ID: cC-zmle189057g07a1
aaaagggcggtaaccagtcaagaacataaacttttaaaaacaggagtagagcggaagtttttacaataagataatattcattaacaagcttataagtttacaaaccacaaagtatttattattacctgccccaggtagagttaaagggctaacttattacatcaactgggaagaaaccatttttccgcagcacccacataatgtacacaagtaaaagtcaccattatgagtttaacaaaactcatatgggttgatagtttctccttggggaggaggaaaggcgggttcttcgaccaggatattgcagttagcaacaaatccaaatgggacaccttctggaggaccttcagtgacaaccttcattggagaaggttccgatgggggaacaagctcccctttcacttccactttaaaattttttttaa

SEQ ID NO: 24192 - DNA, 448 bp, Zea mays
  unsure at all n locations
  Clone ID: cC-zmle189057g09a1
gcgcgcgcgccgcgaatcttcttcntcctccgcgccctcccctcctgccccgggtgactcgctcgattgcgtcggaactggctcggatgtcgagtgcttcgtcgacgccggcgccgaagacgccgctcccctccttcccgcgctctccgcaggcgcgtcaaaggacgatgggaagagcgagggcgacgcggcggtttcggcttcccctacggggagggagctcttggagtgggcatctctggtgtcgcccttcttcttctggggcacggctatggtggccatgaagggggtcataccccgcacgggtcccttcttcgtcgccgcgatacgcctgctccccgcgggcgcactgctagttgccttcgcccgccgcgcgcggcaggaagcagccctccggctgggaggcctggctcgccatcgctgcgttcggactcatcgacgcggcctg

SEQ ID NO: 24193 - DNA, 515 bp, Zea mays
  unsure at all n locations
  Clone ID: cC-zmle189058a04a1
ttttagaanccttaatagcaaattttattcatgatattacgcggggacggcaatctaagatatcatattaagtgcttgttcgattaggagtggattgaagagtattggaggggattaaagcccctctatttgtatagaaggaaatttaatcaccttcaattcccttagatacagacacaaccgaacaagccctaaaagggttgtagtcttatgaaattacacaagggagcatggtctagcatgttgtgaggcggctccttattctgcaactttgctttgagcttcaggctcgcacatggtgaaggagagatccttaggcgctagcacactcttcaacaggcttgaattcctgcagctccttgaagttctcccatggcttctcccagaccttagcttcgtagagcttcttgacttcgccatccttcacttcaatagtgagatagtacatcgtgccagcaaccacttgtgtcttggccttcacaagcttttcgaaccccagaagagcattggccttc

SEQ ID NO: 24194 - DNA, 470 bp, Zea mays
  unsure at all n locations
  Clone ID: cC-zmle189058a05a1
cggnncccccttcacccaggggggaatttgacataataaccctggaaaatctattttatagacctagtggacgggaatacgaatcaatttacctttatgatatgacatccggtttgaaaccacgaaatcgacgacgcctttcagctcaacattccaccgaaaataggggaagtgctgcgtcgaatcgcgctttatttttatccacatggagaactttccggccggggactgatttattttcttctgggcctattcttttcaaagcttggcgttaacgaggatgacgatcaacggcttgttcgagcttttggcgagcacttggggaatatcacccggttagctttgccttcacctgattcttgggatttcttggggatacacgaacaacgacgacctttgattgaagtctttggccgagcacttgataagcgaggacatagaccccggtttttttacataacggccgggat

SEQ ID NO: 24195 - DNA, 450 bp, Zea mays
  unsure at all n locations
  Clone ID: cC-zmle189058a07a1
cntggggggaaaacacccgggagggagtttaacaccttttacttttacaactgttcagggggactactatactctaacaacaaaacgattaacactccaagaataaaaacaacgttttacttgtcggcaccaggggcactttctggcaccctgctcacaaaatattcgagttctaacataaccattacacccacgtaccattcatattacatcaagggttgggcaggacatcactgtgtcaaaacatctttgttagcatgtctttcacaggagcgacggaagaggaaggacgtctcgaagcatcgggcgcaaccttgacgtcagcgacaatgtcgtcaggaaccactacgccgggccttcttattaaaatttgcccaccgggaatggctttgtccatagattggcgggccgagcctttaaaacggcgcagttgtcctctgaagctttgac

SEQ ID NO: 24196 - DNA, 447 bp, Zea mays
  unsure at all n locations
  Clone ID: cC-zmle189058a08a1
tttttagctccnatcaacggnaaggaaacttgcacagtatgggtccactggtttccctgaatattttaacaaagaaaaacgactagtaacacaaggacgttcattttaatgcacgacagttaaatgcccagagcatcagcaagcactgatacattatgtccgcaagtcgagcaggaaaatcacacgatcaagcagcaatatcctcgggagggcactgcgcaggttgggcatcagaagacaggtctgtgatggacatcagctttgatctgaacttatccgccccatcgcccagcttcccgttttctgcaatggagatcggtgccttcacagtctcgggtgaaggtgtcttcggaatggtcttgggagattgcgatgagagactgacgagctgctttcctactgaactctggtggtgaaagtgaggccattaatcgtaggcagcgagcg

SEQ ID NO: 24197 - DNA, 259 bp, Zea mays
  Clone ID: cC-zmle189058a09a1
ccaaagacagcaaatatccttggggagagaagaacaaagagatgctaccggccaacacaatacacacaagaaggggattccacacccaaccgatcgaaatgacgaataaccccccattaataaacccccgccttataaaaatagccccggctggaggccggaccaccaagcaaccgaaaacgaggaaacaaaaaaagaatcaccgggctgcaagaacaagacctgggggcagccccaatgtaaaaccaccaaccaccaa

SEQ ID NO: 24198 - DNA, 458 bp, Zea mays
  Clone ID: cC-zmle189058b04a1
cttcagagtccaggaagcagcctctatcattgttggggccccaaagtgtttacacaattcatggtttcttgaatcagggtctccctccaagaatagataaacacacggagcgaaaacgatcagtgtataaactggacacaaaaatctgtatgtggagatataacattgaaaagtgtctttttattatctatattggcattggcttccaattgtgaataaaaaaaaattgagaacttgtatgaagcttcccttacaatgggaggcattcaggatcctcaacaatctttgcaaatgtttgcaggaatgctgcccaatcagcaccatagataatcctgtgatcagcagtaaacattcaccaccatttcactcttgatactaaagaaaccattcttatcagccactacagtaggtcttgacgcttcaacagccatgatagcccccctgaccagcgggaagga

SEQ ID NO: 24199 - DNA, 416 bp, Zea mays
  unsure at all n locations
  Clone ID: cC-zmle189058b05a1
aatcgacatttattcgntgggcatcaggtgagcagtgcattgcccggcaggaaacacagttacagtattattccatgcacacttgacagaaacgcaaacagagacgacggtacggtgtatcagttgtccatggcgacgccaggcagctggaaagggtcgtcgtcctggttgagctgctgcttgagcatccacttcttgaaggggtggaagaggatctccttggagcaggtgtactgctgcggcgcggggcagtcgatgaacgtgccgttccccgccgcgcagaagtagagctggaacagcatgtacttgtcgaaggggcccttgctgcactggatcaccggcgtcgcgttgatgccgctcttgaagaccttggtgatcgccttgaggccgtagagcccgaagtccggctcgatacc

SEQ ID NO: 24200 - DNA, 313 bp, Zea mays
  Clone ID: cC-zmle189058b06a1
aatccttttccatcaattatcgtatacaaatatccacacggggaggcttttatttacaaataaccccacggaaccacccacacacaccaaaacaccaccaaaaaggccaacccaaccacccccccccccaaagacaaacaaaaacaacatgcaaaagaaacacacaaccccacaccaccgcaaacccccaaaatactcagacagccacaacccaccaccacaccacgaagaaaaacaacgcacccccccccaaagaggaaggcccacaccccaagcccacccccggacaaacaaaccaaaaaacaccccgggt

SEQ ID NO: 24201 - DNA, 436 bp, Zea mays
  Clone ID: cC-zmle189058b07a1
ttaaaattcttcctcttttgcaaagaaaaccccattaaatggggggggttttattatgttatcgcgggaggtaaatacccacccgtccgcccaacggtccgggaaaacggggggccacccctaaaactccgaagcgggacccggaggggaaccaaattttcctaaaggggagcggaaaaaaaattgggggaaacaagggaaaaacgcggaccccgggggaaaatgttatcccccaacaaatccccaaaaaatacgaaccggaagcaaaaaggggaaaaccgggggggcccaaagagggggccaacccacaataaaggggggggcccaaacggccgcttttaaaaggggaaaacgggggggcccgcagattaaaaaaaaacgccaacccgcggggagaaggcggctgtcaatttgggcaccagggggggtttttttt

SEQ ID NO: 24202 - DNA, 129 bp, Zea mays
  unsure at all n locations
  Clone ID: cC-zmle189058b08a1
tttttacctancttttctaattatacattttatatggggtgggttttatttaaacctcccaaccttaaccccccccaaaaaaaacaagcggaacccttctcaaaaaacacccaaaattacccccccccc

SEQ ID NO: 24203 - DNA, 444 bp, Zea mays
  Clone ID: cC-zmle189058b10a1
ggccctcagatttcgaccaagggggggttccaccaaacagaagcacaataacagtgcaatgcgagcagcgcatcctacactaacatacaataccaacctctgtattagaggacgaattttacatctagaacctggccgttgcgccacttgcacggaggaactggaaagtgaacacagctcatttcttattgattcgtatgggtccagaaagccaagagaaatcaagaaaaataagactagcggactcccccgagctcaaatgaacagaagctttcatggcgatcagacctgtagtcggggatgcaagaatattgttgggtccaaccatacaacaatacagaccatgagagcattatcagatcttgaaggcagcaaacaggtccccctggacgtagtcgttgtcaacgaggctgaccaggttgtatgttttttgaacccggacgc

SEQ ID NO: 24204 - DNA, 467 bp, Zea mays
  Clone ID: cC-zmle189058b11a1
aagccttttcctcattttccggcaagggaggccacacacaaaggccggggaactggtaactagacaagagtcaaacacgatctcctcctcgtcactaacgctacagaacatgctgggccgttatttattgttttgcaccttgccccaccaccagactaaacgggaactggatcatcatcacctaggtagattggtaggtaggaaaaaaagacagaggcgacccccatctgctgcgtttcgaccggcctccggagctagccccggctaagtgcagcaacagcaaaagcagtcgagggagccctcgcagggctcgtatcatccaaagcaacacaccgcatagaaaatgccggcgtttaggcaaaccctctcctcggggggcctctgcaagtgctccagataagaatattctgggccgaacgggcggtagacaacttgcctgccttgcggaatccatccgagctgtggtg

SEQ ID NO: 24205 - DNA, 261 bp, Zea mays
  Clone ID: cC-zmle189058c04a1
ttcacgcaataactaatcacctaggagcatgcataaatacggaggggtatcagaggttgttgcgtgaagaccaaaacatgaagagatggacagaacggcggactacaaatccacgaatcatcatctattccatgaatggatatccaacgatagctagcttaaatagttgacggtgatctttcccaccattccggttccttgatgctgcttctaattataagccgtttgttccccataccgtatagggagactgatttatgt

SEQ ID NO: 24206 - DNA, 411 bp, Zea mays
  unsure at all n locations
  Clone ID: cC-zmle189058c05a1
ggaaagaaaagnagcactgatgggggggacatgacgaaggttgagcatccatggaggctaaattatagacagacaccctgattttacacgacgaatcgcaagaagcgcatgcattggatatccttaaccggagagggcgctggtgttgtaaacgaggagggcgccgccgccgaggatcccagcgagggtgacggcccatatcagaagcccagtggttccaccgacgtatacgtcgccggggggagaccagtcatcctcgttgtagattgggctgtatccgtcgacgttcgcgccgtacttgtcgactaactggtacacgcccttgcccttgccctttctcccgttggcgtcgacgtcgacggtcaggccacccccaatcccgtagggcttgtcggtcttgatcttcttttt

SEQ ID NO: 24207 - DNA, 465 bp, Zea mays
  unsure at all n locations
  Clone ID: cC-zmle189058c08a1
ttttanttttcttattntacaaaataagcatacaatagtggtcaaataaccttataatgatccatagttttggcttgtctcgtgtacacagtcggaaagagaaaccatgctaactaactgcagcggattgaagcacaggagtacttgaagtggggggaaaaaactccataccgaccgatcgaggaaaccggccctcaagcgcgcgtgtgtgtgcagcatggtgctggcatctgatctgacgaggggattcagaagaacacccatttggacgccgtcttctccttcatggttctggagtggaagagctcggcgccgtcgccgtcgccgccgccgtcgccggtgtgccgccgcctcttcgcgccaacgagcctggacaggaacctcccgatcttcttctttttgccgcttttcctccttttcggctcgccctttcccctggccggttcgttctggctcgcgggcggg

SEQ ID NO: 24208 - DNA, 430 bp, Zea mays
  Clone ID: cC-zmle189058c09a1
ttttaagatcgacgactcatcatgattcgaaagagaggaggggttactgaaactaacccggttctacgcgcgcgcactcgactggactggattatcgtctatcgatccagatagagacatccaagaatcgattgcttcctccgatccatgcatttccatccgagatcaggtcccttttgcatgcgcatgcagttgagctagcgctggatcagagatcgatcgctatctggtggtttctgctttggcggcgtccaggccgaggagcctggtgacggccaccggcgacagcctgccggggctgacgaccgcggcgagggcgagggccctcctgcccttgcgctccttgatggtgtcgaggcgcggagaccacgcgcggcccctggcggcgcccaccagctgctcgtagtgcttgcgcagttggggcgtgctg

SEQ ID NO: 24209 - DNA, 303 bp, Zea mays
  unsure at all n locations
  Clone ID: cC-zmle189058c11a1
cnctattgttcattttcttccttaccgagcaaacgggagcatttcaagcggatgagtataacattgaaagccccagcccaacactaacagaaacagttctgttcacctcccaaaactcaaacacaaattcctatggcagaaccacaggtacccccataacacaatacacaattgctgaccgacgcatcgaaacagcactactcccacggcaattaactttactcgccgaccccatagtggctatcagcaccaccggcagagctcagcaggtcgatacctctcaatgaagctggccatcctctg

SEQ ID NO: 24210 - DNA, 385 bp, Zea mays
  unsure at all n locations
  Clone ID: cC-zmle189058d04a1
ttttnntttcctgaatctgaggctnnaagnatagcataggggggggtttcatgacgagaactcggaattgaaactagtagaaatagtcaaatacaggacgcatttcatcttgctatgtaagcaacgaagtcgtcaaggtccttgcgcgaagacccgccctcggtcacagagcggcgaataaactccatgagctccttggccctctcccgcaccgccaaacctttattgcgtgccatcaccttttcgatcacctcgcggatggtttccgcaggtgtcacagcactgtgttgctcccatggccttacgaggagcccggccttgaggcacttgcacacgagctccgccaccagcggctggttggagtgcatgggccaagcgagcatcg

SEQ ID NO: 24211 - DNA, 323 bp, Zea mays
  Clone ID: cC-zmle189058d05a1
tcaaggatctatctatttaacggacacattcaaattttcgagggggtttttttagagaaacccccccgaaacaaaaacccaatacggtcctaataaaacctgtaagacaaactaaaacttcggcccactccaggtcacaacaaaaaagggcgtaattgaaccactaataaactttacccccggggggccactcaacacattaaaatacagcccacccaaaaatgtgggcccccccccacccatgacgatcataaaatgaaatttctccaaagccgcccccttttagaaaaacaaaacagtcgctaaattcaaatcccaaacaa

SEQ ID NO: 24212 - DNA, 513 bp, Zea mays
  Clone ID: cC-zmle189058d07a1
actgttcattttgctatcaaaaacccggcggattcctctctgggcgggtttcatagcgggagccaacaaagggaacaacaggggcaccagcacctaatccaaagggtgagcgggccccaacacggtgacggaaaccaacgggcacacgaggctctagatggatcagaggactcggacgcacccaagatgggcccacacatcagttcctccagccaccggcagcggcgccgaagccgtcaccaccaccctcgcgctgaccgccggagtcgggaccgcctacgaagccgaagccacgaccctagcgccgaccggcggaaaacggaacgccgtcaaaaccgccaacaaagaacccgccagaaaacatcacggcgacagcacgcggcgcctaatgaccgacctcaccgacaacgataggggactgggcccggtcacggtgaagtcgcggaacccgagccccctgccggacatatgcatcaaaccacccagcatggagagctcgatgagaaaggaacg

SEQ ID NO: 24213 - DNA, 364 bp, Zea mays
  unsure at all n locations
  Clone ID: cC-zmle189058d08a1
aaactttttcctgattaccaagaagnccacacccaggagggggggatattactgagcacgagtgcggaattactgggggtgtagtacttccaaaatcacgtttcagagctatagactgtcaacgttctgacaagtgctgatcagaaagggtccaagaaaaaaaagaagtgggggcagatcgaacatcctagcacgagtaaatttcccatgagtgcggtcacgggcgtcaaatgctatctaagttggcagtacaaaaacatggttccataaaattggtgcccggtaactcttggcttatagcacaacatttcagtgcccacagatcttggtcacgtcagccttcaaaaacttgagccctcccatg

SEQ ID NO: 24214 - DNA, 363 bp, Zea mays
  unsure at all n locations
  Clone ID: cC-zmle189058d09a1
tttttnncttcattttcttgtnatatattttttttgggtgggggttttttaagtttttctggcgggtaaaaaccaaaaagggggggggaatgaaaaaaaaaggtgaagaaaaataggagcaaantggggagggtttgccagacgggaaaaaaaagggaaagggggaggaagctttaaaaaccccccccggcccaaaaggaaaaaaagaataggaaaagaaaaaaaaaagtgaaaaccaaagggaaaaaagggggggcattcggggggcaatggggggggaaccaaaaaaaaccccccgggggggaggaaacctaggggccccccccccggagggggaaaaaaaaaacccttcccccccctcct

SEQ ID NO: 24215 - DNA, 102 bp, Zea mays
  unsure at all n locations
  Clone ID: cC-zmle189058d10a1
nnaaccattttaataatacaacaaagacngaaacagccagagaaagactttaatcaagcgcacgggccggaacccccccccacactaaacaacagaacaaaa

SEQ ID NO: 24216 - DNA, 431 bp, Zea mays
  Clone ID: cC-zmle189058e03a1
tcttttttattaattttggatattggattagcttaatcggggggatgctattacacacgactctagctatagctagctcatatacaaaccattacatgatatatagatacacatacgcatgcatcatgcatgcacatatatatagtatgtagtaatctataatacttaattacacgcacgcgcgctatctctcgatcgtgaagaagagagattgctagctttattccggtccgatgatgatggaggcacatatatatacatagatccttggttctacaatacgttgacagtaatctgtatatatgcttcgggtagtggttttggttgggtcttattgtcttcaccgccgtctgcgtcggggtggatgacgacgagtcgctcgccgtcgccgacgccttgaacagaacaggaacgccgttggcgcgaacgct

SEQ ID NO: 24217 - DNA, 395 bp, Zea mays
  Clone ID: cC-zmle189058e06a1
tatagcaacctcacctcaccgttatgggtggattaacaaatattccaaaggtgcacgcgcatgcatgatgacgatgacgatatagatgaacatggtgatgggatgatcaggaaggagctagcctaggcggcctgctggctcatcatctgctcctggaactcgggcaggtgctgctcctggacgcacatggtcatgatgcgggcgccgggcttgggcttaggcggggcgccgatgacggcgacggccatgaacgggtggtaggagaagggcaggacgtgtgtcggggtgccccagccgtagtccgcctcgaggaagccgaggcgcgtccagtcggagacgaagagcgagtcgtaggtgaaggtgagctcgtaggggtcgcggtcgaagccgcccgc

SEQ ID NO: 24218 - DNA, 444 bp, Zea mays
  Clone ID: cC-zmle189058e07a1
aaaaggggccaggaaaaaaatttgaaacgggcaatggccatgactgcaactttggttgagccgaaacccacatggggagacaagatttgttaacaaaggttttttgtttaaacaaaaaaaacctggggactggtatacagcattttattggaaaactaacaaaaaaccccttttgtttttttgggcgggaaaaacccgcccggggggaccttttcagtttaattgacccacccatcagcaattttcgggtttttcaatcccaccgggatgcccgaacgaatgtaaaacccctcggaggttttacggggttcatctcccccttgggagggggggaaaaccacttttttccctatcctcccatttttggctaagaaccccctttgaacacgtggtttccctccaaacccaaaaggaactttttcttttggaaggaatttttctttt

SEQ ID NO: 24219 - DNA, 518 bp, Zea mays
  unsure at all n locations
  Clone ID: cC-zmle189058e09a1
atacttacataaaatacccggcacgnatataatcgatagggggggatgtattgaagaacagaggttcgaaccatggagcagtttggaagttttacatgactggggaaaaaaaggacatgggatcgtagcttttatgagcactgctactagtaatgttcacatagcatggctctgtaataatactgttgatcaccacatccaccagcagcaggcaattcggttgccaatgaggaggcagcctcagacaagcacctgagctgcagctagcctatcaatcggaaccctgaaaggggagcaagaaacgtaatccagcccagccttcgcgaagaaggccacataggaaggctctccaccgtgttctccacaaatgcccacctttaagttaggcctagctttgcggcccctttttggatcaagcttaacagcttgcccacttccctctggtcaagacctcgaaagggtatttttggaaaagccctgtgccagatagacgggaatgaacttttccaccttattcc

SEQ ID NO: 24220 - DNA, 447 bp, Zea mays
  unsure at all n locations
  Clone ID: cC-zmle189058e10a1
ttttggcatcaattatcttttctctgnttcacaaggcacacgtttttgttcaccaattaaccctgtcaaacggccagccaccaagtcattgacatagttgatgttgtaacatccggatatccaaggacatgcatgatgaacatgcatatgtagccaccaagtcaaaagcaagtgaaaccctcatgtttttcggccagcataatacaccagcaaacgataatgtaactctttggtcacccttcaaagaggaaggtccagacccttgcccacctccaccccaatcatctgaagaatccccttgttcagcaccagctccacaatgaaggtgccgatgaggccgatcatgcaggccctggagttccaaatctccgcggtctgggtgaaccccaagaagggctcgctcagctttcggttgcaccctgggcgcttaacccctggaggaagttt

SEQ ID NO: 24221 - DNA, 312 bp, Zea mays
  unsure at all n locations
  Clone ID: cC-zmle189058e11a1
acctttcnctccttttccggaggattccttttttcggggtgtgtttttttaggttttccgccgcgcccccccccaacacgggggaaaaaatttttttcgccccgccaaccaagaacaaataaccctaaacaccccccggcctggggaaaaaaccccgcaggcctttggtggggggggcggcacggtaccccccggggaaaaacacccccccccccacacggaaacctccccgccccccctccacaaaagacaaaaccccccccccccctctttgacgcgacaccccaaaaaccccctccccttggaaagggc

SEQ ID NO: 24222 - DNA, 366 bp, Zea mays
  Clone ID: cC-zmle189058f03a1
ttttggatgaaattgcgtgacaagcatagggattatgcaaagggagggtatcgatcgtgtagcaactcgggcttctataggaacacaacttgaagaaccaaccagctatagcgggtccagggtacaaccgtacaagcatatttcctcaagccgagcacaagcgcccgaggattttttacatctacagacgtcctccaatatgaaaacacgaaacatggaatactagcagcgccgtccaacttttaagaatcctgcaaaaaacaaactgtaatgaagaatggtcaaccagttcctctttcttccccggatccaatccaatggagcaccttaaacgaattaagcgaccgcgggcatgtccttaagcca

SEQ ID NO: 24223 - DNA, 328 bp, Zea mays
  unsure at all n locations
  Clone ID: cC-zmle189058f05a1
tttttatttctcnttttttttctaccttatcttaccgttttggggggggtttacaaatattcaaaaggtgcgcccacacgctagatgacagatgcgagtttatacgaacatggagaagggaagattaggaaggaacttccctacgccgactgctggtacaccatctgatccagaaaaaaaaaacgttctgctcctgaaaaaacaagggcataaagcggtccccccgctccgccaaaaaaaaagcccccgatgaccccaaaagccaagaaccgatggtaggataacgccatggacgtgtgccttttaaaaaaaaaaataacccgccaaa

SEQ ID NO: 24224 - DNA, 51 bp, Zea mays
  Clone ID: cC-zmle189058f07a1
gaaaaaaaccgcccgaaaaccccggccacaacaagaccaaaacaaaaggag

SEQ ID NO: 24225 - DNA, 305 bp, Zea mays
  Clone ID: cC-zmle189058f08a1
agttttaatcatttttagtcatttccgggaaaaccacataaaaggggggggttatttatagttttgcggggcaaccccaaaaaacaccttatttaccttaaaaataatcttaaaaataaatctcgcactgggttactaatattctttatcccctaaatcccagctgttttattcaagggtgttcgtaaaccacagttaaaaaactgtaataaaactatttcaaaaagatacctttctaaaaaaaatacagttgggacacaacaaaatcaattaatataaaaataaaccccttggacaaaggataa

SEQ ID NO: 24226 - DNA, 392 bp, Zea mays
  unsure at all n locations
  Clone ID: cC-zmle189058f11a1
tntttccctccntttttcagagggagggcaacaaccgggccagtggtttttatgggatcaacgcccaccaaaaaccaaatcaaatatttattttgaggggcatttccacccctcacgcattagggaaaaacaagttgccatggatttgcttaagaactaattgcatcagcaaaacagacataaaacggcccaccagcttcaaattcaccggagcgagggcgtgcaagattgtttgctagaagtgcagacttggaaacaattcggaggcttcttctcagggggggaggcacagaactctttgccgttggcaactcggggccgattgccgccaaagtccatcacagtacatgggaaagccagacaggagcctccgatgagggctgactgaacac

SEQ ID NO: 24227 - DNA, 393 bp, Zea mays
  unsure at all n locations
  Clone ID: cC-zmle189058g03a1
tttngcatgcatatttcttgtgnaangnaannncaccaaagcggtgcatatgagtgagacatgtgtcctggcaatgccgttaaaaaaccaagcagagcagggttgatgctagacatgatcaaacccgagacctaaacaaacaagttcctaaaaaccaagacagtgcaccactttaatcctttgatctgtgaagtacagagcaagcaagaacaggttgatcgagggagacaagacgagcagagccatcgcattatgaaattagtatcgagtcccagtcgatctccagggaggggtacttgcgaaagtggaagctgtctgactcgtcccatggcgcttccgagaagtcgagccagtgcatttccggcaccacgtttgaagacccattggaggaca

SEQ ID NO: 24228 - DNA, 398 bp, Zea mays
  Clone ID: cC-zmle189058g05a1
ttggcccagcgctcataatcaaccgggggggctgtcagcataatactccaggatttacacatccacagcttttcctccctctaccgggggtcccgatccagccagctcctcaggctgcacagcgcctcctcgacaggcccttcttgcagctcctgggcctggccggcagctcctcctcctgctgctgctgcggtgtaaacggcgaccccatctccggcgcgaagcacaccacgacgaccgtcaggttgtcggccgtatccagccgcttggcctccatcaccagctcccgggcgcagcgcgcggggtcgtcgtgctgccgcaggccgcgccgcaccaggctcaccgcgtgctggctcgtcatcacgtcccaaatcccgtcgcaccccatgacgaggaac

SEQ ID NO: 24229 - DNA, 523 bp, Zea mays
  unsure at all n locations
  Clone ID: cC-zmle189058g06a1
acnnnnttcctttttttttaaaagnaggaagaaaacaacggggggggggtttttttttgtttatgggccgcaacaaaacaccaatattcttttttttttaaaaattcagggtttgtatacaaacacaaactgcaagctaaacccgtttttcccaacaaagaaatggagattttttttatttgggtttgcgagagaactcccccccttcattttaaaggggagagggcccccactgttttaaagggctagcggggtttcaaaaattggcccaaggggttgggttggagaaaaagccctcccctttggccatcttggacaagggtttcggggaaaggggtttctcgtccccgggccacccccaaaactccttgttcgaaaccccccccactttgaacacctcacccggggcgcccaccccggtttcctttctcgggaaagaatttatggggtcctttaaaaaccgccccctttaaaaaaaaggcaaattttttttggcaccccccgggggggggcattccccccc

SEQ ID NO: 24230 - DNA, 406 bp, Zea mays
  unsure at all n locations
  Clone ID: cC-zmle189058g07a1
ggatcctctagagcggccgcagtggggtgcgccgccaacatctccttcggtcacgacaacccggccgncaccgggggggcgctgatcgccggccggatctgcctcgtccgctccctcgtctactgggccgcgcagctgctcggcgccgtcgacgccgcgctcgtgctcaggctcgccaccggagggatgcatctgccggagtacgcgctggcggggggcgtgagcggatggaacgcggtggtgctggaggcggccatggcgttcgggctcatgtacgcctactttgcgacggtgatggacaaagcgcggagggtccgcgccggcgccggaacgctggcggatcccctcgacagggggctttaggcaggggccaacttactgtcctgcggcccccttgagggcgcaa

SEQ ID NO: 24231 - DNA, 453 bp, Zea mays
  unsure at all n locations
  Clone ID: cC-zmle189058g08a1
ccgaaaaggaanacnacacgggggggggttttttaagaaaaaggggggccatcccttcgaaaccatcaaatttgatccccttccattattaaaaaagcgggggctagattagcactccatttgcaagcgggtttgaaaatttaaataccttcacaagcaaaaacgcccccttcgttacaagcttggacacaggcttttaaagccccaccaatagctggtgcaccaggggcatttccccaagggtgtcccaaaggccccccaccaaattggaaaacggaatcatctccaaaaattttgggcaaaggtggctttttccaaacatgaatacccccagaagcccccggttaaacaccggggttggataccccctcccgagggaaaaaaaaacccggggaaccaccttttttaaaaaaaacatttgcgccaaaaaacaacaaaacccaaaggtatttt

SEQ ID NO: 24232 - DNA, 288 bp, Zea mays
  Clone ID: cC-zmle189058g10a1
tttttaaatcagttttcaggagacaaacattttttgtgggggagcttttttatatggctactgcgagatctttatactcctaaaattagattttgatttttcccttcttctagtggatctaaccaaaaagactattaaaaccggaacagagcctatacatcaattacctgacagaaaatataggcggccccgcgcacaaacacaataaacatgcacctgaccaaccagataacccaactcctacaaaatggccccacctgggcatcaacgggccgggacatccaaccc

SEQ ID NO: 24233 - DNA, 461 bp, Zea mays
  Clone ID: cC-zmle189058g11a1
tttttttttcccttatcattttaattatttatttttggggtaatttttttttagggttatcgacccttttccacctcttttacttttatataaaatcatatttcacaaaactataaacacaacaaggggaaaccaacacctttcccccctatcttctccccccacaaaaaaaaacacaacaaagaggaagccccaaaaaaacaccccccccaaacaaaaaaaaaaaaaaaggacccaaccaacaacaacggactctttttttttcaaaaaaaacaaaaaatagcccccccccctcccaacatgaggagaaaaagaaaccccccccccacccccccgggaagaaaacaaaaaaaagtccatacaacaacataaaaaaaaaaaaacaaagaacccccccccccctccgggcaacaaaaaaaaaaacaaaaccccccccccccgcaaaaataacacacccccac

SEQ ID NO: 24234 - DNA, 313 bp, Zea mays
  Clone ID: cC-zmle189058h04a1
tatcgacgatccatcttaactactaaaaacatacggccgagaagagaatgaatttcgtgtacaaacgaaacatccacgcgccgaatactcaatcctttaacacattaaataactagtataatctatacctataccaagtgcgaagcgccttctacctactaatgaagccccccgtagattatcggttggctgatggcacgcctagcacctgaatgttataccaccccggcgatcgccgacactaacctgcccgcgccccatcatccaataaacaaaaactgcccaggaagaacgtcccttctcacccaacgcc

SEQ ID NO: 24235 - DNA, 409 bp, Zea mays
  Clone ID: cC-zmle189061a01a1
gcagcaccaagaagcaccattttttccttaagattaacttagaataaagcctgacgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccggtcagttcctccagttcccgtcggagttgccgtagccgccgccacggttgccaccgccgtagccgccgccaccaccaccgtagccggcgtcgccaccgtagccgccgccaccgccgtagccgccgtcgacattac

SEQ ID NO: 24236 - DNA, 494 bp, Zea mays
  unsure at all n locations
  Clone ID: cC-zmle189061a01d1
acccacgcgtccggtctgctagactgtcgacagattccgctccaacgcgcacctgctgtcccgcacgccctcgcccaccgtcgcctttgaaaaagctggaggattctcgagagggagaagcgcgcctggcagctccgttccatccgcccccacgaatgtccgacgtggccaagcgcgggcccgcgggcgccgcgcaagcgaagctccgggcctcctccgatgaccgcaagccggagggcgctgggtccccggcggcggttgcgcacaagatccagctcaagagcgccgatatgaaagaggagatgcggcaggacgccttcgaaattgcccgcatcgcgttcgataatgcactgcatggagaaagacatcgctgagtacataaagaaagagttcgacaagaaccacagcccaacctggcactgcatcgncggccgcaacttcggttcatacgtgacgcacgagacaaactactttggatatttctacatcgactc

SEQ ID NO: 24237 - DNA, 450 bp, Zea mays
  Clone ID: cC-zmle189061a02a1
ggcgaagtagtgctctacagttgaaacaaattgttctttacaacaatttatattttccgcctcaaaatcaacagatataattgttgaaaacttgacttcacacggtagggaataggatgcgcagtgagccagtgaattgtgtatcaaaaccaggcaagtcacggccagaccaggcctcatgtgtaccgcagcacctggcacttgcagcaaaatctctggcaaacatcaggcttcttcaaagtccattactcgcggttctgtaactgctgagctcatttcgcatagacattcaaccttactcgcgctgtcacgtttgggtgaagcttgatctctgcaacatactcttcgatttcacggatttctggaaccgtcaccagcttcttgtcgacatccctattaagttgtgactgtattatgtcaacaacattctgtgccgtgacactcccaaag

SEQ ID NO: 24238 - DNA, 320 bp, Zea mays
  Clone ID: cC-zmle189061a03a1
ataatgatatggtttgattgcgaaagaacatcaggagggaggcgggcttgacagacagacgatacgaccctgcgaacgtgaatgctaagctagggcccccccacactagtttggctggttatcgggtgggctcactttttgctcactttttgttgagggcgatgccggccttgcacgcgacggggtttaggccctgctttttgatggttttgagggccttggtggaaaggcccattttgacgaaactcttgccggcctcccaccacagttttttttactgcaggttcaccaactgctggttttttcgtttgggggtggaa

SEQ ID NO: 24239 - DNA, 413 bp, Zea mays
  unsure at all n locations
  Clone ID: cC-zmle189061a03d1
cggaattcctgggtcgacccatcgcgtccgccgttccgttccttccgtccatccatccgccatggcgaccgctacactactgagctcctccttcgccatgcccgccgacgcccgtagggcctactccccttcctccgcctcatagagcttcgccacgtcgcagatgggcggcctctccctctccggcggcgatgcaactccaaccgacggcgacctactccccaagaggcagcagctccagcccattgtcgcgcagcgtgtgtgcccgtgcacggacaagaagacgaaccgggcgaacaaggagtcgctgtccaaccacagagacgaagaagcagcacatncgagaacctgcagcacaagaagctgctgagggaggccggcaagcgctccgactagctgcgcctttccaccaa

SEQ ID NO: 24240 - DNA, 462 bp, Zea mays
  Clone ID: cC-zmle189061a04a1
aggattacgaagaagttttattcaggtcacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcaattagccctggcgaggaagctctccctgcgctcgtggacctcgccggtgcaggtgttgatgtcctcttcgaccctggtctcgcgcaccacgaaaccgtggccgccgtggtgaccatggtggtggtggtggttggcgccggcgcgtgagaccgtgtcgacctcctcgaacttcttcttgacaacgtgctgctggacgccgccgccgtggcggccgaagccggccggggccaccgacctcaccttcttcgagcagtagtccacctcctggtagtaagccattggt

SEQ ID NO: 24241 - DNA, 490 bp, Zea mays
  unsure at all n locations
  Clone ID: cC-zmle189061a04d1
gaatgctggggagaccctgcgtgctctgcttcagtacttgcacttttacgtcacacaggcgctgagctctgacactccaagcgtcggcaccaagaggcttactaccaggaggtggactactgctcggaggaggagtggtcggtggccccggccggcttaagccgccacggcggcggcgtncagcagcacgtcgccttagagaagttcgaggaggtcgtctcgggctctcgcgccggcgccaaccaccaccaccaccatggtcaccacggcggccacggcttcgtggagcgcgagatcagggtcgaagaggacatcaacacctgcaccggcgaggtcctcgagcgcatggtgagcttcctcgccagggctaactgagccggccggaggtctgcatccacgcccgctcgagctagcctgcgagccttatgtatgtctgcggctgactggttgagcacggtcatcgtacttggctatcgnacgtgcacgcact

SEQ ID NO: 24242 - DNA, 475 bp, Zea mays
  unsure at all n locations
  Clone ID: cC-zmle189061a05a1
aaaaaaaggactctggattcgacatgggggtatggtatatataacacagcagtagcagacgggtggctgcttgaattgatcatatcccgtatgcaaaggctactagagatacacatatgtgtttagtcgtcgatgcatgtatgcatggcatggcatggcatgctcatgaactaccgatgtacttgtcgatgaggggggggagcgtggacttcgggacggcgccgatgacccttttctttttttcgccgcccttgaaaataaacacgggggggatgctgcggatgccctaagtagaccccacgttggggctgtcgtccgtgttcaccttgcagcacgtgatcttgccggcgtagtccttggccagctcgtngatcaccggggcgatcattcgggacggcccgcaccacggggcccagaacttcaccagcaccggtgttttgcacgccatcacggacacgtgggcggacccgtgggt

SEQ ID NO: 24243 - DNA, 350 bp, Zea mays
  Clone ID: cC-zmle189061a05d1
tttcttttttttttttttttatctttttttttgggtaaaggggctgttggtttttctcacaaaataatcccgggcgcgatgtttaggggcaattggggggggcaccccccaccccaaccaactggagaaaaaccccttcaaaacccccctcccccgcgggggtttcccaaccccctagatttggggggggcccccttccccccccatggtttcttcccgacattataagccctacgagcttttccccgccccaactggccccttggatgccttgtgggggcccccctctttaggagggcaaaaccggccttcaactaaaaaaccccaaccaacttccagtcccccgcccc

SEQ ID NO: 24244 - DNA, 480 bp, Zea mays
  Clone ID: cC-zmle189061a06a1
ccctcgtctcaccctccctccctcacacaaataataaggaaaggtcccgcccttttcctccgacatccacaggggggaggggaaaacacgtgcattcacccggcggcaataatggcctcggttccggctccggcgacgacgaccgccgccgaaacctatgcctttgcgtcgccctttcctgtgccggggttgacaaccccaacctccccgactacttaatccagggccgggtgtactgggacacctgccgcgccgggttcgtgaccaacgtcaccgagtacatcgcgggcgccaaggtgaggctggagtgcaggcctttcggcaccggaaagcttgagcgcgccatcgacggggtcaccgacgcgaccggcacctacacgatcgatcttaaggacagccacgaggaggacatctgccaggtggtgctggtggccaacccgcccaaggactgcgacgaggtccaggcgctcagggaccgcc

SEQ ID NO: 24245 - DNA, 448 bp, Zea mays
  Clone ID: cC-zmle189061a07a1
aataatatagcaaccccatgcaagaccattgcatatgatatgacaataatatatcaggtgattcaggtcatcatccaacctggaatatctatgtcaggcaagcaccaaagaactaaactggggcatctgtctaccacacaccgtacatgcatgcttcgtacaatcggggatgaagcagcagccagcaggtgagggagcgggtgcgcatcaggatcagcctccgcgcgcctccctcctggtggcgtcgtggaggatgtcgatgtccacgccgtcctgcgggagcagcacgtaccgcaccaccgagcctctgatgaagcaattccgcactgaaagcatgtggggatacttgtcctggtcgactacgcgggtgttctcgagcttgatgttgaggtactggtcaaccgagtggagcgtcccgcggatcgccaagtcattcttgagctccact

SEQ ID NO: 24246 - DNA, 495 bp, Zea mays
  Clone ID: cC-zmle189061a07d1
agactatagaggatagcatagattgattagatagatagatgacacagcacaaacaaattaaagtcgcagacagatcgaacaggggcatggcccgatgctgtactgcacactcggcccacacagcacaacacaacacaacacagtctgactgctagatgagccccaggaaggacatgacaggacaggacacgacacgacacggcgccaacatctcggtacaattattcgttcccccatcagtaccaccactagagcaaggcgatggagcagatagagcgaggcatgctatgccatggcccatggcacgcggctgactgtctaactgactcgaacaaaacacagcaaacgacactgctagaatattatatactagctagagcttattaattagctagagagataaagagtccttccgaccccatcagggcctgcagaccctgcagcgtcatcgccgccaccgtcgtaatctcacttgcaggtgcaggggtcgcaagt

SEQ ID NO: 24247 - DNA, 66 bp, Zea mays
  Clone ID: cC-zmle189061a08a1
tttttgtttttttttttttttttttttttttttttttgggtggacgcttggttttattccctgaat

SEQ ID NO: 24248 - DNA, 623 bp, Zea mays
  Clone ID: cC-zmle189061a08d1
ggttgacccacccgtccgaattcgttgagaaggcattctagaaacactagtgcttccaaatttgcatgcaaatcttcctttggtggtagtgcccctttgaagaatggtgaatttcagaagatgttggaaatggaatcacataaaactatagtggtaaattgccctgatgtgagcatccctgtagtggaagagacaaaaccactcatatgcggaatcactgaaatggatgatggccttttcaaggacaagcaactttccactaaggagattgcaacgtatggattgtatctttgccccttatggtttgtgacagagtatttatcgaatgcagcgcttgcaagaactagtgttgccagtaccacagtgctgtcttcaacttcaggactcttcactcttttcattggtgttttacttggccaagactccataaatgctgcgaaaattattgctgttttcattagcatggctggcgtcgcaatgacaactgtgggccagacttgggcatctgatgaatcagatgcacgcaaatttggttttacacagaggactctacttggtgaaatgtttggtcttatgttagcaatcgcctatggtctatttactgtgctgttaaaaaattttgt

SEQ ID NO: 24249 - DNA, 337 bp, Zea mays
  Clone ID: cC-zmle189061a09a1
gccgagccgagaagagacccttctacaaaggctgttgccgctcgtctgactctggctgtgtctctgacttgaagtacgggtctggagacgcggatgggcttacatgaaagcgcatttttcagagagctgctcttgagcgcctaacagtaggtgagctcaggacacacgtcgtaggaaaactgatacataatactaacacgaactacatgctagaagagggaccgaccgttaagggtcatgtacggatgagatatcagactgcaaaaaaggcatagccgatagcgcacttccgttgaaacttaacggaggtttagcgaagggcaaagatctgaaattt

SEQ ID NO: 24250 - DNA, 351 bp, Zea mays
  Clone ID: cC-zmle189061a09d1
ttttaccttaataaattcaatgctacacaggcggccactaatagaactggatgaccccggtaacctttctagctgagacgaacacatgacactaaaaattattcccactttcagaatggatgtgatggctccattatatatctatttctcctactacatgtatcctgaactgaacaaatttgaggctgcacatgatggactgactgaaaaaaggaccttccttaaatccaagccgcatctgcacaagcatgcaacatgggtgaagcataggcagagatgagacgacgcggcaagagaccttgacgacgggtcacttgtgaaacggctcggccgctctaaaggattcaagct

SEQ ID NO: 24251 - DNA, 394 bp, Zea mays
  Clone ID: cC-zmle189061a10a1
catgcgaagacaaatgactgagaaatgcgaacccaatccagatgaccatgcaagtcaacatgtctcaaaataacaggatagatacccaaacaacagacacagggctcacaaccaatagattttaacagatcgaagtatacgggcacaagttcaaaataaacgagggcacatgggaggacgcttcatttcttctttattgcagcctaggtcaccttggcaccaagagggtccttcttctccacgctcttgatgactccaacaggaaccggctgccttatgtcacggacagcaaaacgacccagaggaggatactgagagaaggcctcaaccaccatgggcttagggggaataatcttcaccataccggcataaccattcttcaagaacttgggct

SEQ ID NO: 24252 - DNA, 494 bp, Zea mays
  Clone ID: cC-zmle189061a10d1
cggaattatcgggtcgacccacccgtccgggatctcaaacgtgggtacgtggcctccaactctaaggatgactttgccaaggaggctgctagcttcacctgccaagtcatcatcatgaaccaccctgggcagattggcaatggctatgccccagtgctggactgccacacctaccacattgctgtcaagtttgctgagctcataaccaagatcgataggcggtctggcaaggagcttgagaaggagcccaagttcctgaagaatggtgatgccggtatggtgaagatgattcccactaagcccatggtggttgagaccttctctcagtactcctcctctgggtccgtttgctgtccgtgacatgaggcacacggttgctgttggagtcattcaagagcgtggagaagaatgacccaactggtgccaaggtgaccaaggctgcaataaagaagaaatgatgcgtcctcccatgtgccctctcttattttgtactt

SEQ ID NO: 24253 - DNA, 384 bp, Zea mays
  Clone ID: cC-zmle189061a11a1
aatataaaagcacatataatatcaacaggttcacaaaacgtatgcgtcacacgtttccatcggcaagcctaacatagcacattctgcatggctatagggtcccacctaacaaagtacatatttttggagattataccatcctcgtcatgtttgtgagtgttaatgcttaattaaccgagtagcacaccacaatgatgatttatacctcattactcccgatcttagagcaaaataactatcgaccacatttggagactagaagcacataagaatctagaaaagtactttcttacttctgggacgccacaaacatcatccaaaaaacttcattattgaactataactcataagcaatctaaaagatggcaccaccaaagatgggtt

SEQ ID NO: 24254 - DNA, 531 bp, Zea mays
  unsure at all n locations
  Clone ID: cC-zmle189061a11d1
cagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaacccaacagtgttctaccaacaacccatcattggtggtgccctcttttagattgcttatgagttatagttcaataatgaagttttttggatgatgtttgtggcgtcccagaagtaagaaagtacatttctagattcttatgtgcttctagtctccaaatgtggtcgatagttattttgctctaagatcgggagtaatgaggtataaatcatcattgtggtgtgctactcggttaattaagcattaacacacacanacatgacgaggatggtataatctccaaaaatatg

SEQ ID NO: 24255 - DNA, 391 bp, Zea mays
  unsure at all n locations
  Clone ID: cC-zmle189061a12a1
ggatgctccaaagccccccacaaagggggcattatcaccctttttttttatcagnccatgcaaattcggcccgcctggttattatctctacttggcattttaccaacaaaagagagattcaggtaagccctcccactcgcaattcctcggaactgcccaagcttatccgccaagctttttgaagcaatctcgaacacgttttcggagagcccattggccgacacgatcatttccaggtgggccttaacaagagcttggctgggcttggcgaaccgcccccaccgagaaaatgctgaaaccatgcgggagggcccctgaagggttttcttgtgaagctgcaaaacccggacccgtgggcggacccgtgggtccacccgggaattccggaccg

SEQ ID NO: 24256 - DNA, 415 bp, Zea mays
  Clone ID: cC-zmle189061a12d1
cccacgcgtccgcgttttgcagcttgacaagataaacctttatgtggcctcccgcatggtttcagcattttgtcggtggaggcggtacgacaagaccagacaagctcttgctaaggcccagctggagatgatcgtgtcggccaatgggctctccgaaaacgtgttcgagattgcttcaaaaagcttggcggattagcttgggcagttccgaggaattgcgagtgggagtgcttaactgaatctctcttttgttggtaaaatgacaagtagagataataaacaggcgggccgaatttgcatgaactgataaaatataagtgtgatgatgcccgctttgtggggggctttggagcatgcaaaccaaaattaaaagaagtatcttaatgtgaacaacccaatctgatgaaaatgttgg

SEQ ID NO: 24257 - DNA, 424 bp, Zea mays
  unsure at all n locations
  Clone ID: cC-zmle189061b01a1
atctccacaaaatatgattaaaatagtacgatacaaagtaatctttcagcttgctaccaacgcagtgtatatataccgtataaaccatcgtataatgatgactgattagacgtattgcagcatccttattctgttattactatgatcgctattcgctacgcagagagtatgattcggatatcgatcggtatagcacacacatgctaatgacgctgtccacagaagcaagtgctcgactccacgtccacgcacgcctgcgaagggaataccagagcgagttcgtcagacgcactcgagcacttgcttctgcttgcaccaccatgcatgcatgtgagacgctgattcagacaccgncgncgatgccaccttcaccttcgnccccagcaccccacgcgtccgcccacgcgtccgcccacgcgtncgn

SEQ ID NO: 24258 - DNA, 408 bp, Zea mays
  unsure at all n locations
  Clone ID: cC-zmle189061b01d1
ccaagcttagctcgctatggaaaattaatgaggtttatattgagtcaacactttcacgtgtctgccaagcagtaagtcctgagtggccatagagttcttggatcaaaggctgcatttgcatgccgctatacacattaaatnagaaattatgatcttcgatatttcaagttctgagagataacacggnctccaaagatgtcctgatgctgcgagcgaatgcgtagaaaatgctcggaacgatattccatgtaagtttttgttcgtatgttctgttgctccatctattcttactgcgatccaaaaggagttcgagagtcatgaactttccgntgatcttttatatgtcaccttggctctggccagagggnttagcacttgactaacagnttccgcgtaaattcagggcgc

SEQ ID NO: 24259 - DNA, 423 bp, Zea mays
  Clone ID: cC-zmle189061b02d1
ccctcgcgtccgcgtcggcgacggaggacgcgctggccgctatggacacgctggagggcgcgttcgccgagtgctccggcgggaataagttcttcgccggcgacgcgcccgggtacctggacgtcgcgctgggaggcttcatcggctggctgcgcgcctgggacaaggaggggggcgtcaagctgctggacgccggccgggtcccgcgcctggccacgagggcggagcgcttcgccgcgctcgacgtagccaatgaggtcatcccggaccccgaccacatcgccgagtttgccaaggagctgcaggcacgctccgcggcagctgccaccagcaactgagctcgcaagtgaatgctgctgctctgccttcctgataaaatcatatcataggacccgggtaggtcgtttaatctggcgcggaaaa

SEQ ID NO: 24260 - DNA, 441 bp, Zea mays
  Clone ID: cC-zmle189061b03a1
atcgcactaacacacttttttattcaaggatccaacttttataaaaaacccattttcttaccaataccaaaaaaatttggtaatagcaattcggcgatgatttattcttcactcattttaaccaacatccgaagagggcttcactagagctaattttaccacacaaacaaaaattagcttaccacaagggggtttgattggtcctaccaaccacattattcgcttcatccatttaacaatttagctaacaagaataatagaccagtttaccgacccaaaccaactaaaaaaataacaacctagcttaccacaccttagggcagattttacaaaaaccacgacgatcacgggtttaagcttaacaccaaacacctaacaagggggacttactcactttactggggacaccatttagctttatatgccaatcgtttacttcga

SEQ ID NO: 24261 - DNA, 523 bp, Zea mays
  unsure at all n locations
  Clone ID: cC-zmle189061b03d1
cccacgcgatccggcctccctagccttccctagctagcgcctcccccaggcttgcgcctccattctcctccctcacganagctcgcggctgcggccctccattctccatgctcgcttcctccccatgttccctccatagagccagcgcatcctatggcatccagctcagccagnagagatgctcccgcgcagcagccccccatttttccataggcagctcaggccagcacatgatgtcttcattcggccatagagcgcctcatcagncgctagctcccatgccctatgtatgatcgcctcccctccagccttcagcacgagcgcatcctcctcatagggcgcaccctctccctgcctcggcatcatacgtcgaccagagccttgccaacgggagctcacccacgtaggccatgcctcccaactccgntctaggatcggctcagctcctaagcaccacctcgctgccgntctagatgtagagcttggcccctctgacgttcacccagtgagcagcaacagcgcc

SEQ ID NO: 24262 - DNA, 338 bp, Zea mays
  Clone ID: cC-zmle189061b04a1
gaggactccgaaaataactcccaatttatttccactgtttccaggcagagaagccacgttggttatttatttgaatacatggatttatttttttatgccaaaatgcctccgtttcagggcgtagtatgtaccggtacattactgggtcatcgcatatgcaacaagagcagctttggctttttcacgagggtttttcattcattacagaattttgcaaccgggggcccgtcaacaactcggggatcgggtccaacagtaacattgattatggatgaagggtaaacgtttttgtcattattgaagcgaggaagcttttgaatccgcccaagggcaatgat

SEQ ID NO: 24263 - DNA, 476 bp, Zea mays
  Clone ID: cC-zmle189061b05a1
ttttggtttttttttttttttttttttttttttttttttgttttttttctatttccatgcattatttatttgggcagaatattctcattttggcatcaagcagcaatacatgatttgtcaggaaaagccccatgtctccaacttttgcagagagatctaaggcgcaggtagtccacttacattttgcaaataatgtactgcatatgggaggacagcaataagcggggggactgcacattgtttttttgcaacagtaccagctaagcatgggctaatgagtcctgatagtaaagcactggaaattgtactggagcttgttttgcccaaagaatgattgacttattgttatatgcaaggggggggctcataaatcagatctctccggtagcctctgatccttgggtttcgcataacttccagcctcccttaattagtcaagtgaatggaccaaaacagctaatggtggggtcagtttg

SEQ ID NO: 24264 - DNA, 123 bp, Zea mays
  Clone ID: cC-zmle189061b05d1
agggagacgccacgcgggcgactccagagagtgaggctcacgacgaaggtcaggggttgctccacaactctgaggaatacatcaagatgcgtgaaggtgtgatcccctagtggacctagaagc

SEQ ID NO: 24265 - DNA, 558 bp, Zea mays
  Clone ID: cC-zmle189061b06a1
tcggagcccggtaccgacgcccaccacgtcgtggtcgggttgcgcactttgtagcacgccggcgggtggaggtcaggaggctcgtgcccccgggcgcgggctaggaggacgagaccgtcgcagtcgtccaagatcacgttgtgtagccccttggcgtcggggtgcagctccgccatcccggagacgttgacgaaccgccgcatggtctccttccgctccaggaccatggcgttggggcgtgtgagacgcgagctctcggtgtcgccgtcgccgtccacgcggcagaggaaccccgccacggtctgtgcgaacagctggcggtggagcgggtctgtgacgaggccgcaccagaccttggagacgcacttgaagcggtggagggagttggcggggaggatgctgaacatctcgatgagctgagatgtcatgttcgagatcagtttgttcttgcagctgcagacaacttgtcgattcgttgcttgaggagcagccatggacagaagaaaccgaccagctctgttgataattttggttttcttgggactctctttatgaagt

SEQ ID NO: 24266 - DNA, 602 bp, Zea mays
  unsure at all n locations
  Clone ID: cC-zmle189061b06d1
attnttgggttgacccacgcgtccgcccacgcgtccggttgtcagcaatggccaccaccgctgcgtccagccttctcaagtcctccttcgcgggctcccggctcccttcggccacgcgcaccaccaccccgtcgtccgtggccgtggccaccccgcgcgccggcggcggccccatccgcgcgtacatctcctcccccaacccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtcgccatcgtggagcagtccgtgtccccgggcggcggcgcgtggctgggcgggcagctgttctcggccatggtggtgcgcaggccggcgcacctgttcctggacgagctgggcgtgggctacgactaggccgaggactacgtggtggtcaagcacgcggtgctgttcacgtccaccgtgatgaaccggtttctggcgcggcccaacgtggtgctgttc

SEQ ID NO: 24267 - DNA, 368 bp, Zea mays
  Clone ID: cC-zmle189061b08a1
ttttgtttttttttgttttttgatgaaacaaattctcaggccaggattacactacacgactcccaacaggaaatggaaagcgggagcctgtaccgcccgttccgggactgcctacaactcatatatatatataacatacctctctttcagggaagaatgagcataatatcatctatggaaagaaccctcgcccccgggctgtgcctatccaagagaaaagaacccggggctgatgctgtcgacaccttggactcggaggcctaggggttgggcttgcggaaatcctccagagggtttgccctgctggccggcggacgaccgggccacttgggcggcaccacttgcgccagatcaaccacgcgttggct

SEQ ID NO: 24268 - DNA, 606 bp, Zea mays
  Clone ID: cC-zmle189061b08d1
attattgggttgacccacgcgttcgcccacgcgtccgctttttttttagtattactcctcattaggatgtatatattaatcatcctattttaatatatattaatgagtcctattttaattaggttctaatccaattagtagtaagtattttcttttttatttaatagcctctgactatcattaaataaagggtagagcaattcttttttctagagattctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctataccacattaatgggagtacatttatgtttctgctataccaatatgatatttattggacatttctaataatagcaagccttattcctattttggtattttggatttcaggac

SEQ ID NO: 24269 - DNA, 304 bp, Zea mays
  Clone ID: cC-zmle189061b09a1
aaaaattgagattttttttttttttttttttacacgggggggcaacaaaaccaccctcttccaacagggctcttaccaggggacaactccagaccccccaagattaaaacaccgcaccgccaaaaataacaagggcttttgcccaaacccaagtcaacccaacaaccaaaacccaacaacaaaacgacgaaaccaaccctgtagaaaaacccaataagcccaattcgggttatcaaccccccccctggggccccaaaagccaaaaaaaccaggccgggaaaaaaaaacaccagcttaggccccg

SEQ ID NO: 24270 - DNA, 614 bp, Zea mays
  Clone ID: cC-zmle189061b09d1
aattattgggttgacccacccgttcgcggacgcgtgggccgagacctgatgctcatggcgaggcccttctggaacttagagtttacacctcccagttcccagaatgctggtcggttgatagaagatggggaaccttgcgtagatagtcatgctcagatactggcatacggctctcttgctggtaagaggttggactgcccacaatccgtggtcactttgtatcctgcgtgagtgtaaatagactgagggcccgtttggtgcccatggaaccgttgtctggaacaatttctggtaggattgcttgctgatttgtataggctttgatcagctggaaacaaatgaacaaggcctaagctcgtgtctttctctcacgtccttgctttcttagcctcatggtcaacaagaatggtgttgataacacgatatgtgcttattgtattgatctagatggctagctgctacgtactgcaatcagctactagcagttgagatgacctgtattctggaataagcccttgctatcttcgcctgtactgctatctaatgctaggaagcatgtatatgtatactgggaaacgtaacgatggcagatgtgagtctgattgcccgccctg

SEQ ID NO: 24271 - DNA, 376 bp, Zea mays
  Clone ID: cC-zmle189061b10a1
ataaatacatcttttggtctgctgtaatagattcttcaagtagaggcaaatgcaatacaaatgcccgatttttccatgagcagaggaggacaatcacattttaccatgggatgccatgatcaatcgggcatcacaatcaagccattgcataaacatgttctccggcccgggttccttcacttgaacatggagatgtcaaacacacgggcggagccatctgatgagggggagaccatggggttgccgtcggcagtgatagccagcgactgtacttcatttggatgcccactgaactccctggggcaggctccagagagggtggcccagatgcgcaccttgccggcaatgcatcctgacccaacgtatcttgacgaac

SEQ ID NO: 24272 - DNA, 484 bp, Zea mays
  Clone ID: cC-zmle189061b10d1
cccacgcgtccgcccacgcgtccggttgttcgaggccatggcttccattctgatggattgacatgcttatcgatgacttcggattcacaaacggttgttagcggctccaaggacagttctgtgcacattgtgaatttaaactcgggccaggtcgttggctcattagcaggccacaccagttctattgagtgccttggtatctcgtcaagctatggctgggtagctacagggagcatggatcaaaagctgatcatctgggacctcacgcaccaatccagccgatgcatttgcgaacatgatgagggcgtgacatcactgacatggctaggttcgtcaagatacgttgcgtcaggatgcattgacggcaaggtgcgcatctgggacagcctctctggagcctgcgccagggagttcagtgggcatgcagatgtagtacagtcgctggctatcactgccgacggcaacaccatggtctccgcctcat

SEQ ID NO: 24273 - DNA, 458 bp, Zea mays
  unsure at all n locations
  Clone ID: cC-zmle189061b11a1
ttttagacataaagaggtagtgtttattcatacacaaacttactacacgataccacgatgcagatgcagcgcgtgatgcgtctggcgagcatgacacaagcccctttattagaagtagagctagttgcttcgtctccagagcctcactagacaactccctccactaggcagcgcggtagcacgagggcgaggcgcatggatcaagccgaggcgcaggatgcgcagttgcaggacgccccgcatgagcagttagccctcctgttctcgcggccggacggcatcgaggcccggccacacgtgcacgggctgcactcgcagtgctccccgcagccgcaagtcgtgtgctcccgctgcccgccgntctccgacgtgcacctgcagtctttgccgccggggcacggcacggcgcacccgcactttgtcgtcgcaccccatgcccgatcgacgcctcttaattt

SEQ ID NO: 24274 - DNA, 552 bp, Zea mays
  Clone ID: cC-zmle189061b11d1
acttgtgctcccccaacgctactaccgccgctagctggttcaagtgcggcgagcggagccggagaccggtagaggaaattaagaggcgtcgatcgggcatggggtgcgacgacaagtgcgggtgcgccgtgccgtgccccggcggcaaagactgcaggtgcacgtcggggagcggcgggcagcgggagcacacgacttgcggctgcggggagcactgcgagtgcagcccgtgcacgtgtggccgggccacgatgccgtccggccgcgagaacaggagggctaactgctcctgcggggcgtcctgcaactgcgcatcctgcgcctcggcctgatccatgcgcctcgccctcgtgctaccgcgctgcctagtggagggagttgtctagtgaggctctggagacgaagcaactagcactacttctaataaaggggcttgtgtcatgctcgccagacgcatcacgcgctgcatctgcatcgtggtatcgtgtagtaagtttgtgtatgaataaacactaccactttatgtctaaaaaaaaaaaaaagggccggccg

SEQ ID NO: 24275 - DNA, 504 bp, Zea mays
  unsure at all n locations
  Clone ID: cC-zmle189061b12a1
tagttaaacctgcacaggtaattccttttgagctcgttccagtgattcaagcagggtacactcatgcttattctatattacttatatcattgatgatgagaatatgtattctcagactcgacacatgtgtgcaactcatttaacacaccaccacagcaaggtaagcttcgcaatccgatagagggatgcttacaaataggcctaaatcatccccaatctccccttgacgagatataccacagcaaggaaggctggctggcgctcaattacaccgagtcggcatggaaccaccatctggtctgcttcggcgacctcccgttgcgggagttcctgacatagcggtcattgtccatctggacgttgctttgctggcgaactagacaacatagacaggatactgattcagacagagctcacggncatcgctggagatcacgagtcatacaaaatatctaagnagatgtgcccgntgctggagatgtgtggatgcattggcgctggatt

SEQ ID NO: 24276 - DNA, 567 bp, Zea mays
  unsure at all n locations
  Clone ID: cC-zmle189061b12d1
ccaagaacccaagcccctaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacngtgtaattgagcgcctgacagcctttcttgctgtggtatatctcgtcaaggggagattggggatga

SEQ ID NO: 24277 - DNA, 405 bp, Zea mays
  Clone ID: cC-zmle189061c01a1
aaaaaaaagtccggttttagtatatatatagtatcaaatcatatcatcggggaccaattaatatatggttacagcagatgcaatcggatcaaccaacatgcaggtagacacacgtacgtacatgagcacaaagactgaccccaaacatgcagagagagatagcaaactgaagaactttgtttttttttttttcacacacaccacacaatacctatgtttggcagccagctcggccttgcttattattgttcaaccaccaccacaagctagatagataataatcatatccatgggcgtcgatcgatgtgatcagcagttgcaggggtcgcacttgcagttgccaccgcagctgcagccgtgggcggcctcgccggactccgccggggcctgacgaactcgggcgcg

SEQ ID NO: 24278 - DNA, 386 bp, Zea mays
  unsure at all n locations
  Clone ID: cC-zmle189061c01d1
ttttggatttattgacaatgtcaactagaatcgactaatggagttcctcctattccacatttatgggagtacatttatgtttctgctttacgaatatgatattnctaggacattnctaataatagcaagccttattcctattttggtattttggatttcaagacttttagccccggttagcgaaggaccagagaagctttctagttatgaatcgggtatagaacccatggggggggcttggttacaattccgaatacgctattacatgtttgcgctaacttttggtgttttggatgcggaaacaatctttctctacccttgtgcaatgtgtttcgacgtattgggtgtatccgattttatcgaagctttcatttttgtgcttatcc

SEQ ID NO: 24279 - DNA, 204 bp, Zea mays
  Clone ID: cC-zmle189061c02a1
catgagttaacagaagcgaatagaaggcaacacaggtacatgccacaccatgctgcaatgctttacaagatctaacagaagaaatcaaaagatagtcgaaaactgcggtataagcaaacaacattccacttccaaatctgtcatcatctcttttatgtatcagtatattcatctttaataacaggtatttagcggacgcgtggg

SEQ ID NO: 24280 - DNA, 286 bp, Zea mays
  Clone ID: cC-zmle189061c02d1
ctcgctcctagccgcggacaagctgaagctgacggtcaagatcggcgaccagacgccctttgcctaggtgccgaccgggccgtcgacgctactcggctgcaaggcgttcggcgtggacaccaaaggctccagtatgacgtgctccgtgctggacgtccccagcaagggcgtggacaccgcgaagatagccggcttcgcgctagccacctccgagctgctagcctaggacgccagcacggatggcacgcccaagaaggtgacctacaacaagatcgacagcaaaacg

SEQ ID NO: 24281 - DNA, 164 bp, Zea mays
  Clone ID: cC-zmle189061c03a1
atatatcatacaatttttttcctacacaaccttagtgtaccccctaacactaacaactaagatatattaaaaaatttccataaataatgcaaaatcttttcttttcggaaaatttttttaaaaaataacaatattaaaaaaaatactatccctaaacataaaaa

SEQ ID NO: 24282 - DNA, 465 bp, Zea mays
  Clone ID: cC-zmle189061c04a1
ttttgttttcagtttaaactttaaacattattaaaatgagagcggtggatgggatattgagtatatattgtattcccgcacaagtcactctaaatcgagactccagctttcaaaggagaacaagtacaaaccccacgatctttatctgccctagcagaactataaaaaaaatgggggagattggccaaccagaaagagaaaagcttaaaccctttaccatcaggggccaaacaaagcgagcggaatttttatgactaaaataaacagctcatatcggaccaaatggctcagggagcggtgtaaacctattataaaacactgggcttggaccaaacttgccatccacgctgtgcaaccaactcatgcccttggggggcaagttcagcaccattccatcgcatcgggaataggcatatatatccatctgattgagaatcttttttttttccactaatcgggggaacc

SEQ ID NO: 24283 - DNA, 198 bp, Zea mays
  Clone ID: cC-zmle189061c04d1
ccacgcgtgcgcggacgcgtgggaaaacataaaaaattaaatggcatttttttatttcacaataaaacataaaaaaaatgggggtagtactaccttaagtcacccgggctcccgacccccacctaggtctctccctctccaacggtgacctatgcttcacaggccaccgcaggaggatcaccctcgtctctggggatc

SEQ ID NO: 24284 - DNA, 429 bp, Zea mays
  Clone ID: cC-zmle189061c05a1
cccacgcgtccgcttttttgtttttttttttttaataatattcagataccatagctttcagacgggactcgtcgtcgatcccggcccacgaaggtttcgattgttcaacaaatttgactggcttttgcagcacaagattacgaagggattgcgactgggaatggctatgcccctatgcagcagaagccaaatgctgaaatgcatgggtctcagcagctcttagcatctgtttatatattagccgacgaactttaacagtttcagacatgatgactgggtgtaggttcacagaagcaccctcctgcctcctgcgtgggttctacttggcgtcctgatgatcctcccccttctcttccttccagaccggaaggatgccttgcccagccagtcttttgtaaacccagaacaccacgtacttgggcgttaccc

SEQ ID NO: 24285 - DNA, 421 bp, Zea mays
  Clone ID: cC-zmle189061c05d1
gtccgcccacgcgtccgcccacgcgtccgctcgaggcattctttttaccttttcacatttaccgcgcaaacatcacacaaccgcaaacatgggtgccgtagtttcctgcatcaagtccatcttccgcacgatcggcaactgcatcatggccatcgttaacgccatagccgccggattgaaagccatcatcaacgccatcgtctccctgttcggcatcatcatctcctgcctgacctgcggacgcggcggcggccgaaagactcgcaccactcacacgagtagagtctaaacagtcttccgtcttgacctccgctgacactgagagtcagcctggatgacgagacgggagtagggcgtccgaagttgctgagcgatcagcaaagcgacctttcctgacatcgcgactacgacttcgactgga

SEQ ID NO: 24286 - DNA, 143 bp, Zea mays
  Clone ID: cC-zmle189061c06a1
tcaataagggccagcacgtatggttgtaaatgttgccgttatcagttctggctgtgtcgtttgtgggcgattgtgaactactagtatgttagtttctatccgagccggaggcgatacttaaccatggatacttgttgtgaaaa

SEQ ID NO: 24287 - DNA, 286 bp, Zea mays
  Clone ID: cC-zmle189061c06d1
gtccgccttcgcctcctctttctctcttttgcttttgtgttgctgtcattttctttgatagtgtgcatcggcaccagcaggagggggagtaattcatactagcgggcggtgtgatagcagcagtgtgatctaggagaggattgcggagttcatccacgaggacttcttgaacaagcgcaacgagtctgtgagggagcataggcgcctggaactgcatacgctgcacgtggagaggaacccccactcgttccgggaggcgctggcaagcccgggagtagcccgagga

SEQ ID NO: 24288 - DNA, 564 bp, Zea mays
  Clone ID: cC-zmle189061c07a1
ttttttatattttttattttttttaaattttagggtttagttattttatatatttcccttctattttatttttttttttttacaacatccatattttttaatatatcaacatctcaaattttactatctttaccatccctttaaaaaaaaaaaccaaaaaaaaacccaacaaaaaataaaattttttaaaaaaaaaaaccccccattaaaagcacccatactcaggacaccctaaattaaaaaaaaaaaaaaccccccccaaaaaagggtttctccccaaaaaaaagaccgcttaaaaaaaaaaaaatgtctcaatcgcaaaaaatttttttttttaaaaaaacacccaaaaaaagtaccccccccccatcgaaaaaaaaaacaccccccccttctatttaaacaccccacaaaaactccaaaaaaaaaatacttaaaaaaaaaaacaatacatcataataaaaaacaaaccccttccacaacaaaaaccaaaaaaaaccccacaaacttgtccaaaaacactttcctcgtaaattcataggctaaaacaccaacaagagcgcc

SEQ ID NO: 24289 - DNA, 456 bp, Zea mays
  Clone ID: cC-zmle189061c07d1
cggggacgcgtgggtaccagcgctcagtcaactagccatggtgatcttctttcgcctacctacaacagcaacaactggggtggggtagccctctcgctggggctaatgcacctacatacctgcaacaacagttgctgcaacagattgtaccagctctgactcagctagctgtggcaaaccctgctgcctacttgcaacagctgcttccattcaaccaactgactgtgtcgaactctgctgcgtacctacaacagcgacaacagttacttaattcactagcggtggctaacccattggtcgctgcctttctacagcagcaacaattgctgtcatacaaccagttctctttgatgaaccctgctcttgttgcggcagcaacccatctttggaggtgccatcttttacattaccatatgagatgtactcgataatggtgccctcatagtggcatgtgtt

SEQ ID NO: 24290 - DNA, 152 bp, Zea mays
  Clone ID: cC-zmle189061c08d1
cccctcccagtaaaaaaaaaaaacaaaaaaacaaacaaccaaaaaaaaaaaaattaattttaatgaaaaaccacactatttaaagcgtgggggaagctctctaaatctaatctattttctttcctatattcatcccaaaaacgcaaaacact

SEQ ID NO: 24291 - DNA, 409 bp, Zea mays
  Clone ID: cC-zmle189061c09a1
atcgaaaattggggagggtttgaagaaccaagttttgaaccatgggcccggcgggaaaggtcacctgcccggaaaaaaaaagggggatgggattggagcttttttgagccctggtgctaggaatggtcccattgcaggggccgggaataatcccggggacccccccatcccccagcagcagggaatccgggtgcccacgaggggggagccccaaacaaacccccgagctggagctagcctaacaatcggaaccctgaaagggggggaagaaacggtatccagccccgccttcgggaagaagggcccagacaaaggctctcccccggggtctccacaaatgcccaccctcaaggtagggctagctttgggggccccctctggaggaaactttaccagggcgcccactccc

SEQ ID NO: 24292 - DNA, 623 bp, Zea mays
  Clone ID: cC-zmle189061c09d1
caattattgggttgacccacccgtccgcttatccgccaatgttgctgagaaagtgttcgccaatgtgggcattactatcgggtacaaagttggaacaatgatggagagccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggccctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgattcttgctcccctttcagggttccgattgctaggctagctgcagctcacgtgcttgtctgaagctgcctcctcgatggcaaccggattgcctgctgctggtggatgtggtgatcaacagtattattacagagccatgctatgtgaacatacttagtgcagtgctcataaaagctaccattccatctccctttttttt

SEQ ID NO: 24293 - DNA, 373 bp, Zea mays
  Clone ID: cC-zmle189061c10a1
aaactcggagcattttctggtatgagagaactacatttcaaccttcgctgttcaagagtttcaatgtaaatgccaccacttggcatatcaggtttaagcaggagaatagcaataacctattgatggtacatcaggcatagcagttgctacagattctaggcaagcaagaaaggcatctcaaacttccccagcatctgaaaggcatctcaaacttcccagcatctgtaaacaagggtagctagccaacataaactacacctattgagcctcctctgtatctagggtcttcttcttcttctcttttttcttctcactcttctaggagcctgtgccatctgctatctgagcactctctggttttgcagcatcactt

SEQ ID NO: 24294 - DNA, 390 bp, Zea mays
  Clone ID: cC-zmle189061c10d1
acccacccgtccgcgctgtaaatgctatctgctatggtgctaagcttatgatttcttttttactccgatttgagaatgatattgggaggggggaggaagtggttctcatgacgacgaacggggaggctatcgcgattggtatatttgaaatgactactgctgtgatggcgacctgtgaccatggtgcagtttcaaagatcaagagggtattgatggacagagatacattcccaaggaaatggcgacttggccccgtggcactcaacaagaaaaaactggctgctgagggtctacattgacaagcatgggaagccaaatgataagacaccaactgagtggcttctgaatgtggtgcttcccactggtggtgatgtttcaattgccatcatt

SEQ ID NO: 24295 - DNA, 388 bp, Zea mays
  unsure at all n locations
  Clone ID: cC-zmle189061c11a1
acagagacctctggctcttttaaaaacaagataaagatttttacctcgctgcagcttgcggagaaacaaatgaagctgcgcgcgcggataaaaaaactaatcaaacgccccccgggaaacttgggattaccccttcttttttttcttttttggtactggtagggtggtaatcctcactccatttcccccatggtctttagcttccatgcctggggcattctggcatggatgacgccgccgnaataccttgggcagcttctttctttttcaagcaaagaaaccatgaaagctgggggtagcgcccgaccccggggggatgtgcgggttttgggcggccaaaaagctctggaagagcatcctgtcctccgccgacgcgggggacgcgagg

SEQ ID NO: 24296 - DNA, 464 bp, Zea mays
  unsure at all n locations
  Clone ID: cC-zmle189061c11d1
cggaattctcgggtcgacccacccgtccgccgcgtcggcggaggacaggatgctcctgcagagcattctggcttcccagatgccgcacatgccgccggtgtccggcgctaacaccagctctcatggcttctttgcttgaataagtaagtagctgaccaaggtactacgacggcgtcatccatgccagtatgccacatgcatggaagctagagaacatgggggagatggagtgaggattagcagcctagcagtagcaaagaagaagaagaagaaggggtaatcacaagtttccctggttgcgtttgattagttttcttatccgcgcgcgcagcttcatttgtttctccgctagctgcagcgatgtaaatatctttatcttgtttttaaaagatgcagtagtctctgtcnaaaaaaaaaccaataaaaaaaacttaataatatataatgaaacaaataaaaacagg

SEQ ID NO: 24297 - DNA, 413 bp, Zea mays
  Clone ID: cC-zmle189061c12a1
aggaggaatcgtcgactcaaactttattccaaatttatccttgtccggaaccggaaggacggcagcagcaccatgactgactaacatccaaaagcctaaccggagctgatttacatgacatcgcaagagataaacgctgcggaatatgtaagggcagaaaaggacgtgaaacagctattgctagagagcttaaggtattacagtatgaaagactgaaacgagttatattcttaagaaatcttgcagttgacgcaaggctgctgctgatttgcacataactggagttgatccgaattcaacggtagttgcggtagatggggctgtacatgcagctctctgcatatttcaccaggtccttaggccgaaggcgcctacttgccaaaccaagttcatatgcctttgctgcaacgctg

SEQ ID NO: 24298 - DNA, 591 bp, Zea mays
  Clone ID: cC-zmle189061c12d1
ggtggacccacccgtccggctgagcaagcttacacatggagcaagggacaagcagtgtttgttactgggagtccatttgatcctgtggagtacaatggcaagatacatgttcccggacaggcaaacaatgcctatatcttcccagggtttggcctcggcgtggtgatgtctggagctatccgcgttcatgacgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagattttctaagaatataactcgtttcagtctttcatactgtaataccctaagctctctagcaatagctggttcacgtccttttctgccctacatattccgcagcgtt

SEQ ID NO: 24299 - DNA, 190 bp, Zea mays
  Clone ID: cC-zmle189061d01a1
ccactcaaattttcagatcgtcttacaattataaaaggtttaattggaccacgcaaacccagtaaagcaggaagggttgccatgccagccatgctagagctaaattataatgaggccttgcgtcgccccgacggaaatggaattatctagtctagcagtttagctatgaactatttatccggacccgggg

SEQ ID NO: 24300 - DNA, 152 bp, Zea mays
  Clone ID: cC-zmle189061d01d1
tgacactcgcaatgatggagtgagacgcgctcgcctgagtcggagatcgtggacatcaagccgttccctgagctggtctcgcgcccggcgttccttgacccggcgatgatgatgtctgcacccaaggcggagccggctgactactgcagctc

SEQ ID NO: 24301 - DNA, 190 bp, Zea mays
  Clone ID: cC-zmle189061d02a1
caactcaaattttcaaatcgctttacaattataaaagggttaatttgaccacgcaaacccagtaaagcaggaagtgttgccatgccagccatgcttgaactaaattataatgaggccttgcgtcgtcccgacggaaatggaattatttagtctagccgtttacctttgaactatttatccggacgcgggg

SEQ ID NO: 24302 - DNA, 376 bp, Zea mays
  Clone ID: cC-zmle189061d02d1
gagggtagttaatagagtcaggggcgctgaactacaaatactttcttctcttcctgttttacaccttcctcgagacaactcttgtcactctctctctattgcctcacttcattgccttcttcagtgatgccgagatcccaggaagtcctgcagcacttgcaaccacatttctcaccttagagttgaatctggccttctctttgagcgttcttggttttatgattatgcatatttcactagtttctgctaatacaacaacaatggaggcatatgagaagaagacaactccacattggatatatgatcttggccggaagaagaattttgctcaagtttttggaaatgacagaaaatattggttcatccctgcatactc

SEQ ID NO: 24303 - DNA, 408 bp, Zea mays
  Clone ID: cC-zmle189061d03a1
agggacaaactacagagagtattattggatatgcctagttggggcaaatatcttaatcttcccaagaatgtcccctccaccacatcagtcgtaacaacaattagctgtaaataatgtgaggggagcaactgaacaggaatagcctgcttcaaaaaagacagacatccaaaccccagatccaagcaaaacctcctagtattggggggtacctccatgtgatggatgcatggaggctcggtagaaataaatgaatcaaaagcttttcttaggctggacgggtatcatcagctgcatttcaccacgaatggactaaagacacttaagaattgtgagggtcgcatcccgagcttgaggtgaacttctccgccacccaaccagaagaaatcctcatccaatttggtgatagct

SEQ ID NO: 24304 - DNA, 110 bp, Zea mays
  unsure at all n locations
  Clone ID: cC-zmle189061d03d1
cagaanncttgggggacagatcctcatctaaacttttttcccaatttagttaaaagattaaaacatctaagtttgattgatcttaaataaatattaataatttagtatag

SEQ ID NO: 24305 - DNA, 485 bp, Zea mays
  Clone ID: cC-zmle189061d04a1
atagggctgcatcaagcgcaattcacagcttcgtgttaaatgctcacatctacagaaaattaatagaggggtactagtgtagaccggatttgcattttccgaatgctatcgttagcagacaaacaaattaacaaaggccaaaaccacaaaaaaaaatcaccaaatccgatcccttgctacacgggggtccatgggcttcagtgtgacgggttagcttgctgatttgtgctcgtttcaacgcgcaggctgttttcacgacggtacatagattttgcgccctgaatttacgcggaaactgttagtcaagtactaaacccactggccagagacaaggtgacatataaaagatcaacggaaagttcatgactctcgaactccttttggatcgcagtaagaatagatggagcaacagaacatacgaacaaaaacttacttggaatatcgttccgagctttttcaacgctttcgctcgcagcttcaggaca

SEQ ID NO: 24306 - DNA, 320 bp, Zea mays
  Clone ID: cC-zmle189061d04d1
gaatgcccgggtacacccatcgcgggcgcggacgcaggggcggacgcttgggctagctagagcccttcttccttcttcctcagctaggcacccgtgcgcatctgcaggccacctagccctgcctacgacgatggcggcggcggtggttgtgtttggtcaatctcgttccgggtttggcgccaggggtcgaccgggggaggccatgccctctacaggaggtctcagagggctgcccctgtctccgccagagcgtccttgaacatatcgtgctgcgcgatcctgacgcagacggcgcaccgctagtcggattcggggacgac

SEQ ID NO: 24307 - DNA, 523 bp, Zea mays
  unsure at all n locations
  Clone ID: cC-zmle189061d05a1
tttttacatgaacaatctgttttttcttgaacgaatgtacatataattaagaacaagcatgcatgcatactcttagtttggtacgacaacaaaccatgttttttccgcgccagattaaacgaacaaaccgggtaccatgatatgattttatcaggaaggcagagcagcagcattcacttgcgagctcagttgctggtggcagctgccgcggagcgtgcctgcagcaccttggcaaactcggcgatgtggtcggggtccgggatgacctccttggctacgtcgagcgcggcgaagcgctccgcccacgtggccaggcgcgggacccggccggcgtccagcagcttgacgccccccaccttgtcccaggcgcgcagccagccgatgaagcctcccagcgcgacgtccaggtacccgggcgcgtcgccggcgaagaactttttcccgccggagcactcggcgaacgcgccctccagcgtgtccatagcggccagcgcgtncaccgtcgccgtcgcggacgcgtggg

SEQ ID NO: 24308 - DNA, 230 bp, Zea mays
  Clone ID: cC-zmle189061d05d1
ggtcgacccaagcgtgcggagatggcggcggcggctacagcggtggcggcggcttctttggcggcggcggctacagaggaggtggcggcggctacagcggtggcaaccgtggcggcggctacggcaactccgacgggaactggaggaactgagcggaggggcccgcgcgggctagttatcctgttcgctgccgagatgtttaccctagcccagagggttgatcttcgttc

SEQ ID NO: 24309 - DNA, 535 bp, Zea mays
  Clone ID: cC-zmle189061d06a1
acgcatgagcaaggacgcttctattgagataatcacaaacagacgagaggcagttcacccagttgtccggcaatcatattgcaacaagacaatgtactcacaacacctaacctagctagatatatcagacataagtaagatgcaatctgatctcacactagtgggcatacgaagaataatccgttgctgatatacatcaacatgcaggctcattaagattaccggcttccagcttggctgcagacgaccctgggcctggggggaagggtgcggtgcatacatgggagcaatggaacgtaggcgtgcaaggttgattgcgtcggctgcgagcaatcacccagacttgaatagcaagacagctttagagtcgatgtagaaatatacaaagtagtttgtcttgtgcgtcacgtatgaaccgaagttgcggccgacgatgcagtgccaggttgggccgtggttcttgtcgaactccttctttatgtactcagcgatgtccttctccatgctgtgcttatcgaacgcgatgcgggcaatt

SEQ ID NO: 24310 - DNA, 494 bp, Zea mays
  Clone ID: cC-zmle189061d06d1
aaaccattggcgctttcaaactccctcgcaaaggtggaaaaggaattttagatctttgggagtgtcacggcacaggatggggttgacataatatagtcacaacttaatagggatgtcgacaagaagctggtgacggttccagaaattcgagaaatcggatagtatgttgcagagatcaagcttcacccagacgtgacagcgcgagtaaggctgaatgtctatgcgaaatgagctcagcagttacagaaccttgagtaatggtctttggagaagcctgatgtttgccagagattttgctgcaagtgccaggtgctgcggtagacatgaggcctggtctggccgcgacttgcctggctttgatacacaattcactggctcactgcgcattccattccctaccgtgtgaagtcaaagtttcaacaattatatctgatgactttgaggcggaaaatataaattgttgtaaagaacaacttggttgaactgttgagcac

SEQ ID NO: 24311 - DNA, 416 bp, Zea mays
  Clone ID: cC-zmle189061d07a1
aggggctattttattcatcgctatcatgtattaaagtccccactcgtggtcgggggcgaccagacgataaacacctcgggtgttacaataagcaaagtttaagacagacacaaattagtaaaattcaatttagagactagactaactaagaaaaaaagtgttgtgtccgcccgcaccaagagccgtgaaccttatgacatcactaccttcaagtcctcacatttcctccatattttgagactatcacgatgtttaacgaatttctattgcaagatttttattcttggatattctagatgataatcaacaataagcgcgagtggatgtccaagtatatatgttattgtacaattcagggaacacccttgctcttattacttgtgcttccacccaatatgtgatgtttggattgcatg

SEQ ID NO: 24312 - DNA, 606 bp, Zea mays
  Clone ID: cC-zmle189061d07d1
gagttcatgcctaatgggagcctggacacatggctacatcacaaaggatacaatgaggcagtaaaacgtcttggcttgactcaaagaataagcatagccgttaatatagctgatgcattggattatttgcaccatgattgtggacgaccaactgtccattgcgacttgaaacccagcaatatccttctagatgatgacatgaatgctcttttgggagattttggaattgcacgcttctatcatgatcctgagtcaaaatgggccggttcaattagttcaattggtgttaagggaacaattggatacattcctccagagtacggaggaggtggccttgtgtcaacgtctggggatgtttatagttttgggatattgttgctcgagattttaacgtgcaaaaggccaacagatcctttgttcaaggatgaccaggacatcatcagctttgtggagaataactttccggatcatgtatttcaagttattgactctcacctcctggaagaatgcaggagttcaattcaaggaaataattcaatacatggaaatgagatcaaccagtgctgggttgatctactacaagtggggcttttatgccttcgttca

SEQ ID NO: 24313 - DNA, 386 bp, Zea mays
  Clone ID: cC-zmle189061d08a1
ttttaacatcagacaaaaaactttattattgaactataactcataagaaatctaaaagagggcaccaccaatgatgggttgttggtagaacactgctaggtttgtcaaagcaagttggttgaatggcagcaattgttgcagttgtaagagggtgccagcgttaggcgcagcgtgctggtagaacggcaacaactgtggttgtgtcaagaaggtagcagggctcacaccagctagctggctgaatggtagtagttgttgctgctgtaaataagcaggagagttcaatgctgccagttggttgaatggaagaaattgctgggggtaggcaacaggtagctggctgaatggtagttgttgttgttgcaaataagaagcagagttcaatg

SEQ ID NO: 24314 - DNA, 631 bp, Zea mays
  Clone ID: cC-zmle189061d08d1
aattattgggttgacccacgcgtccgcggacgcgtgggccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgc

SEQ ID NO: 24315 - DNA, 374 bp, Zea mays
  Clone ID: cC-zmle189061d09a1
ggccaagccccaatggccttttggtggcagacattttctttcactggatgaccatgccccatgaaaccacttgggcctattggttgaaaccttttaagggttcacatgtactgataaaattcgggggggcaagataattatgatttacaggtcatcactcagaatattcttctccactttattgggcaatatcttctaccctagaacgctttgaatgctcatcaagatcatcatcaacatgagggctccgggggtttgaattcacatgcatgccagaagattctccgcgctccatgggaccaacatgacctggtttggtcacaggaataaaggaagggactggaaaatgctcaatttcatccccagacctcccc

SEQ ID NO: 24316 - DNA, 601 bp, Zea mays
  Clone ID: cC-zmle189061d09d1
attcctgggttgacccacgcgtccgcccacgcgtccggagaagcaagcaaaggaaaggcgagaaacaagggagggtcgcaatgctttcctagacaatcttaatgatagagagaaacagatcaaagccattgaagaatccttcagagcagccaagtcaaggcctgttcaccagactaaacgtggcatgcaagctgagtgggttatgcctttgctacctgattttgataggtacgaggagccgtttgttatggtgaattttgatggcgatccaactgctgattctgagcagtacaacaaacttgagagacctgtacgtgatgaatgtgaatcccgggctgtgatgaaaagttttagtgtcagtggttcagacccttcaaaacaggagaagtttttggcatacatggccccagcaccccatgagctcgccagagacttggatgatgaaaacgatgatatccagtattcctggctaagagaatatcactgtgaagtgagaggagatgataaagatgatcctacaacataccttgtcacatttgataaggaggagggtgcaaaatatttgcctctccctactaagctagttttgcagaagaagaag

SEQ ID NO: 24317 - DNA, 403 bp, Zea mays
  unsure at all n locations
  Clone ID: cC-zmle189061d10a1
aggccaagccccaatggcctcttgttgacagacattttctttcactggatgaccatgccccatgaaaccacttgggcctattggttgaaaccttttaagggttcacatggactgataaaattcgctggggcaagataattatgatttacaggtcatcactcagaatattcttctccactattttgggcaatatcttctaccctagaacgctttgaatgctcatcaagatcatcatcaacatgagggctccggggctttgaattcacatgcatgccagaagattctccgggctccatgggaccaacatgacctggtgtggtcacagcaataagggaagaggctggaaaatgctcaatttcatccccagacctccccttcttcgnctttttcttctgcaaaactt

SEQ ID NO: 24318 - DNA, 603 bp, Zea mays
  unsure at all n locations
  Clone ID: cC-zmle189061d10d1
cccacgcgtccggagaagcaagcaaaggaaaggcgagaatcaagggagggtcgcaatgctttcctagacaagtcttaatgatagagagaaacagatcaaagccattgaagaatccttcagagcagccaagtcaaggcctgttcaccagactaaacgtggcatgcaagctgagtgggttatgcctttgctacctgattttgataggtacgaggagccgtttgttatggtgaattttgatggcgatccaactgctgattctgagcagtacaacaaacttgagagacctgtacgtgatgaatgtgaatcccgggctgtgatgaaaagttttagtgtcagtggttcagacccttcaaaacaggagaagtttttggcatacatggccccagcaccccatgagctcgccagagacttggatgatgaaaacgatgatatccagtattcctggctaagagaatatcactgggaagtgagaggagatgataaagatgatcctacaacataccttgtcacatttgataggaggagggtgcaaaatatttgcctctccctactaagctagttntgcagaagaagaagcgaaggaggggaggtctggcgatgaaa

SEQ ID NO: 24319 - DNA, 383 bp, Zea mays
  unsure at all n locations
  Clone ID: cC-zmle189061d11a1
aatcagngcattgaaactttgttatagttgtacactagcagaaagcgagttaactgtcggggtgaacaactagctgaagaatatttacagggctagtctgacaaaaggggagcaaggaaaccgcctccctgcctatctgatgtaaaaaggctcagcttcaccgaatggcagacatcggggcggggcatcatctatgcagatcaagtcctccagtccagccatgaaatcgtccgcaccaccagccgcctggcttagcatctcatcctgcatcatctgttccaaagtagccagcatcaaatcatgatctaaccccgagggaaaataaaacacgtcctgcagcaagcttcgaaagcataccctggactgtttcatttcagcaacgc

SEQ ID NO: 24320 - DNA, 552 bp, Zea mays
  Clone ID: cC-zmle189061d11d1
cttgtgaccaggctcatgtacgaggacatcaagtgaggaagaactatcggaaggtagtctggtcagtcggtatcgtcgagaaagtcatactgagatggaggagaaagaggcctgggttacgcgggtttcggccccagaaacaactagaaggtccatcgcaaatccaacctgcaaaggctgaagacgaatacgatttcttgcacgacggcagaaggcaggccgaagccaggctacagagagcacttgcccgggtgcactctatgtcacagtacccagaagcgagagagcagtaccacaggcttacaacctgcgttgctgaaatgaaacagtccagggtatgctttcgaagcttgctgcaggacgtgttttattttccctcggggtttgatcatgatttgatgctggctactttggaacagatgatgcaggatgagatgctaagccaggcggctggtggtgcggacgatttcatggctggactggaggacttgatctgcatagatgatgccccgccccgatgtctgccattcggtgaagctgagcctttttaca

SEQ ID NO: 24321 - DNA, 410 bp, Zea mays
  Clone ID: cC-zmle189061d12a1
ttttagtttttttttttttttttttttttttttttcttgcaagctgatctttactacttttcagttttggcaagctcaagtttacaggaaaccacgaccacgagactggggtcaactggcaatgcatatttttatgggaatccagaatagaggccgggtctatgaaaaggtagctggggcattagaaacaaatttccaatcgacgcagatcgggccttcgtcacttcggggactcttgggccatgactggggcagttacttccgggcttaggacttcctctgctccttggcagctttctcctcttcgggtttcttcgccgcatcagccctttggtggcttattaaagcaagacgttccaaatcttttcgggcttggtctggttttccttgctcctgaagcttcatttaac

SEQ ID NO: 24322 - DNA, 567 bp, Zea mays
  Clone ID: cC-zmle189061d12d1
cccacgcgtccgcccacgcgtccggccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgagggtattattcagattgaaaatccaaacttggtgaaagccaagaatataaaggccaaggaagttgattttggcaagacaactgaactctcaaggcgtgaaagagaggagcttgagaaacaaaaagctcatgaacgttatatgaagcttcaggagcaaggaaaaacagaacaagcacgaaaagatttggaacgtcttgctttaataagacaacaaagggctgatgcggcgaagaaacgcgaagaggagaaagctgccaaggagcagaggaagtccgaagcacggaagtaactgcaacagtcatggaccaagagtccacgaagtgac

SEQ ID NO: 24323 - DNA, 98 bp, Zea mays
  Clone ID: cC-zmle189061e01d1
cttctgctgctgcttccttcccctagggtttagggtgttctgtgttgatatgtaagattagcgaagttgtagagttttttttatttttttttattttg

SEQ ID NO: 24324 - DNA, 375 bp, Zea mays
  Clone ID: cC-zmle189061e02a1
gaaatatacatgatccattatatagacgaatatatgtatgcatgtcctggttcagtaatatatatatatatattacaaaactatccaagtaatatatatattcacctcctcgatcctatgccggcctcgcgcctagctagcaatagcaaagagttgctttctacttgaagaaggagccagtctttatggcgtcctcgttggcttcaccaagagcagcctcgttgaggtacttgtcagcaagctgcacacgcttgacgttctcctgctccgccaccagcatgtgtccgtactccaagagcttctcgatcgttatcttgggctgctcgaacgtgggcgggccctccttggagttgacgagcttcctggcgatgttct

SEQ ID NO: 24325 - DNA, 414 bp, Zea mays
  unsure at all n locations
  Clone ID: cC-zmle189061e03a1
gngcaaaaaaataaattgcatgcgatatctaataaataagcctggtcaaattactcatacataagcgtcctcaaaattgtggctttgatcatatacatatgatctttctttaagggggactattacatctgcgacatagaaaaccttgattgctgacacacagactgaccctacctcaaaaattggacccttgcctccttgagcagctactggataagaaaaaatgaggggaaaagggtgcagcttcattgacattcctcactaaggggcatttctcgacatctgactgggcaaaaaggtgtctgtggcgtatctggttcactgagaaagctgccagaaaaattttcatcctgcatattgactcatacatcaccttactgcctcgagtttgcttgcttggtcgtaatagaacat

SEQ ID NO: 24326 - DNA, 428 bp, Zea mays
  Clone ID: cC-zmle189061e03d1
ccgaaatcaaagtagcagacaccgctgcagtttctagagccctctctgccactcgagatcccactagtcacaaagcctgccctcgccaagcccgcctcccgcaccgccaagcccgccgaggctccgaagccgaagcctgccgccgccaagccgaaggcggccaccgctggtgcctcccacccgccttacttcgagatgatcaaagaggctatcacggcgctcaaggagaggaccggctccagctcgcaagcgatcgccaagtatgagggggacaagcacggcgcgtctctgccggccaacttcaagaagaagctttccatccagctccgagggtccgcagccaaaggcaagctcgagaaggtcaaagcttcgtacaagctctcggacgccgccaagaaggcatcccccaagaccaatgctaagccggc

SEQ ID NO: 24327 - DNA, 485 bp, Zea mays
  Clone ID: cC-zmle189061e04a1
gaatattcagttaagaccattccaaggctgcttttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgtccaaaaaatatcatattcgtaaagcagaaacataaatgtactcccattaatgtggaataggcggaactgaattagtcaattcaagttgacattgtcaatttatccagaacttctctcttttcctcggtgaaaccggacgcgtggg

SEQ ID NO: 24328 - DNA, 562 bp, Zea mays
  Clone ID: cC-zmle189061e05a1
gggaggtaatgcatggggacaatatgatgaagatgagtatgttggcgcatacgatgagaaggcaacctacaaggagctattttctgatatagaagagagtggatcagagtacatccctgactctgatgatgaagaccacgatgattgtgttgtagatgacaatggagatcctctgtttgtcacaacaactgacttagagaaccctaatattgcagtaggtgttagatttgaggatgggcctactttcaaaaaggctattaggcagtgggctatcttacatgaggttgaaattggggctcactatagtgaatcttctaggtatagaggattctgcaaagcaaagaagtgcaattggaggatccatgcatcacaattgcctgatggtaaaacttggcaggtaaagaagatgtcaaagaggcactactgcaggagcagaagcaagatggagaagaattgcatggccaatcagtattgggttagagacaaggtagtgccgatgcttagggaaaatcctaacctaggtgctggagctctggtgaaaagctacaagagaaatatctca

SEQ ID NO: 24329 - DNA, 454 bp, Zea mays
  Clone ID: cC-zmle189061e05d1
attcctgggttgacccacgcgtccgcggacgcgtgggctgacgcgtgggcggacgcgtggggtgctgtgtgcggaggtggaggtggcatcggcggcggtgtctgaatcagcgtctcacatgcatgcatggtggtgcaagcagaagcaagtgctcgagtgcgtctgacgaactcgctctggtattcccttcgcaggcgtgcgtggacgtggagtccagcacttgcttctgtggacagcgtcattagcatgtgtgtgctataccgatcgatatccgaatcatactctctgcgtagcgaatagcgatcatagtaataacagaataaggatgctgccttacgtttaatcagtcatcattatacgatggtttatacggtatatatacactgcgctggtcgcaagcttgaaaaattactttggatcgtactattttaatcatattttgtggggattaagg

SEQ ID NO: 24330 - DNA, 437 bp, Zea mays
  Clone ID: cC-zmle189061e06a1
ttttaggtaccaaacaacctttctttgtgtttagcacaggggatgtcattcttgtaaacaccagagacacaaaacacctatattgtaaacactgaacactctgcaccgattttgattaacaactaccttacatacacgaaacctcctctgctatccaaagttgtacatggttcgtacaccttcccaagatccataatgacggtcggcctcctatcacgaccacactccaatcactcgagctgagcgaaccacacccgctggatcttgacatacttggacgccttgacccccaggtcaccgacagacgggttctcgctgtctgagacgtctatgacctatcacggatcagggttggtcttgatgacgctcaacgtaatgttgccggtagaggaggcggcattcttgatgtacttactatagagatactgctccggacc

SEQ ID NO: 24331 - DNA, 503 bp, Zea mays
  Clone ID: cC-zmle189061e07a1
ttttgaaacaaaggcagcttatttttgttataaaagaatgcggcacattttgatttactctcccaagtcccaactgacaactcccaaccacttgtaccatgcagctacagctgttggcagaaataatatatctgattcgttaattaatgaatgaaagttgcaagattcatcatcggcaggcatggaggcatctggagcggttgcagatggcggatcgggaccatcagacgagatctcgtagtattggagcaaaaacaaattctgtaatcagcagacagcacaagtttattgctggatccgtactcgaatatagctggaaggaacctaggatagaatctgggatggtgaatggaccacgcgcggttgaaggcaagcctggccatggcacgcacgcacgcaggaggcgtgcccaaactactgctcgccgtggtgcgcgcccgcggctgtaacggtggcgcgtgccttgagccagtctatgatatcgtcgaacaccttctccacgt

SEQ ID NO: 24332 - DNA, 629 bp, Zea mays
  Clone ID: cC-zmle189061e07d1
ggttgacccacgcgtccgcgctcgcgctcgcctccccgcgccgcaccacggcgccgcccaggtgcggtcacggcgctcgagctcctccgcgtctgccgcgagctgcagcggcgattcgaggaggtgcagctgccgctcctcgtcgtgcacggcgccgaggacaccgtctgcgacccggcctgcgtcgaggagctctgcaggcgcgccgggagcaaggacaagacgcttcgcatctacccagggatgtggcaccagattgtcggcgagcccgaggagaacgtggagaaggtgttcgacgatatcatagactggctcaaggcacgcgccaccgctacagccgcgggcgcgcaccacggcgagcagtagtttgggcacgcctcctgcgtgcgtgcgtgccatggccaggcttgccttcaaccgcgcgtggtccattcaccatcccagattctatcctaggttccttccagctatattcgagtacggatccagcaataaacttgtgctgtctgctgattacagaatatgtttttgcttcaatactacgagatctcgtctgatggtcccgatccgtcatctgcaaccgctccagatgccttcatgcctgccgatgatgaatcttgcaactttca

SEQ ID NO: 24333 - DNA, 539 bp, Zea mays
  Clone ID: cC-zmle189061e08a1
ggagggggaagatactaaccgtattcaccatttcaaaggtttactctacaatatacacataggattgagtaaaaaaattcatagtgacctcaagaagcgcactagtcagaccccatgagggcttgttcggttattttcaatccatatggattggaagggattgatacggattggagagattttgacttactagtgattgaaaccatctcaatcccctcaatccatatagattggagtagaaccgaacaagccctgaggagacaatttagatacatgaccttctttacccatccagtaatattcaaacgaaagggagaaaaaaacctaataataagctggctgtaaagcctaaacacgtggcaaaaggtcgacgatagatcaaataatcctctgtttgagatcttcgaactttgcaaacaggtcatctctgctttccttgaaaaggagataccgtgcgatgaaccaaattgtgtaagcaagtcctattaattccagcaattttgggagcagggggactgaatcaactgcagcaacaacag

SEQ ID NO: 24334 - DNA, 631 bp, Zea mays
  Clone ID: cC-zmle189061e08d1
aattcttgggttgacccacgcgtccgggtggacagaccatggagctctgcgtctctacacccccatctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtctcggacaagcccgatacgcctgccgacgacaaggccgaggaggttagcgccgcgcctagtggctccgcggaggcgcctatggcagagctagtgccgtcagaggcgtccccgtccccagatgatggcggcctggatgagattctaagcaagttgaacattgaagtgtctccaactttaatcctcactggatttggtgcttttattgctttatggatcctatcttctgttgttgctgcagttgattcagtccccctgctcccaaaattgctggaattaataggaactgcttacacaatttggttcatcgcacggtatctccttttcaggaaagcagagatgacctgtttgcaaagttcgaagatctcaacagaggattatttgatc

SEQ ID NO: 24335 - DNA, 103 bp, Zea mays
  Clone ID: cC-zmle189061e09d1
tgggttgacccacccgtccgttcctatattttttagcagacaaattatcgtgtgtaatcgacattgatatctccttaaattttaaaaaaaaaaaaggaagggg

SEQ ID NO: 24336 - DNA, 81 bp, Zea mays
  Clone ID: cC-zmle189061e10d1
ttcctatattttttagcagacaaattatcgtgtgtaatctacattgatatctccttaaattttaaaaaaagggaaggaaaa

SEQ ID NO: 24337 - DNA, 430 bp, Zea mays
  unsure at all n locations
  Clone ID: cC-zmle189061e11a1
acctggacaactagtttatttattttcagaagcacagccattacagaaggccatgccttattgaagaccagatgtaatatccaagcacacaaccgactaaaacgagctccgatctactacgctggagcttctggcgaaagtctcgtccttggtcacaggctttaagcaatctggaggttcaaaacgaagggtggtcaaatgttttgaaattagctgaacaaatatagatcgatcggtatcaaggcagaacaaaattaagaaaatacggaggggcaaactaccccaagccggttctttgtttgctcaagcaaaaactgcgggtccagtttagtctgtgtgtacgcatcgatcttgttcacttcctgagacataccgacccgngagttaaagtttctcatcaacgaagcattatcaacaggataaaaggacc

SEQ ID NO: 24338 - DNA, 601 bp, Zea mays
  Clone ID: cC-zmle189061e11d1
cccacgcgtccgaattcttcaatctccatggagcgtggttcaaaatgaaatctctattacgaatgtgggcttcagttggcatgtggttttgtcgtgatccgttatttcattattacacgaacaggtggacgttgcgtatgtaccgttcatcgagaggtttcatatactctattccaatataaagaactatgacatcacaaagggcagacccaaccttcagaaattcatcgaggtagctcacgcggatggatttcaaattgactaggatttatatctgtaatacgttggttcactaacattgtttgagacggtccttttatcctgttgataatgcttcgttgatgagaaactttaactcacgggtcggtatgtctcaggaagtgaacaagatcgatgcgtacacacagactaaactggacccgcagtttttgcttgagcaaacaaagaagcggcttggggtagtttgacactccgtattttcttaattttgttctgccttgataccgatcgatctatatttgttcagctaaattcaaaacatttgaccaaccttcgtttttgaacctccagattgcttaaagcctgtgaccaaggacgagac

SEQ ID NO: 24339 - DNA, 452 bp, Zea mays
  unsure at all n locations
  Clone ID: cC-zmle189061e12a1
gggatgaaaggaccatgcaatactgacaatcttctaccacgattttcttacaaaagtttgtagacgtcactcatgatgcatgacaatgacatcgataaaacaaaaggagctatgtaaattcagatgatacagcatcatagccaaacgctggtcaatggctttctagtgttacacaatcaaccaaatgtgctgggatacatttatcatgctagttcgacgttcactagcagtacaacaacttcggacgcccccttctgtcgcaaaactggaacgctcgcttctgaagcagnccactggtacttacattgagatgccacacaacagaaatttgccaagctttttatgctgcccaaggctcaggatctttcagaagaacacaagaagatgcagatcctctaaccatccagcgggtttcaccattcattcaaagccccttaagcagaaagcaccac

SEQ ID NO: 24340 - DNA, 608 bp, Zea mays
  unsure at all n locations
  Clone ID: cC-zmle189061e12d1
gaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtatttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcattgagaccaaccgcacaacggcgaggatcttccctgctgtcctagacgtcgagaaccccgagttcaagaggaagcttgacaggatggttgagatcaaccagaagatcattgccgtcggagagtccgacgaaatcccnctagtgaagaacctgaagaggattcctcttgtcgcctctctggtgtccgagatcatcgncgcatacctcatgcnccccatcgagtctggctcggctgatttcc

SEQ ID NO: 24341 - DNA, 409 bp, Zea mays
  Clone ID: cC-zmle189061f01a1
ttttatcacaaaagcgaatgaatattacgataccgatcacgtacaacatatataggcagtcaggccagaaaataatattacgccaaccttgttactagcttgacctactaccgactccgactccccaggggatttcggtctttgattgagggttcactactagcagtatacacgacacaaataaaataataacggaactcgttccatgcagtaaatggtctgccagttttttgggaacatcctacccatctttcctagccatcagaatcctacctcctcaggcccttaacgatgtatgtagcatacaggtccatagagtgctggatggcttcataagcggtgctcgctggttgaagtcattcacaggaacctccttgttctcattgttcttgagacctcgaagaaagcg

SEQ ID NO: 24342 - DNA, 395 bp, Zea mays
  unsure at all n locations
  Clone ID: cC-zmle189061f01d1
ataagacgactagtttcattgattcttagaagagatcgagcttcttttgcaccacatgagtcgaggatgtcttgcaactgcagatcaagctgcggctgcggctcaagctgcaagtgcggcaagaagtaccctgacctggaggagacgagcaccgccgcgcaagccaccgtcgtcctcggcgaggccccggagaagaagagccgcgcccgagttcgtcgtggccgcggaggagtccggcgaggccgcccacggctgcagctgcggaggcaactgcaagagcgacccctgcaactgctgatcacatcgatcgacgaccatggatatgattattatctatctagcttagggaggaggntgaacaataataagcgatgccgagctggctgccatacata

SEQ ID NO: 24343 - DNA, 557 bp, Zea mays
  unsure at all n locations
  Clone ID: cC-zmle189061f02a1
gagctgagaacggcgggtgcaagtgcggcgccaactgcacctgcgacccctgcacctgcaagtgagactacgacggtggcggcgatgacgctgcagggtctgcaggccctgatggggtcggaaggactctttatctctctagctaattaataagctctagctagtatataatattctagcagtgtcgtttgctgtgttttgttcgagtcagttagacagtcagccgcgtgccatgggccatggcatagcatgcctcgctctatctgctccatcgccttgctctagtggtggtactgatgggggaacgaataattgtaccgagatgttggcgccgtgtcgtgtcgtgtcctgtcctgtcatgtccttcctggggctcatctagcagtcagactgtgttgtgttgtgttgtgctgtgtgggccgagtgtgcagtacagcatcgggccatgcccctgttcgatctgtctgcgactttaattngtttgtgctgtgtcatctatctatctaatccatctatgctatcctctatagtctaaaaaaaaaaaaaaaaaaggcggc

SEQ ID NO: 24344 - DNA, 186 bp, Zea mays
  Clone ID: cC-zmle189061f02d1
atatatatataaaaattaatataatatatataaaaaaaaaaaaaaattaaattctaaaaggacaaaaaaaaaaattggtggttggtgtttaattcgcgtgcatgcaacgactgagccctccttttgtgcccccttaatccaacccacaggccgtcgttgtccaccgtcttaactggaaaatggttg

SEQ ID NO: 24345 - DNA, 524 bp, Zea mays
  Clone ID: cC-zmle189061f03a1
ttttgaaatcgagcaagcctgttgacatgggccgagaacggccgcagtctacactgtcgcgcaatttgtagtaagagaatttacagttgcaaagggttgctataacatatgttttcttcttcatctgctgcctttcactattcaccacggcaaaattcacctccactatgtttaaagaagcaaagggaaaataattcctggtatctcccgatccaggttttctgaagtattggcctaaccaacccgaccttggagcttcctgatgcacgctctaataagggcctgttctgttttatgagactatgatagccctagagaacgagaaaagcgatctgcaaggttcgcgataacaaagcctgaaaatacctggacagaaccaagaatatatactgctgaatagtgacggccgtgaatgatcatatcagcaaccattgctattggaattgtgagagacatgcctagagtggccaccaagggagtagtccaaacaacagaaagagcccagaaagtgtctgataatacac

SEQ ID NO: 24346 - DNA, 424 bp, Zea mays
  unsure at all n locations
  Clone ID: cC-zmle189061f03d1
gtcatgcagcatgcccagagacatgccgtcctcctacatcacagttcccctgagcttcgtcgaccgcatcaagggcgtgttccgtcgtcgcagctacggcagcggcagcggccaggagtcgacgtgcactgcgttcgacgtgttcaccgccgccatatggaagtgccgtgcccgcgcgacgatcggcagcgccgccagcccggacgcccccacggcgctcgccttcacggagaacgtgaggaagccggccaaggccaaggacggctactacggcaacgtcttcgccttcggcctcgctgcctcgacgctgcgcgaggtcgcggacggcgacatcctggaccttgagacgctggtcagggacgccaatgcacgggtcccgttcacgttcgctgacagagccgcgcacatcgncgacgagatgggc

SEQ ID NO: 24347 - DNA, 355 bp, Zea mays
  Clone ID: cC-zmle189061f04a1
gctggtggtggtgctttgttggttgtgcgctgttcaaacaccaccaaattctacgtgggggtgttgaacaaaagatgttaatgcaagcagccacacagtattgtatgcccgtcctgatttggaagtgaaattaaagaatgagccggtccgttccgcccgccggctccatgggcgatacgaccgacactcgcaaaacctctggaacacaacaagggttacggaccaggccaagacctatggcgcattcacccaggatccaaccggctgaaactcttgacgactggctccattctgggttcacctgaaaacttgtgcaaccgacgggctagcgcggtgtggctctgctttgtcctgg

SEQ ID NO: 24348 - DNA, 67 bp, Zea mays
  Clone ID: cC-zmle189061f05a1
aaaaaaaaaaaaaaaaaaaaaaaaaaaaaaaaaaaaaaaaaaaaaaaaaaaaaaaaaaaaaaaaagg

SEQ ID NO: 24349 - DNA, 634 bp, Zea mays
  Clone ID: cC-zmle189061f05d1
attcttgggttgacccacgcgtccgcccacgcgtccgcgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttgggtgatccgattgcatctgcttgtaccatatattaattggtccacgtgatatgatttggtactatatatatactataaccggacttcttatt

SEQ ID NO: 24350 - DNA, 71 bp, Zea mays
  Clone ID: cC-zmle189061f06a1
agatcaatcaaccattgatgtttgactcttttaacaaaattgggaaaaatgtttagatgacaagctgtgag

SEQ ID NO: 24351 - DNA, 230 bp, Zea mays
  Clone ID: cC-zmle189061f06d1
aattgctgggttgacccacgcgtccgcccacgcgtccgctaaatacctgttattaaagatgaatatactgatacataaaagagatgatgacagatttggaagtggaatgttgtttgcttataccgcagttttcgactatcttttgatttcttctgttagatcttgtaaagcattgcagcatggtgtggcatgtacctgtgttgccttctattcgcttctgttaactcatg

SEQ ID NO: 24352 - DNA, 398 bp, Zea mays
  unsure at all n locations
  Clone ID: cC-zmle189061f09a1
ccagattaatctcaatcaatatattgattatttctaggaaacacatgccggtatgagggcaccattatcaagtacatttcatatgtaatctaaaagaaagcacctccaacgatgggttgctgccacgataaggcagggttcatcaaagagaactggttgtatggcagcaattgttgctgctgtaggaaggcaacgaccaaaggattagccactgccagtggattaagtaaaggttgtcgctgttgtaggtacgcagcagagttcgacacagncagttggttgaatggaagcagctgttgcaagtaggcagcaaggtttgccacagctagctgagtcagagctggtacaatctgttgcaacaactgttgttgcaggtatgtaggtgcattaaccatagc

SEQ ID NO: 24353 - DNA, 472 bp, Zea mays
  unsure at all n locations
  Clone ID: cC-zmle189061f09d1
caattnttgggttgacccacgcgtccgctgccgcctacctacaacagcaacaactgctttcatctagccctctcgctatggttaatgcacctacatacctgcaacaacagttgttgcaacagattgtaccagctctgactcagctagctgtggcaaaccctgctgcctacttgcaacagctgcttccattcaaccaactgactgtgtcgaactctgctgcgtacctacaacagcgacaaccattacttaatccactggcagtggctaatccattggtcgttgccttcctacagcagcaacaattgctgccatacaaccagttctctttgatgaaccctgccttatcgtggcagcaacccatcggtggaggtgccttcttttagattacatatgaaatgtacttgataatggtgccctcataccggcatgtgttttctagaaataatcaatatattgattgagatttatctgg

SEQ ID NO: 24354 - DNA, 120 bp, Zea mays
  Clone ID: cC-zmle189061f10d1
aacccatcaatatccttctagatgatgacatgaatgctcttctgggagactctcgaaatgcacgctcctatcatgatccttacttaaaatggccccaataaaatttatcaatacgtgcct

SEQ ID NO: 24355 - DNA, 331 bp, Zea mays
  unsure at all n locations
  Clone ID: cC-zmle189061f11a1
attataaaaaaatcccggggatgatgatttggggccaatgaggggggccacagggaacccaacccactgaagaaaaacccctacaaaaccccccacccccggaggggtttcccaaccccctagattgggggggggcccccttccccccccctggtttatttccgacaattaaatcccaacgagcatagccccgaccgaaccgacccatnggatgcctaagggggccccccccccctagagggggcaaccccggtctacaactaaaaaacccaaaccaacttcaaatcccccgacccaaaggtgggaggggacccatttttattcccccggc

SEQ ID NO: 24356 - DNA, 634 bp, Zea mays
  Clone ID: cC-zmle189061f11d1
ccggatttctcgggtcgacccacccgtccgcggacgcgtgggcggacgcgtgggcgccctcgtgccccagtccttcagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgagaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcacggtgcacggggtgtggcacttcgatcagatgcttgttgaggaagaggcctaaaaagaagaacggacagatgaatg

SEQ ID NO: 24357 - DNA, 414 bp, Zea mays
  unsure at all n locations
  Clone ID: cC-zmle189061f12a1
aaacatagcaatgtcatatatattatatacatatacgcaccatatataccatagtcttatgcgaagggaacaaaatataccatagntcctctctgaaaatagaagggtactatagatgagtccaatatccaagcaaataccaagttagcgaaccatactagatgctgccgcaagttcttgctccaaactatagcatccagacatcattggaattggtaaatgttcctcattataaattggactgatacgtncatgtgggggctgagcttctgcgcataacaaaagttccatttctccacccttttcaatcaaaagaagaggtttattccggagcctctttgttcttagacattggaatctcatatctacttctttcatgctagggctatgtcctnctttggatcttaagcacac

SEQ ID NO: 24358 - DNA, 536 bp, Zea mays
  unsure at all n locations
  Clone ID: cC-zmle189061f12d1
aaacttatctcattacttcattgaaggactacaggaagggactctcatggaaataatagattctcaagttgtggaagaggcagaccaagaagagattaatgatatctcctcacttatagaagtgtgcttaagatccaaaggaggacatagaccaagcatgaaagaagtagatatgagattgcaatgtctaagaacaaagaggctacggaataaaacacatcttttgattgaaaagggtggagaaatggaacctttgttatgcgcagaagctcagcacccacatgaacgtatcagtccaatttataatgaggaacatttaacaattccaatgatgtctggatgctatagtttggagcaagaacttgcggcagcatctagtatggttcgctaacttggtatttgcttggatattggacacatctatagtaaccatctattttcagagaggaactatggtatattttgttcccttcgcataagactatggtatatatggtgcgtatatgtatataatatatatgacattgctatngttt

SEQ ID NO: 24359 - DNA, 501 bp, Zea mays
  Clone ID: cC-zmle189061g01a1
aaaaccatgcatttttattgtttcatcacaattccatcttctcttattcgttctgacagcagcaggagaccccacgagtggcccccacgtgacagagcacacggctggtgtgtggcatggtgctacacgaacacgacacactaacgagacagattaaagctaaccgatcgaagggaattcattcgtccaacagcaacaaagtcccagattaaaagaagaaaccccgtgatggcgccggcccagataagacgctgcttgcatgctggcgcgtggatgctcgctcaggcgtccacgacctcgtcgtccttggacgcaatcacgaactcctcgcgcagcgccggcgacacctctgggatggtcccgtccacggcgttgggcctgcccagtgccttcagcgccaggtgcgccgccttctggccggagatcatcatggcgccgaacgtcgggcccatcctcggggcgccgtcgatctctgcgacctccatcccggtgacgatcatg

SEQ ID NO: 24360 - DNA, 410 bp, Zea mays
  Clone ID: cC-zmle189061g01d1
gaattgcagggtcgccccacgcgtcagcccactcgttcgagatggcttgcgagacgccggtgctgtgtgtttttctgggcgccgaggagcgggccgagccggatgatcgcgccggagatcgacgagctggccaaggactacgccggcaagatcacgcgctgcatggtgaacacggacgacagccccatcgaggtgtctacctacggcatccgcagcatccccaccgagctcatcttcaaaggcggcgagaagatagagagcgtcttcggtgccgacccgaagtccacgctcaccaccctgatagacaagtacatcggtagttcatgagcatgccatgccatgccatgcatacatgcatggacgactaaacacatatgtgtatggctagtagcctttgcattcgggttatg

SEQ ID NO: 24361 - DNA, 533 bp, Zea mays
  Clone ID: cC-zmle189061g03a1
ctgaatattcagttaagaccattccaaggctccttttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgtccaaaaaatatcatattcgtaaagcagaaacataaatgtactcccattaatgtggaataggcggaactgaattagtcaattcaagttgacattgtcaatttatccagaacttctctcttttcctcggtgaaacaagaatctgttttgctcaaaccaaaggcaggagcgcttactttagcctttatttcttt

SEQ ID NO: 24362 - DNA, 422 bp, Zea mays
  Clone ID: cC-zmle189061g03d1
ggggagacccacgcgtgcgcccacgcgtccgcccacgcgtccgatgaggagacagtggtgctcttgaatgactaggcgatccgagggacgctccactcggttgaccagtacctcaacatcaagctcgagaactcccgcgtagtcgaccaggacaagtatccccacatgctttcagagcggaattgcttcatcagatgctcggtggagcgggacgtgctgctcccggaggacggcgtggacatcgacatcctccacgtcgccaccaggagggaggcgcgcggaggctgatcctgatgcgcacccgctccctgacctgctggctgctgcttcatacccgatagtacgaagcctgcatgtacggagtgtggtagacagatgccccagtttagttgtttggcgcttggctgacatagatttccctg

SEQ ID NO: 24363 - DNA, 121 bp, Zea mays
  Clone ID: cC-zmle189061g04a1
actcaacaacatcgcctatcctacatttcaactctgaactcccaattcccaaggggaaggaagcagcagcagaagcttcaaaggcctctcaggtagccaaacctgacacggttgctattac

SEQ ID NO: 24364 - DNA, 436 bp, Zea mays
  Clone ID: cC-zmle189061g04d1
gacccacgcgtccgcccacgcgtccgcccacgcgtccgagcagttgctgattctgattttagttattagctgaagaagggcaatcctctgaatcagtgatgactagcgttgcactctgggagttcactggataatgatgatggttcggatgtatctctaaagttaaggctgccttgcgttgcatggaagtaaacaggaaatgaagctccttgtcgattctgggtgaggatgagggtgagggaggagctgcggcctcagcggataggcacttgagtatggttttatggacgaccggcccccgactacgtactgcaataatcttgcattggaagcgagatcggttaacctgatttgtcatccttgtggcttcatgatgcgaagttccgcttgtaccggttgctagcatgttaactgaatttttagaatcgcatatact

SEQ ID NO: 24365 - DNA, 520 bp, Zea mays
  Clone ID: cC-zmle189061g05a1
gaccacgcgtccgaggatcctcttggaggaggagattacagaggcatgcacacctttgtttttctccctcctctcgtcttcctcctaaactcgactcattcgctcgacaccgcatggcctaaccagttaaacccccttcctcctgcaccggtgaattgaacgaaccaaaccgtcctgactggtccagcgaggcgaacatggcagcctgccgcggcgccttactcgccgacgtcattgcgatcaacgtcgtgggttccgcttccgcggacaagtacaagccgacggagtccatactggtgaactgcgggtcggcaaaggagggcaaggacgtcgacgggaggaaatgggcggccgaccaagacaagagctggctcgtcgacgccgggaagtcatccatcatgggcgacgccgacgtccaggacccgtcgattgcgtcggccgtgccgtacatgacggcccgggtgttcaccaaggaggccatgtacaacttcttcgttggcgacgcggacaggcactgggt

SEQ ID NO: 24366 - DNA, 263 bp, Zea mays
  Clone ID: cC-zmle189061g05d1
aattcttgggttgacccacgcgtccggatagatatgttcatagctagactgctagactagataattccatctccgttgtgacgacgcaaggcctcatgatgatggagctcgagcatggctggcatggcagcacttcctgcttgactgcgtctgcgtggtcagattaagcctctgataattgtaagacgatctgaaaatctgcgcgacaaaaaaaaaagaaaacctaaaaaatatcaaaaaataagagatggaataaaacaggg

SEQ ID NO: 24367 - DNA, 489 bp, Zea mays
  Clone ID: cC-zmle189061g06a1
aaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgcctttttggaggcaggggacttcacggtcttcggcttggccttggccttggcggggggggactttttcggcttcgccacgacctttttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttggcggcgtccgagagcttgtacgaagccttgaccttcacgagcttgcccttggctgcggacccacggagctggatggaaagca

SEQ ID NO: 24368 - DNA, 236 bp, Zea mays
  Clone ID: cC-zmle189061g06d1
gatagatagttcatagctagactgctagactagataattccatctccgttgtgacgacgcaaggcctcatgatgattgagctcgagcatggctggcatggcagcacttcctgcttgactgcgtctgcgtggccagatcaagcctttgataattgtaagacgatctgaaaatctgagtgaaaaatacattatcccatcccaaataaaaaaggaaggaagagtcgaaatacaatcaag

SEQ ID NO: 24369 - DNA, 521 bp, Zea mays
  Clone ID: cC-zmle189061g07a1
cgaaagaattacacagcgcttatccatttactattgatagtgtataacagaggcacaattatcagaaatgatatttatatcacataataataactaaactaaagtacagcactatttgaagcacactaccagtttggatggaatgaaaccaatccacgttgtcgataaaactaatttacatcccaacaaacttcctctggcccagctaggagaaatttcacttcgtcacatacatgacgtgcaacagatgaattactcatggttactaaaatcttgtgaacatttcatttgatgccttgcatagcgcaatcagcaatgctgtcagttgtatcagtagatgtccaacactgaggtatctgacgaggacactggcaaaaattgctgtgttacagttcctgaccatcaaaatctggtctcacaggataatccagaccctgtagagctggagttcttctcaaatcctcttctgagtatgcagggatgaaccaatattttctgtcatttccaaaaacctgagcaaa

SEQ ID NO: 24370 - DNA, 601 bp, Zea mays
  Clone ID: cC-zmle189061g07d1
cacccgtccgcccacgcgtccgcgtcggcctgcttccagtttaccgcagcggttttactgacgcgcctccgacgacacgccaggtgcggcatccatgggcgccgcggcggccgacctcgaggcgcgtcagctccgcatcctcggccgtatttctgacctcgagctcgccgcgcagcagcaccgcctcggggcgctctccatctccaccgcgccctcagagaaaggcgaggccgacgcgggggctaccgaggttcatctcgcagccctcctggccgcgcgcggcgtgcgggacttcgccttccgtcgcgttcccgccgactactacgaccgctccctcgaggagcggcgcgacctgctccgagccgactcagtcgcccagctctgcaagagtatcgtcatggtgaacacccaagctgctgcagatgttgttgattgcagtaatccaaagaattcaaaatactatgtcgttgttgttcagtatatggcacggcttaacgctgaaaacatcaagaacttcctgtatgaactaaatgagaagcatataccgaaaaagagatttaacatgagggtggcaccagaagaggagtcacacaagcttact

SEQ ID NO: 24371 - DNA, 234 bp, Zea mays
  unsure at all n locations
  Clone ID: cC-zmle189061g08a1
ccccccctggggggaaggggggccccctgctgggagcgcccccaaaaaaaaaacaaggcccccccccccccgtggggttgtgtgggcaaaagggggggcccgggcccggcccacccctatttaaaggggggccccccgccggggggggcccggagatttttttttggtccccgggaaaccagccagagggnttattttttgtctccctgggggcagagcccccccagggggccc

SEQ ID NO: 24372 - DNA, 320 bp, Zea mays
  unsure at all n locations
  Clone ID: cC-zmle189061g08d1
cctcctcaacaggggccagcgcgtagctggggaagatatattgttacccggctcaacatgaatgcaaacatgtgaggcttcagctgaatagaataataatgaagacgcatgcatgtcgaccccaggaacaagagaaataatacaagaccaccacgcatgggcatactccatatatatatgtatagcccgtgcccgtgaacgaatttgtaccaatacaagccattactaatgaatngattattaccataattatcgcgctatgacatacatgttccccctgatacctgaagatgggtgtagtaccagttatcaaaataaga

SEQ ID NO: 24373 - DNA, 350 bp, Zea mays
  Clone ID: cC-zmle189061g09a1
attcattcccagcaggaatcgttgggcttactattattattattaggccaataggataggaggccacggtcctatgaagtagggaccacaacaacatacgtgatccaattaattcagcaggtaccggttcttcctcttgttctcgggttgggatttctcctgggcattcttcatcatgatgacaaggatgcgaacaagaaccgaaacaaaggcggggaagagagtcagcgcgggcttgatatagtccatgtccccacggggcgccctctcgaagatctcccggggggcaaacaccatatatcccaggaaaaccaggagagccaaagtagagctcaaacatgaaagacgcg

SEQ ID NO: 24374 - DNA, 610 bp, Zea mays
  Clone ID: cC-zmle189061g09d1
gtcccaattagggtttctttccgcttgctctccactttgcggcatcagtttgtttttcctgcgatggagtctctgttcgggcaagggcatcggaggaggagggcgggcggcagcggcttccaatcgctcaagcgtctgggtcacatctcacccgctgtgcagtcccacctcaaacatgtgtacctgaccctatgctccgcgctggccttctgtgcacttggtgcgtacctccacattctccttaacgtcggaggcgccctcacgaccgtgggatgcgtggcctccatcgccttcctcatctccctgcccgcttcacggtaccaggagaggaaccgcttggcgctgctcatgtctgccgcgctccttcaaggtgcgtccgttggtccgctcgtcgaccttgttattgacttggattcgaggattctcgtcactgcgttcgtcgggacggcagttgcttttgctgcttctctggcgctgtcatcatcgccaagcgcagggaataccctgtcctcggcggtctgctttcatctgggctctacattcttttctggctggagattgctacttaaatctttggccacaccagtgcgaccttcatgtttgagctcta

SEQ ID NO: 24375 - DNA, 487 bp, Zea mays
  Clone ID: cC-zmle189061g10d1
acccacccgtccgcccaattgcctgcctcctctacctgtccggctgtcccggttcttttatttccaccctcgcgcggcggtcggcggggcgagcacagctgccggaaggcccgtcggatccgccgtcgccaagatgaatgacgccgatgtagccaatcagatccagcagatggtgcggttcatccgccaggaggccgacgagaaggccaacgagatctccgtctccgccgaggaggaattcaacattgagaagctgcagcttgttgaagctgagaaaaagaagattagacaagattatgaacgcaaagagaagcacgttgaagtacggaagaaaattgagcactctatgcagttgaatgcttctcgcatcaaagttcttgacgctcaggatgatctattgaacaaaatgaaagacgatgcgatgaatgaactccttcttgtcagccacaaccaccatgaatacaagaatcctgtgaaagatcttaat

SEQ ID NO: 24376 - DNA, 353 bp, Zea mays
  unsure at all n locations
  Clone ID: cC-zmle189061g12a1
agggaaagaaatatttatatatcacggtcttatttggcttccattccggggtctttattcagcaaggataaaattaaatccacttagcccaagagcatccatccgaccttaacccaaaaataaataacctctggtcgacaccccccaaaccaaaacatgactgggaggcaccctccatcagctaccgattggttcctttattcctgggaaccagaattaacctgaccagggaattgaggnccaatcccctcagaatagcctaataaacgatgcgggaatcacagaatgggggggcactttatccgcccgggattgacccacgcgagacgaaaagataattcccaccattagac

SEQ ID NO: 24377 - DNA, 608 bp, Zea mays
  Clone ID: cC-zmle189061g12d1
gccggaggcgaagatgtcgtcggtgttcagcggcgatgagacggcccccttcttcggcttcctcggcgccgccgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaaggcgaagccctactacctctttgatggctacgcccacctttcgtccgggcttgcctgtggtctcgctgggcttgcagctggcatggccatcggcattgtcggtgatgctggagtcagggcaaatgcgcaacagccaaagcttttcgtcggcatgatcctcatcctcattttcgcagaagcgcttgctctctatggtctaattgttggaattatcctttcgtctcgcgctggtcaatcccgggcggattaagtgcaccaccattctgtgattaccgcatcgtttattatgctattctgagaggattggaactctattcccttgtctagtttattcttgttaccatgta

SEQ ID NO: 24378 - DNA, 470 bp, Zea mays
  Clone ID: cC-zmle189061h01a1
ggtatgaataggacttattatttattaggcaactagcccaaatacatatacaaatacaggagttcaaaaccgcttataaagagaaaaatacaagtaagaccccctatctatctatctaacgagcagcagcatcgaagcaggtaggttttctatggggctaactaaaaatggctattgcattattggaactctttcactcttctgaatttctgatgcaccacaataggccaaacagtactgggcagttctggacgtcatccttgaaactgaatcaaagattgctgtgaccatgacagtggaacagagcagaacagcctcattcacttgaccatgccatggcacagatctgaaccgcggtacgagcagagcaacagaaggactgctttgaccacaggagtgtctccgcgcttattctgttggacgacatgccacgtctggccgtgtacgcagcaggattgaggccactccac

SEQ ID NO: 24379 - DNA, 478 bp, Zea mays
  Clone ID: cC-zmle189061h02a1
gaaaacaaccgagctagaaagaggcgatggtaagttaatatagcagaaaagaaagagactttttttcagtgttgacaacacaatttatacagcaggaagcatccaatcctacactctagaacaaaacgagccagaaatcttcgtattccgcgggttcttacttctggaatttgtatggcttcaagaattggatatcaaaacgaatccatgcttgggtgaacacagggaagcacatacaaaatcttatggggacacacagattgtacagcaccaagcagacgccttataagagaatggtgcatccacatctgttctgcttgggggaattggcaagctgcttctgactgtttttgacagcttgtggaggccgcactaccacatgcattgagattacaccacctgggatctatcctactggaacacgggactctgcaagtgtccggttattttacaatatactttcaccattgataagctt

SEQ ID NO: 24380 - DNA, 327 bp, Zea mays
  unsure at all n locations
  Clone ID: cC-zmle189061h03a1
ctntttgtttatcattaagaacgagtgaatgtgaatcccgtaaattttgagatacaaaatacctacttggcagctaatctagccaacagatcaaaattcacgtctagaattgtctgacggacaaaccaagtagtcagttacagaaacgtcttttcataggttgtcagcaagcattagcacctccttgaaatgttgctcaccacttcaccctaattgatgtttgacacctctatcgaaactatcacaacagtccatatccatgaaactgataatactacctcggtccagtacttacctccgcacaagcaaccggacgcgtgggttgat

SEQ ID NO: 24381 - DNA, 470 bp, Zea mays
  unsure at all n locations
  Clone ID: cC-zmle189061h04a1
tttttataataagaagtccggttttagtatatatatagtatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggcctcgccggactccgccgcggnctcgacgaactcgggcgcggccttcttctccggggccacgccgaggacgacggtggcctgcgcggcggtgctcgtc

SEQ ID NO: 24382 - DNA, 85 bp, Zea mays
  Clone ID: cC-zmle189061h04d1
ccatcgcgggcgcctacacaggggacaaaatataaaaaaaaaaaaaaaaatttaaaataaaaaaaaaaaaaaataattatttttt

SEQ ID NO: 24383 - DNA, 312 bp, Zea mays
  Clone ID: cC-zmle189061h05a1
cgggttgacccacgcgtccgcctgcacccctcctccttcctgaacgcagagcacgcccgccggtcgttgtcttctgcctgcttgcgtgacactgaatcagtgatacatcatacatgcatgcatgggatgcgatgacgatttgatgcatgcatgcatgggtatacctaccaatttgatgaccgacgatgtatagtttcgtcgactgcttcatacacatatatagcagcccaattaatgtaacgtcacgcaaataagcatttgcggtaattttttgtctcgttgattcgatgaataaagggcatgcttgagagt

SEQ ID NO: 24384 - DNA, 152 bp, Zea mays
  Clone ID: cC-zmle189061h05d1
tccgcctataacttatgtgtgtatcggtacgttatgtctccgtctgttctctttctcgtgagcaagcaacacatggctggccgggtggtcttgcatttccattgcataatatgcttatgaagaatgctttgttaatatgattttacagtcct

SEQ ID NO: 24385 - DNA, 500 bp, Zea mays
  Clone ID: cC-zmle189061h06a1
ttttgtcatcaatgttttggtttggtttgattgtatattgtgccgatctgatcgctcggctgcgaagctgaagcagaccaatcgtgacatataaattatcgtagtattatatatttttattgtaacgcacgagtttaaagtgctcttattaaaattgaaacacggacaaacatgtaaggtctccgcgtcacttgaggcttcgtagctccgcatggaaagcctcagcgtgctcctgcttgacgcagagcgccatggcggcgacgccctcggccttgtcctttttcccgcacaggaagcagcccggcaccaccttgcgctccatgcacccgatgacgcgctcagcgccgccgctgccgaagtcaacgtcgtccaagccgaggttccaccagctcgtgacgtacagggtgtcgtaaccgtcgaggcccttgagccgaccgcccatctcgtcggcgatgtgcgcggctccgtcagcgaacgtgaacgggacccgtgccttggcg

SEQ ID NO: 24386 - DNA, 409 bp, Zea mays
  Clone ID: cC-zmle189061h06d1
gtccgagaacatcgccaggaagctcgtcaactccaaggagggcccgccctcgtttgagcagcccaagataacgatcgagaagctcttggagtacggacacatgctggtggcggagcatgagaacgtcaagcgtgtgcagcttgctgacaagtacctcaacgaggctgctcttggtgaagccaacgaggacgccatgaagactggctccttcttcaagtagaaagcaactctttgctattgctaactaggcgcgaggccggcatatgatcgaggaggcgaatatatatattacttggatagttttgtcatatatatatatatattactgaaccaggacatgcatacatatatccgtctatataatggatcatgtatatttcaaagcataaggaacagccctctatgaacg

SEQ ID NO: 24387 - DNA, 203 bp, Zea mays
  Clone ID: cC-zmle189061h07d1
taaacgaacactggacattataagacctactcaattagggaggaaaacaagggctatgcttggggccaactgccaagctagatatgcacttgcatttaaacacaccgacatgaatatgattacctcggcattgtgaggtcccacatccatgcaaccccggacattcacttagactgtcgataacgacagtaacatacccaaac

SEQ ID NO: 24388 - DNA, 82 bp, Zea mays
  Clone ID: cC-zmle189061h08a1
gcacaaaaccaagcctctcaccgatgaggttttgttaaccctgcaatttcatccatccccaaccttcgtcttttttctcgtt

SEQ ID NO: 24389 - DNA, 69 bp, Zea mays
  Clone ID: cC-zmle189061h08d1
ggttgaacgaaccctcccgtatgcttgtatcctctagagcagcccccccatactatataattttttttt

SEQ ID NO: 24390 - DNA, 340 bp, Zea mays
  Clone ID: cC-zmle189061h09a1
aacatctgcaagcaaataccataccttcaccgggtttaaacattcggaaacaacaagcaatttaaaatgggccaaacattagaaacacatttagcataacaaccctggctttggtccagcgaggacaggaaagatctccaaattttcttttttcttggtctagctgattcactaagcaaaggtacacagattcagaatatgcttgtttgaatgcaggcatgcaagatcactcctccatagcatcaccaccctgggggacctcaaccttttggtttagaagtgagacctttgaagacagtacctcagtctgccccttcgagaaactgtatccctttgaact

SEQ ID NO: 24391 - DNA, 439 bp, Zea mays
  Clone ID: cC-zmle189061h09d1
gtcgacccacccgtccgcccacgcgtacatacacgcgtccgcccacgcgtccgaaaataacttaaagggtaccggaagcggcgaaagggttgggcccccgttcgctctcgcatcgtctccggagcgcacgtcagatcaggtgcgccgcgcccccctttgcctcagcttgcgacgaccatccatcgaacaggaaggatgacgggctccatggatctcccggccaagggcgggttcagcttctacctgtgccgccggaacaacatgctggagaagaacgggctcaaggtcccgggattcaggaagaccgggacaaccagtcgcggactcgttttttcaggatggggttgttcttggggcagacacaggggccactgagggccccaagttgctgttaagaactgtgagaaactccactttatgggaccgaatatattctgct

SEQ ID NO: 24392 - DNA, 438 bp, Zea mays
  unsure at all n locations
  Clone ID: cC-zmle189061h10a1
caccgaaagtgagtctttggggggtgaatcccaaagccctgtggagggggaggagttacaaagggcttttacaatgcaacgcttcacttccactggttggcgcaaatgtcagcatggtcgacgaccctttgcgagtagccccactcgttgccgaaccaggagatgaccttgaccatgtcgncgcccatgaccttggggagggaggcgtcnatggtggaggaaacgtcggagcacctgaagtcgacggacacgagcggcccgtcgcaaagctcgaggatgcccgtgagctcgttggccgaggcgtcncggaacgcctggttcacctcctcggcgatggtcttctaggagacctgcacaacgaggncgacgacggaaacgttcggggagggcacccggagcgcgatcccgttgagcttgcccttgaggttggggagcacc

SEQ ID NO: 24393 - DNA, 353 bp, Zea mays
  Clone ID: cC-zmle189061h11a1
acccattcaaaaagcagattggggattattagagcaagacggcacacgttgacgcaagcacacaagttttggtgcaactccgacagtttcaaatccacgacgacgtccatcatgaggatgactaaggtcactggggattcaatagataacagactgcacttcaacacgggggggcaatcacttcaggaggggcttcacaatggatttcacgttcagcttcttcaggtccgtgtaggactgaccacagccaacgaacatgactggagctccagatatgtagaccatggaaagcgctgctccaaccttgtcgtcgatggtgtcaaacttggagagcaggataccatcgatcaatc

SEQ ID NO: 24394 - DNA, 599 bp, Zea mays
  Clone ID: cC-zmle189061h11d1
accacgccttcggggacaccttcagatctggtgctgtagagcatctgacaactcattttaggaggcttcacatacctatatttgagaagggttattagaaagatccggctgttgtcacgagggaggctattcaggaagcaaccccgaacaaaccatatgctgctcctggctgacactgctggacctatgcaggggccgagccactcatgagggcactctccaagctaatcaatctcaatagcccatacctggttttatttgatgagaacgcatagaatggaaatgatgctgtggatcactctcactaaatttacccagaaactaccagccctatctgctgctcccactgatagaatgatcgacggtatcctggtcaccaagcttgacaccgtccaccacaagcgttggacccgcgcttttcatggaccacatatctggagcttccagcatgttccatggctgtggtcagccctacaccgacctgaataagctgcacgtgaaatccacagagaaaacccttctgaagtgattgcaccaaccgggttgaagggcactctgctaccctatggaaccccagagaacctttccttccttaatgt

SEQ ID NO: 24395 - DNA, 259 bp, Zea mays
  Clone ID: cC-zmle189061h12a1
gaaacaaatactttgggatcaaattttcaaatacagagagatcaccatgtgggcgccatttttaacaactaatgaagatgcagcgcacaccatgcgtgtaataatctattagattttacaggacaggtcagggatcgatcatttctggaacaaaatatttttttgcgcagtccttgattttttttgggatcatcatcgtcatcgacatcgagcacgcttgcttgcatccatgcacgagctgactttccccgatcgaccg

SEQ ID NO: 24396 - DNA, 590 bp, Zea mays
  Clone ID: cC-zmle189061h12d1
cccaaccggaattttcgggtcgacccacccgtccgcttgtgttgtgttgtgctgtgctgcgagaagaaggagattaggttgaagaagagcaggtgctgagaagcgtgccggcgcgcgttacgacaagcatatatgggggagatcaccaatgtcatggagtaccaggccatcgcgaagcataagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggccgcccccactgctatgcagaagatggctcacccagatggggagaacgccactgcgcgcgcggcggctgcggctggcaccataatgacactgtcgtgctgggcaacttcaatcgtcgaggaggttgcctttaccgggccagggatccgcttctttcagctatacgtctacaaggacaggaaggtggtggagcacctggtgaggccagctgaaatggttgggttcaaggccat

SEQ ID NO: 24397 - DNA, 274 bp, Zea mays
  Clone ID: cC-zmle189062a01a1
aataccctggtataaagaaaaacaatggtgtgcaaatgcatgggaaacggggacacatgaaaagggggcccagtataggtcagggtccaaaaggttaaggccaataatgctaacaaaaagcactgccacaaaaaatattggcacacccccggatgcggaattcccaggagggtgttgaacaggaggctcttgaccccgcggaacttgtccaagtggaaattgtaaaccaggtaaatggagcacccccgaatgaggcccgccaccgccataatgg

SEQ ID NO: 24398 - DNA, 572 bp, Zea mays
  unsure at all n locations
  Clone ID: cC-zmle189062a01d1
aaagggggagaagcacagactgaactcatattacatttgctgagcgatctcggtctctgtgtattacacaaacacatggatagattagaggagcaatctccattaggtagcctgccatagtcaattaagtctccttgatagagacttgacagattcattttcgctaaggctgattgctgttggcgtggctttcacagaggatcagagggacaagatcacaacggactgcagagagttcatcaagctgaaaggccccgtcacagccccgtcgtacaccgacgactgctgcgtcgacataagagcggtgcccaatctcgacatggagtgcatcattcgcctgctctccaataaacagaagaagaagttcgacgaggacaagatccggcggctcggcagcgtgctctgcaatccacatccggtgatgatcgaaaatggggtgtggcagtagtttctgatggagagcatcgcgtcaacaataaggagctagaactatacaaaccctacatgatatgagtcaccatntcatatgtatatgtactccattctttaacaaaaaaaagtgtcttaatatc

SEQ ID NO: 24399 - DNA, 472 bp, Zea mays
  unsure at all n locations
  Clone ID: cC-zmle189062a02d1
ctcccgccccacccagcgcaacctgctcctctccgcgcaggtcctgcacaaggagctccccatccgcttcgcgcgccgcgcgctcgagctcgactcgctgcccttcggcctctccaacaagcccgccatcctcaaagagcgggactggtacatggactcattccgggacatcagatacttccctgaagagagagagcaggaacgacgagctcgctttcacgcagatgatcaacatggtcaaagagcggcataacaatgaggttccaaccatggccttgggagtgcagcagctgaagaaagagctgggccgctcaaagaaggttccattcgagttcgatgagatcgacgagttccttgaccggntctacatgtcaaggataggcatccgcatgctgatagggcagcatgaggcttagcatgaccctaaaccggagcctggagtcataggcctcatcaatacaagagtatcccc

SEQ ID NO: 24400 - DNA, 469 bp, Zea mays
  Clone ID: cC-zmle189062a03a1
agaagaaatacaataatcccaggtttgaacttgaatcccaccaaaaacacggggcatccacagaatacacaccagccctagtctaatccaatcgacatcgacaaaataccagtagtcttataacagagagagagagagagaaaaaaaaagaaaagaaaagagggcgataacgcaggacaaagctagaatagcacggcccagttccagcttttccgtaagctggttgcttcacttgcagccgtgttgaacccggcacggatggttccgtcagaagcaggcgtccaggaggcagcagcagcagagggcagccaagcattcttccatgaaggaaggcccgctgctttgctgctgctgtggaagcggctgcgcgtactgcggagggtagccctgctgcgggtaaccctgctgggggtagccctgcggcgggtagccctgcgccggcggggggtagccggccggcgggtacccc

SEQ ID NO: 24401 - DNA, 478 bp, Zea mays
  Clone ID: cC-zmle189062a03d1
gacccacgcgtccggaagcagcaagagctcccctgaccttgctccgcctccgatcaaagtaaatgaagatgagctactacggccagcagccccccgtcggcgtcccgccgcagcaaggctacccggggaaggacggctacccgccagcggggtacccgccggccggctaccccccgccggcgcaaggctacccgccgcaaggctacccgcagcaaggttacccgcagcaaggctacccgccgcagtacgcgcagccgcctccactgcagcagcagagcagcgggccttccttcatggaaggaagctaggctgccctctgctgctgctgcctcctggacgcctgcttctgacggaaccatccgagccgggttcaacacggctgcaagagaagcaaccagcttacggaagagctggaactgggccgtgctattctagctttgtcctgcgttatcgccctcttttcttttctttttttttc

SEQ ID NO: 24402 - DNA, 315 bp, Zea mays
  Clone ID: cC-zmle189062a04a1
ggtgaggtaatcctttgttagtattgatctctttttgctcaaacccaaaaaacagcaaccagaaagaccgcgggcctaacaaagcccaacggaaaaacgacaggaggggaaaacaaacacagtaaaacagaaaccaggaacgctagaacacggaccaaaagcacccggagggagaggtcggggaagccagacgaacgaccgccggaaacgagcgccgacagataccggaacccgtccagaggcgcaccaaccatggggggcccaaggaagaagggcccaaggaagagggccgccccataaggggggcacccgaca

SEQ ID NO: 24403 - DNA, 378 bp, Zea mays
  unsure at all n locations
  Clone ID: cC-zmle189062a04d1
aacatccaagtcatcgaggagggctagggcaagcacaacatcatttgcattgaggatcttgttcatgagatcatgactgtcggcccacacttcaaggaggcgaacaacttcctttggccatttaagctgaaggcaccgctgggaggtctgaagaagaagaggaaccactatgtggagggtggagatgccggtaaccgagagaattacatcaacgagctcatcaaaaggatgaattaggttcacgatcaagctctattgagttctaagaaactttctgagctctcccaattttacattattaggaagcggatgaatatgcatgcagntttgttgtttggaactagatgtgtatggaagaaacatgatcttttttctcgg

SEQ ID NO: 24404 - DNA, 387 bp, Zea mays
  Clone ID: cC-zmle189062a05a1
ggaggggaaaatgaaattcctggttgcatgaaagtacattacttcaaatgcatatttgagaattaaacaaagctaagggttggaataaacggctatatggcgcacatgttggggcgcgcgtatttatatatccaatagattgggtgcttaattatgcgttcggactcgactcgattcatgcttgcttgcgatgatggagaagctagaccacgtggacagcggggctgtgtcggctgacgaagacgtcgaccacgtccctgttgggcagcatcgccggcgcgattgcttcaacagcgcaactcctggcaggaacggccgccatctgggtgactgggtgcataccggaggtcctctccgggagggcggagttgagcttggcaatgttga

SEQ ID NO: 24405 - DNA, 393 bp, Zea mays
  Clone ID: cC-zmle189062a05d1
gaactctgagctcttcgagccctcctgcaagcgccaaggaggatgagaagagagcgtactgcgtagttccatagacccggacaaaccagcgccatcatacaacaccagcaactgttggtttagttgtatatctgccttgcagccgtattatctgtatcaccctttttgtgtcgcgatggctggcctatctttggaacatccttgggcgttcgccttcggcctcctaggcaacgtcatctccttcatgaccttcctagccccgataccgacgttctaccgcatctacaagagcaagtcgacagaaggtttccagccgggtccctacgtggtagcgctgttcagcgccatgctgaggatcttctacgcactgatcaagcccaacgagaccttgct

SEQ ID NO: 24406 - DNA, 390 bp, Zea mays
  Clone ID: cC-zmle189062a06a1
aacacaaatcacacacaccaatatttttgcagcggaaatattattactaaattttacaagttacaaaaattttacattattttatcggagtgattgcaaaagtataagtttgaaatatatgctagctcaagtgaccatcctcaataagaagtatagaagggttacttagacttataagaaggccgagcccactggctacttaacaccatcagcagcagcacaaaactataacctgaataacactaggttagtatttgttaggcgatgtccacttgacgatcatctttgtccttgcacttgatcaggcatgttcgtccatcagcatcatcctgcggattagcccgtgcttggggtcgacttggctcgtcttccacatcacgcgattattta

SEQ ID NO: 24407 - DNA, 389 bp, Zea mays
  Clone ID: cC-zmle189062a06d1
taaataatcgcgtgaagtggaagacgagccaagtcgaccccaagcacgggctaatccgcagagatgatgctgatggacgaacatgcctgatcaagtgcaaggacaaagatgatcgtcaagaggacatcgcctaacaaatactaacctagagttattcaagttatagttttgagctgctgctgatggtgttaagtagccagagggctcggccttcttataagtctaagtaacccttctatacttcttattgaggatggtcactagagctagcatatatttcaaacttatacttttgcaatcactccgataaaataatgtaaaattttagaactagaaaatttagtaataatatttccgctgcaaaaatataggagtgtgagatttgagtt

SEQ ID NO: 24408 - DNA, 518 bp, Zea mays
  unsure at all n locations
  Clone ID: cC-zmle189062a07a1
ttttgcacatatataatacactatatataacctgatgacaaatctatctgtgagtagtatacagccaagacagtcgcctcccgcccgatccatgaacaaggggaatggcagtttacaccagcttattggaatgtacagagttaaccaccccctagcgcatctccatctcaagggccgtgattcgatgtttacagtatgcatccgtgctgcatcacggccagacggtctgaaggaaggaaccagctgcaccggccccctcatatggcgtagatgcggtcgacctccgaatccgagagctccgagttgtggtgccacgagttcgagccgctcctcctcgtcgacttcaccttcttcctgatcttgcgcacgcgcttggacttaccacgtagtacgtcatcgtgccgagcacgccggccatgatcaccccgccgatcagggtcaccaggagcgccgnccacttgaagtgccgcccacacgatgtacgaggaggatatgaacgcgaccgtcgtgcacaccga

SEQ ID NO: 24409 - DNA, 513 bp, Zea mays
  unsure at all n locations
  Clone ID: cC-zmle189062a07d1
aaggaggcgaccgcgctgctcatcgccgccgagaagagggtttcttgacatcgtcgtcgagctgctcaagcactccgacaaggacagcctcaccaggaagaacaagtccggattcgatgctctgcacgtcgctgcaaaagagggccacagagatattgtcaaggtacttctggaccatgatccatcccttgggaaaacgtttggccaatcgaatgagactcctctcataactgcggcgattagaggccacactgaggaggagaacctactgctggagcgagtttctgggtaggttgagttatcaaaagcgaatggaaagaatgccttgcactttgctgcccggcaggggcatgtggaaatcgagaaggctttgctagatgctgatacccagcttgctcggaggactgataagaaaggccagactgctctacacatgagcagaaaaggtactaacccggaagttggtcaagcgcttgagaatgccgatccggcaatagncatgctacctgacag

SEQ ID NO: 24410 - DNA, 554 bp, Zea mays
  unsure at all n locations
  Clone ID: cC-zmle189062a08a1
ttttccaaaatgcattagcttcacttcatggcagtaacggtctcgcggccggcactgggtggtacaatatttctttacagctacggtaggataccataccgtatcttcagatctactgatcctatcatcattagaactggttttgatttaatgttcatctcacatctctaatctcttgacgcaagccaccgtactgagtcagcgcggcctctcttcgactatcagcacacggttcgtccgtagcagatggaagctatgtagagattcttcgcccatttctccttgacatgtgaactgggaaaggcagaggtccggagggtttcttgcgtctcgtccatcggcttccgctttggcatgctcaagatgaaagcagcttggtcattggtggccgctgtggaagttatcctgtaaccactctcccatcgccgatggatgccttcgctagggtacaggaagtccaactctacaacctgagtagaaaaccctgagttccttgacataactacgccccagcgattntcagcagtggccatagatgttacatggaacccttc

SEQ ID NO: 24411 - DNA, 588 bp, Zea mays
  Clone ID: cC-zmle189062a09a1
tttttaactattgatagcctttatttaatcgcagcgcttcagtacaaaagatgtttagattccattcgcatgaataaatcaacttttgagaaccagtggcacaaaccttcagcttgccattgctacaatgcattttcccaatccaagtatccaactattgtagataaaacaagtaataaacttatatccccaacacacaaaatgaatttatatattacgccacccgtagtccctgaagctcgaatcactccttaacattaaaaggtcttgtaagagcatcctacctattgtgctgaacctggtggtatgttgctgctgccaccacccaaccctgctttctgccccaattctgccagttggtgaataaactcggccccactaagaatttctgttgcaccatatataacatgtttggaaggctgtgagcgttgctttagctctatcaagctcttgtactcaatgtaatttccaccaccgatcatgaaaacaacggcttctctgaagggtcctttaaactgcccactagttcctgacctaggagcccgtggatcaaacaaagggagtcatccacctctgggttggtttcct

SEQ ID NO: 24412 - DNA, 362 bp, Zea mays
  Clone ID: cC-zmle189062a10a1
atgaacaaagacgtgtataaagtaacccgcgaatagaatggcgactattccaatccatttgcacactcaaaagttgcaacaagtgacaaggataaaaagaggatccagactatgataactgaagagagagttcaccctaaaacaacttaaatggtgcaaggcacaactcctgctcaaggccaagactcatgatcctttctactgaatcaggatcatcatggtcatcaggaggaggttgtgcagatgatgcaggaggctcagcttcatgctggtgccgcatagtcatgtaaaaggaaactgtgcgaggcttaagagcaacagctgaaacaaagtgaaggttcggatcagcaggcaaattgctt

SEQ ID NO: 24413 - DNA, 395 bp, Zea mays
  Clone ID: cC-zmle189062a11a1
tttttttttttttttcttttttttttttttttttttttttggatcttatttttttccctttttcgttgttttccctatgtttgaggtgtgtctaccggaatgagagggcccccaagataaaaaatttcttcaaaaatacaaaaccaaacccaaaagagacgggcggggggggccaaaacaaaaaaaagggcgccgaacccaaaaaaacgggggcaaacaacccacaaaaaaaagcaccaccagcggggcccccggggcgacccctggggggggaaaacccccccaagccgggaaccatattacacagggggggggggcgggggcaaaaaaaaaaaaaaggcacgagggggtttcaccagaccacaccaaagccaggactgttcccgggggggggg

SEQ ID NO: 24414 - DNA, 399 bp, Zea mays
  unsure at all n locations
  Clone ID: cC-zmle189062a12a1
aagccataacctcaatttccatttttcttcgggtctctagagaacaggcttattggttttctccacccactaatgacatctttttttaacggaaagggggttaaagaaacttgaacaagaacttaacgattaccatagcccacttttctttggctacaaaagctgactctgcaagatcgatggcccgagcttgggcagcagccttattctcgcattcacgttggtcgtcatctgggcttctggcgggaacaatgcctgcaccagcctgaagatgagcgacccactcccgacgcctatttgggtntttgtatgagtacatcgaggtgaggctcggcgctgttgaaaattccatggggcggagagaaagtgcaatttgcatgtcaccatcaaacgatattc

SEQ ID NO: 24415 - DNA, 377 bp, Zea mays
  Clone ID: cC-zmle189062b01a1
aaacgaaaattgatgatgtattgaaaaacagagttttgaaccatggagcagtttggaagttttacatgactggaaaaaaaagggagatgggattgtagcttttatgagcactggtactagtaatgttcacatagcagggctctggaataatactggggatcaccacatccaccagcagcaggcaatccggttgccaacgaggagggagcctcaaacaagcacctgagctggagctagcctaacaatcggaaccctgaaaggggagcaagaaacgtaatccagcccagcctttgcgaaaaaggccacagacgaaggctttccaccgggttcttcacaaatggccacctttaaggtagggctagctttgggggcccttt

SEQ ID NO: 24416 - DNA, 455 bp, Zea mays
  Clone ID: cC-zmle189062b01d1
gagaggattaaagctgtcaagcagatgattatggctcccacgcttgagctgaagcagcaggcgctcgaccgtctctagccgtatcagagagtctgacttcgaaagcattttccgagctatggatggactcccggagaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgaagctaggcttccgagggtgcaagctaggtatatcgtaccctgaatagacagagatgcaagcccgggccatttttgaagctgctatagcaatgaccaaccagggtgttcaagtgttcccagagataaaggttcctcttgttggaacaccacaggaactggggcatcaagtgactc

SEQ ID NO: 24417 - DNA, 410 bp, Zea mays
  Clone ID: cC-zmle189062b02a1
gggaaccccaaaagggccccaacccaaatttggaattggggaaacccaaacaatccggtggggcccccaaaccttaaaaaaaaagggggggtttttattggcccccccggggggggaaaaaaaaccggacccaaaaaaaaattccgggattcccgggggaacaaaaactataggggcggccttttttgccctaaaaagaaaagaaccccattttttgggggggggggggcaagggaaaaaccttgttcctaaggaccgaacctggcgaaacccccgggcattatgagcctgaaccccccaaaagaaacaaatccccccccgttgggggccacccccctaataatgcgggggaactgggcaaaggggggggaattccccaggccccacaaaaaccccccaaacttgggggg

SEQ ID NO: 24418 - DNA, 458 bp, Zea mays
  Clone ID: cC-zmle189062b02d1
cttgtcggcaaagccaataatcaatcaccagcgacatcttttccttgcccgaccgcccgagccgcgcgtcgaggaaccgccgcacagttccatgggcaaggagcgctccttcttctgccgagcccgcatgaggaagcgcggaggctcccggccaggcttgtcgtcctcgactctctcgtccccgtgcccctccgagaggagggcgtcgccgccggccggagacgagacggagcgcgtcttccgcatgttcgacgcgaacggcgacggccagatctcgcggtccgagctggcggcgctgttcgagagcgagggccacgcggccaccgacgacgtggtgtcgcgcatgatggaggaggccgacgcggacggcgacagctacatcagcctgcccgagttcgcggagctcatggactcggcgtccggcgacgccgacgccgtcgaggaagacctgcgccacg

SEQ ID NO: 24419 - DNA, 552 bp, Zea mays
  Clone ID: cC-zmle189062b04a1
ttttgaacatgtaaatataagaagagacttggtaataaaattacacaaggatcatcatgcacatctcaaatcatgccaccaccgtaccagcagctaaattacaatatactgtaattaatagaagaagaagttctttaatttggatcccggctggggcgtgcggcgtacgtgaagcgtgattagtcgaaggtggccttgccggtgaacttgacgtcgatggggttgacgttcttgccgatgctgcggaagttctggccgacgccctccctgccggggttgaccttctccgggtagacgccgtccttggggtggaggtactgcacctcgccgttggggaagacgcggtagaactggtaggtgatcttgtacttggagcgcaacctggtgccgacgccaggcactgctccttgcgcgccagcttcaagaggttggggccctcccgcatgatggcggcgccgccggtgggcatctcgaacacctgctccttgggggacgtccacgtgatgacgtagaacttctgcacctgcgccttgcggagcagcccgcccgtgc

SEQ ID NO: 24420 - DNA, 495 bp, Zea mays
  unsure at all n locations
  Clone ID: cC-zmle189062b04d1
ggaatgggggggtcgacccacgcgttcggcgagtcgctagctcgatcctagcttgtgttccaagaagcgcagctcccatggccatggccacgcaagcctccggcgacacgcgccacctgctggccgccgcctagggcgccggaggagaagccgcggcagctgagctcgcagctcgcgctgccggcgtcgtcctcccgcgggccggccccgctccgcgcgtccaccgaggaggcggcggaggcgcctaaagggttcggggccccgcagctggaccccagcacgccgtccccgatcttcggcggcagcacgggcgggctgctccgcaaggcgcaggaggaggagttctacgtcatcacgtggacagcccccaaagagcaagagttcgagatagcccaccggaggcgccgncatcatgcgggatggccccaacctcttgaagctggcgcgcaaggagcagtgcctggcgtcggcaccaggntgcgctccaagtacaag

SEQ ID NO: 24421 - DNA, 54 bp, Zea mays
  Clone ID: cC-zmle189062b05a1
attacatgataaaaagttttggacattattgtaaaatcacaatggggggcaaac

SEQ ID NO: 24422 - DNA, 355 bp, Zea mays
  Clone ID: cC-zmle189062b05d1
gttagccctcctagagagtttaactatatgtccagactttttctcatagagaagctgagatcatgttctactttctgtaaaaaaaaaaaaaaaaaaaaaaaaaaaaaaaaaaagggaaaaaaaaaaaaaaagaaaaaaaaaaaacacaaaagaaaaaggaaaggaaaaaaacatcaaaagagaaaccaaaaaaaaaaaaaaaggaaaggagtataacaacgaaaaaactgagagaagggggggcgtctcccaaggaaaagggtaggaagcagaggccccgtaaggaagaaggctttaaggggaaaaggatggcacctctcgcgctccccaaggattagcccgccagaagggaaaa

SEQ ID NO: 24423 - DNA, 562 bp, Zea mays
  Clone ID: cC-zmle189062b06a1
gcgcagccagcaaaccaatcaggtagcatgtgaaacaaaatcctgtacatactggtacatcatgaaaacgaaacaatacaaggagaatgtctattatacactatgtacatctttatatgttatcattacatttacatacaacccggaagggggggtatggcatgcctatgctaaatcgtggtgggggtaaaatttgggcaaaagaaaaaaaaggtgtcgcgacaacgctgaaaagtggtgtaattcagtcctcaccgattgatcgtgaataactcatagctcatgcagtaccggttatcagtctctcctgccgatccaacttcttaaccttgacaagcccgatcagaacttgcagcccgaaaaatgcgcagagggagtatgcaatggttgctggtccccggattgaattgaagtacaacattgttgcaaggttcatcaaactacctgcagcaactccatatccaattgatttctgtacagcggcaactctttgaaatgctctatctgattcagcgttctgacacgaagcttgagttcaccttgctccatacgttcaataatt

SEQ ID NO: 24424 - DNA, 509 bp, Zea mays
  Clone ID: cC-zmle189062b06d1
tagttgagaaagatgcatagaagagatgggaaagagcagtcccgtgccttttacaatttggtccgccaacccgatagagttgaaaagctcgcacaaattattgaacgttaggagcaaggagaactcaagcttcgtgtcagaacgctggaatcagaaagagcatttcaaagagttgccgctgtacagaaaacaattggatatggagttgctgcaggtagtttgatgaaccttgcaacaatgttgtacttcaattcaatccggggaccagcaaccattgcatactccctctgcgcatttttcgggctgcaagttctgatcgggctcgtcaaggttaagaagttggatcggcaggagagactgataaccggtactgcatgagctatgagttattcacgatcaatcggtgaagactgaattacaccacttttcagcggtggcgcgacaccttttttttctttagcccataatttacccccaccacgatttagcataggcatgccatacccccc

SEQ ID NO: 24425 - DNA, 551 bp, Zea mays
  Clone ID: cC-zmle189062b07a1
ttttcaattcacatcccacgaagaaatggtgcccatgcaaccataatacatgattcaaaacaactggaaaaaacaagtccagcaatttcttgtaataacagttaatcagccaacagaggagatacaaaggagatgagagtagcggcgacagtcggtattcatcgtctcaacatgaagcccttaacaaattcgttcatcacaagagttttcggctgtcttttagccatagttcaggcggaacatgtcattctgcacgaagaaggacccagctgccggcagcaaatggaatgcctgagagaacttgatggggtgctcctcggggccggtgcggatggaaccggagacgaagacgagcatgcctccctggggccccgacggctggcagtcgacggtgacgatctggtgctcgcaggcctggagggaagaagatccgagcttgccggcaatggcggatgggccctggaacttctggccctcgaaggtgagcatggaggtctcctgatacagccccaccagcgccgcgcggttggtgtcgaacgtccggtagtagt

SEQ ID NO: 24426 - DNA, 404 bp, Zea mays
  Clone ID: cC-zmle189062b07d1
gggcaaaagccaaaaggcatcaccgccgcgacgacgatggcagcctcgctccaagccgaggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgagatgctcgccggcttcgcgctcgccacctcggcgctcctcgtctcgggcgcgagcgcggagggcacgcccaagaagctgacctacgacgagatccagagcaaaacgtacatggaggagaagggcacgggcacggcgaaccagagcccgaccatcgacggcggcgtggagtcagtcccgtt

SEQ ID NO: 24427 - DNA, 310 bp, Zea mays
  Clone ID: cC-zmle189062b08a1
gattgccatttcatcttttttttggaagaaatgcccaccaaaataccgccacgtgctgggaaacacatgcccgaaggggggccccattcatgggtacactaacaacgaggtctaaaggagcggccccccacaactacaggggaccaaccttcacaagacagggtcactcaagccaaaccggtgaaacggcgacaatcctggcctctcagccaaggcagagcccaccgggcttccccccgagcggggattaaggcacggagctccgcggcaacggcccgccggagacgtcgaccaagtgcgctgggcggaa

SEQ ID NO: 24428 - DNA, 155 bp, Zea mays
  Clone ID: cC-zmle189062b09a1
agggaccccgggggcgacccggaaataccgggccggaaccggggggggaaccaatttccccaaaaagggggcatataaaaactggggcaaacaagggaaaaaccggaacccgggggaaaaaaggcagcggggcaaaatgccaaaaaaaaatcaaa

SEQ ID NO: 24429 - DNA, 557 bp, Zea mays
  unsure at all n locations
  Clone ID: cC-zmle189062b10a1
ttttcatgttttgtatacaaaaactagagggcattttatgctgcttgcaagccattttgtacaaggattccgtgtctttgcttgtcccgctgtattgtcgacgcttctcccgtatatagtgtttttgggagtaatagaaacacacacacacaccaatcatatacaatatttgacaattgtacactagcagcatctttgtagtagcctcagaatcttggacgatgatagccaagctccactaagcttttcacaaggtggtaactgacaacctcgttattctgcctctctctgcgattttttgtgtgcctttgccttcgaatgtttgttgcttcccttggaggcctgatgatcccttaacatgccttccagctctngcagtgatctctgagaaagaggggcgcaggttaggattttcgtcccagcaacgctgaatcagtttagacagttgtggattgacccatgacgggatctccaaccgcattccctgccttactcccagtgcagcttgcagggtgtcagatttctgatggtatctttgagtgaccagctcccacaga

SEQ ID NO: 24430 - DNA, 191 bp, Zea mays
  Clone ID: cC-zmle189062b11a1
gggatgaccagggcaactccttgtttccaaccactccacaatggggaatcaccgctaggcccttttttcacttcaacaaaaaacgaggggggaaattgtaccggagcactgaaaaggatacttctcgggaagaaagagatcaaccctactgcttttcacaagagaagagaatgccattcccaaagggccct

SEQ ID NO: 24431 - DNA, 362 bp, Zea mays
  unsure at all n locations
  Clone ID: cC-zmle189062b12a1
catgaagactggagggcaagatacattctacaataggccaggctacgttgttgacctctagtttgaggtctgcccagacgaattacagggtcccaatagctaatcctagctcagaattacaaaaccggggctaattgtcacttgcacctctatacgatgaacaatttacatgaccattggccgctgtcgacattcttcgctaacaggcccttgtcatcactacctgcatgagctactgctacaagccttgccgaagacgccgncgccgggggggtacctagatgcgatagaatttggccgacggnccattaccgcattaggtccaacatatgtacgcatggcaccatccaagttccaacatc

SEQ ID NO: 24432 - DNA, 530 bp, Zea mays
  Clone ID: cC-zmle189062c01a1
ggggggggttttttttttttaatgggattattttaatcaatgagaaaaaacacacataaaaagggggaataaagaaccaccacaaccacacccccccagaggggggaaaaaaaaaaacggagaaaaaaaaccccaaaaaaaacaaaaaaaaccaggggaaaaaaaaaacccccgggggggcccccccaaaaaagggggaaaaaaaaaaaaaaaggggggggaaaaaagagggccgcaaaaaaaaaaaaaggccggggggaccccggggggaaaaccaaaacccggcgcctccccccccccccaaaaaaaaaagggaaaaagaccccccgcccccggggaaaaacgggggggggcccccccaaaaaaaaaaaaagaggggccagaagggggggaacccggagggggccccccccccccccccacaaggggggggggcctccacacccctccccaggggggggggggggggggccccccggggggggaagccccgggggggcccccccccccgggggggggaaccccccccc

SEQ ID NO: 24433 - DNA, 523 bp, Zea mays
  unsure at all n locations
  Clone ID: cC-zmle189062c01d1
gacccacgcgtccgcccacgcgtccgcccgtcacgcccccaacacccccacaacccgatgcagcgaaagctcccctaaccctctccgcgcatccgatcgcaaggaagaagagggagatgagctactacgggcagcagccccccgtcggcgtcccgccgcagcaaggctacccgggcaaggacggctacccgccagcggggtacccgccggccggctaccccccgccggcgcaaggctaccctccgcagggctacccgccgcagtacgcgcagccgccgcctccacagcagcagcagagcagcgggccttccttcatggagggatgcttggctgccctctgctgctgctgcctcctggacgcctgcttctgagagagagaggggccgaccgacggattcgacacggcgacaagagaaactactagctttctatgcgagggagagagagagagagctggaactggattgagcctggaatgctatcgagctattctagctntgtcagagcataatatgtcgcccta

SEQ ID NO: 24434 - DNA, 429 bp, Zea mays
  Clone ID: cC-zmle189062c02a1
ttttaggtgctagtatcgtgagttcatcaggttgcgctcaactacaaaacggttgtgcgtgtgtgtgtgtgtgtgcgtgtatgtcccttctgctgcgcagctcccggcccggagtagacaggtatcgaggccggagcgtgcgcagtacatgtcgcggcgcagcgcttagtaggcgctgaagccgccgtcgggccgcagctgcgtgccggtgatgtacgacgccttgtcggacagcagcaggatggccgggtcggcctgctcgtgcggctggctgaagcggcccatgggcaccgaggcggcctgccactcgcgaatcttggggtccatgccgctcgtctgctccgtctcgcagaagcccggctcgagggcgttgacgcggatgccgtgcttgacccactcggtggcaagacccttgaccatgttcgtcac

SEQ ID NO: 24435 - DNA, 445 bp, Zea mays
  unsure at all n locations
  Clone ID: cC-zmle189062c02d1
cacgcgtgcagaccaccccaacaacccacacaccgcaaccatgttctttaccatcgatctctccggcaagacgagagtcgtctcgggcggcaaccgcggcatcggactggccatgtccgaagcctgcgccaacgccggcgccaacgaggccattctcttccactcgcaccccaaggcgcacgaagcggccgagaacgtggccaagcagttcaacgtcaagtgcaaggcgtaccagagcgacgtcagcgacgccaagctcgtcaaggacacggaggcgcagatcgagggcgacctcggcacgcccatccacgggctctgcgcctacgccggagtctcggncgtcaagcctgctctggagctcaccaccgaagacttccacaaaggcttcaacgcatacgtnctcggcgccttcaacacgtgccaagccctcgcgcagcactgggtc

SEQ ID NO: 24436 - DNA, 481 bp, Zea mays
  Clone ID: cC-zmle189062c03a1
ttttacagataagccggcatctagttcattataacaaaggggaattcctcctcgattagtcatacagggttccaaaagattacaagcgtcaagcgagcaggtgagggaagataccgttaaaaaaaaagcaggtagaacgctcctacgcccaggaggaataacccgtagtagtcagttcatattaaacaaattagtacaaacagaagaaccaaaatcttcatctaggctcccccttcacgcagggaaccaaggaaaaaagggttctccatgccgaacattagggcaggccgttgactcatgtctttgggttcttggccaccaaggtgacaagctacacaacagagactgcacgtgttagtgtgacttccattgctggcggtggctcatgccatgagaactcaaagggggcctccatggtaagaagctgaatggctgatgcagtctcttttggggacgactgagcgtactggaactcaatctg

SEQ ID NO: 24437 - DNA, 420 bp, Zea mays
  unsure at all n locations
  Clone ID: cC-zmle189062c03d1
tccgagataactgttcttatgccaagattcgccctttgactgtttcctttatcttatcttttataggattcttcctgcccgaaagcgttgatgacttgtgaggnttagacttccttaaaggagccatgtcatttgacaacatctgggatgagattgcccaggcggcagagttctcatcttgagatagccctaacttatacattgtaagttggaatgaccacttttttctactcaaggttgagcatgaagcatattacattatcgataccctaggataaaggctccatgaagggtgcagccaggcatacattttgaagttcgacaagaatactacaattcacaaagtacctggggaaaagaaaccttgtagccctgactcaagaggaccaatgaaggattcttcaagctctgaatgctcta

SEQ ID NO: 24438 - DNA, 373 bp, Zea mays
  Clone ID: cC-zmle189062c04a1
ccaggaattcccggacccgcgggtggacccggcaatttcggatatggtccggtcggaaaaacaccggtgccaataaggggctcgctgaaagctggggcgaaacaggggcccagccgagagccgggggaaaacggaaccggctgacaaaaacgcaaacactggggggcccaatgacagaacgaagccgcagggggggctaagcggtgagcttcctccgaagaatcggggaacctttactggcccctttcgaagcgggaaagccagggcgccgggagacacgatgaagaacttgacccccagggagaagcgcgcttccttgagggcgaccgggaggggcttgttgtcccccatggaaagggccacagagaggtgg

SEQ ID NO: 24439 - DNA, 263 bp, Zea mays
  Clone ID: cC-zmle189062c04d1
cgtgtccctacgcaggttttgggaattccctggcatcccccttttaacttccgttggataacattcccgttcttgccaggtggggtctttgctaaaaggccggaacctatatgccttctgaaaatcggcccaacctgaatgtctaatgggacccgctctggaggggaccttctaccgcggcggttgtgttggcttcccccaaggggaccgatacatttgccagttccctttgggtcctgtcctttgggttaggttcctccctt

SEQ ID NO: 24440 - DNA, 562 bp, Zea mays
  unsure at all n locations
  Clone ID: cC-zmle189062c05a1
ccggtaagcgcatcctcctgtcgcgccccgcctcctcctcctccctctccttcgcctcccgccgcctggccgccggggcacccctccgggggttccttggcgcgccaatccgggccgtggcgtcgtcggcgtcggcggcccccgcggcggcggccaagaccatcgcggtcggggaccggctccctgacgcgacgctctcctacttcgacacgtcctcccccgacggcgagctgaagacggtgacggtccgcgacctcaccgcggggaagaaggtggtgctcttcgccgtgcccggcgcgttcacgcccacctgcacccagaagcacctcccggngttcgtggccaaggccggggagctccgcgccaagggcgtcgataccgtggcctgcgtctccgtcaacgacgccttcgtgatgcgcgcgtggaaggagagtctggggatcggggacgaggtgctgctcctgtcggacggcaacggcgagctggcgcgcgccatgggcgtcgagctcgacctctccgacaagcccgtggggctcggcgtncggtcccgccgctacgcgct

SEQ ID NO: 24441 - DNA, 395 bp, Zea mays
  Clone ID: cC-zmle189062c05d1
ttttgacaagtcatgaaacagagggcgtcaacaattgcatgaagctagacctacaaagccatgttcgcaagaaacttgcatctcagcagtgcactagtgacagcgccggtcacaacagtggcggcagtaacacaagccaccgttgccgtcacgattattttcagggaaaagaaaccaactcttgccggaagagacgaaccaaccatggcgtcgcgagttcagagcgcgttgagcatgtcctcggcgctgctgtaggagaacgcgccgccctcctcgaggttgagcaccttgaccacgccgtcctccgcgagcagcgcgtagcggcgggaccggacgccgagccccacgggcttgtcagagatgtcgagctcgacgcccatggcgcgcgccagctc

SEQ ID NO: 24442 - DNA, 461 bp, Zea mays
  Clone ID: cC-zmle189062c06a1
gaaaaaaaatatagtaaaagcatttagccttagcgagcaggtttacacaagctgttgaactgctgctgcagctttgtaaccttacagagttagagtggtcatcagaagcgatgctcacttgtcctctctccgtattaccgtctcccatgtcctctaatcatatcaacaagagccaggcgctgtaaaaaaaaagtagtagtaggaattggaaccctacacgactcgaaatgattgggctatctgtttgaggtctttgtaatgcctcttccactgcaaaccgtttgcagttacactgaagaggtagagcctgttcccagctgccgtggcggtgatgaacacatggggcggttccagctcgaactggtagtaagttcttcccgaatgcgccgccgtttccgaggacaggacctttcctttcacgttctttccgatgacctccggaccgaaggcggtgatcacct

SEQ ID NO: 24443 - DNA, 385 bp, Zea mays
  Clone ID: cC-zmle189062c08a1
ggggaaaaaaggagggagaaaagaaaaacacaaaaaaagccggggaaaaaacaaaggggaaaaaaacgggaaaaaaaaagggggggaaagcccccacgcccaaccccccaggaaaaaaaaaaagcccaaaaaacaagcaaaagaaaacccaaaagacccccccaaaaaaaggcgccaacaaaaggggaaaaaaaaacgaaaagcaaaaacccgcccccggaacgggccccccggggggaaaaacccgagggcccaaaaaacgccccaaaaaccacaaaaaggccccccaaaaaaccccggggggaaaacccccccagaaaggggcccctaaaaaaaaaaaccccaccaaaaaaaggccccccaacggggggacccacaaaggccc

SEQ ID NO: 24444 - DNA, 439 bp, Zea mays
  Clone ID: cC-zmle189062c09a1
acaatgaaaatattttaccatgagattcacgatggaatcacacaaatcatccacaaggattgaattggttataatgcaaatgggactaaaccttttagggcagcagacgaagtgctttcatggtaataagttaataaccgaccattgaccacataagtcttacgcgagacattcgcaagcaaagtgactcccaaaatacttacaaccattaggacaacataaagtagacatagtagtagacaccacgaaacttaggcatcaatagatccagcaccttcttactcgaaggcccactggttctccctgcggatctccttttcctcctcaggggtgaagtcattcttgatgttgaaggtcttgcgaatctcttctggtgtcttgcccttgatcatgtcagcaacagtctgacaggtcaggtcgagtcggacgcgtgggcgga

SEQ ID NO: 24445 - DNA, 560 bp, Zea mays
  unsure at all n locations
  Clone ID: cC-zmle189062c10a1
ttttctaaattcttttttttttctttcaattttcatcaagcacatcatactctgcacttctccctccgcgacatacaacgccggagaagaacagaaaaacacaatcgcaaggagggggaaaaagaacttgactttgaacgcggcatagcagttttccaagaacctaggggctccatgcattggagaacaggtctacgcgtacacagaatgcaatgcaatataatggtccgactcattattcaccggtcaaggggctccgtctggtccatgatgacctggccctcggacacctccgcgagtgaccggaggttgcacttgagcagcgcctccacgaagtagcaggtctcgtccttggtgttgccgtcggngacgtcgacgacgaaggactcgatgactnagcgtccctggccggccgtcgatgacctccgggtggacggtgaggatggagngagtagttctgcagcctggtgatcgcctncaacgaacctgacgctgagaatgcgctcgtcgtcgtctaacagctcgagcctctccgtgcttttgtggccggcagcccggac

SEQ ID NO: 24446 - DNA, 417 bp, Zea mays
  unsure at all n locations
  Clone ID: cC-zmle189062c12a1
agtacaaatcacaacttggttaactcgattggaactattatcggtccagattgcactttgtacacctagattgtaaccaaaatcgagcgggcttgtcatatgtaccccatcttaaggtaggggtacaattcagtagcaattgtagctccctgatcctgggcatcttggaatatccttatcttgattgcaaacttgttggtatccctgaatcattcccagatgatctgaggaggctctttcataactcaatccatttccttctctgaaactcccagntacaactggaaacatgactgctgctctgggagattgctagncgatgccaatgagcctatgcttggcccagctatatacccaccggnccatgcattctgaaaattgaatccgcctgtgaccccatcaacattaagaacctct

SEQ ID NO: 24447 - DNA, 393 bp, Zea mays
  Clone ID: cC-zmle189062d01a1
ttttttttttttttttttttttttttttttttttttttttttttttttttttttttttttttttttttttttttttttttttttttttttttttttttttttttaaaaaaaaaaagcaggccccaaattttcaaaaaaaggggaaaacggggggaaacccgggggggaatttaaaaacccccccccaaaccacgaggggggggaattaaaagtttagttttttaaaaaaggggaaaaaaaccggaaaaaagggccaaacccaacccccccggggggggtttttttttttttttgaaactttttttttttcccccccccctcccaaaaaagggggccccggggaggggacccttggcccccccaaaaaggggggggggccccccccttggcccg

SEQ ID NO: 24448 - DNA, 414 bp, Zea mays
  Clone ID: cC-zmle189062d01d1
cccacgcgtccgagccgctcccactactagattcaggagagctcttcattagagccccggcccttggtgcggagcggccaacggccatggcgaagcttgccgcgcagctcatgagcaagttctttggcctcgtcggccgcatcaccagctgaggccgcgccggcgccacccacaaagatgccgctggagcgacagaagccaagtcatcagtgggatcccagcctgtagagatcaggtcaaggggaggagctcctcccgttgatggaggggccaagggtcacatcaacagagacaccatctagatgagagggagatgtgaagtgttgagatcgaagagaagagaagaagctcaccgatggagcttggacttggacattatctgcagcttagttaccatgtttgaaagaactgaag

SEQ ID NO: 24449 - DNA, 529 bp, Zea mays
  unsure at all n locations
  Clone ID: cC-zmle189062d02a1
ggtccgggaggaaagagtaacagaagttgattgaatatgtacagagaattttctcaactcatccctttacttagcacaaccgaacacttacgactttgtactggaagaacacatcgtactcaagacaccgacatgaacaagcccagtgctggtgtggtcatctggaaaaagtccatatctaaccctccagcagagtcaagctgatacgccaccctctggcccgccgcacacggcacactgacgatactgtatcggttggcaggttggacagatggcacggaaccgacaattgtcgaattgacgacatcgttcgcgctgatccccgccgaagctgcttgctgaccaacacttgacacagtaattcccgctggcgatcgaagtttgactggcgacatgtcaggccaaggagaaactggcggcatatgaaactccaaattgcaggtcttgccctcatcttcgggacggatatcgaagacgaagatagacgacagtgttggtgaaactgagcaatgtaaccatttncaatgac

SEQ ID NO: 24450 - DNA, 522 bp, Zea mays
  unsure at all n locations
  Clone ID: cC-zmle189062d02d1
acaatgctgtcatcgatgcttaggactggatcggcatggacgcgttcccctacttccaaagctctttcgcgaacagcgtaggtaacggcggagaccttttcttcgacgcctacaacatgacaaaggctgctaccaaaggtaagcctgtctgggtcacagagaccggatggcccgtttgaggcgagaccgtcaaccaggccgttcccagcgccgacaatgctcgcgtttactgggaggatgtcgcgtgcaagctggtcaacgacaacgtcaacctttactactacatcctccaggacgttcagaggggtaaccccagcccgtctttcggtatcatgcctggaggcgatctcgcccaggtctctcccctgttcgacctgtcgagccccggagcggncaaaaactaaacaacccctcctcgacaaccgaaccgatcgacgtcactgctcctggatttccatctgacaattcaccatcgnncaaactagcaccagcccctgggtcccacccggcaattgcaccact

SEQ ID NO: 24451 - DNA, 527 bp, Zea mays
  unsure at all n locations
  Clone ID: cC-zmle189062d03a1
aatatcaaagtacaatacggaaccgatgtatatatatttaactcgcataaggtttctacaagcaagctaataacacacttatctgcacctcaacctgaatgacatccatgagatcaaatatacagagggctacacaaatgatgatgatgatgatgagttcttcgtttccaccaggttcttttggacactatattttattcaaaataagaagagaggaaagaaaaaaaaagaccaatttggaacagggatccaacacttcactcccccaaactaatccggcacccttctgtctcaccaacacaagaaccatccaataaaaaccttatgttgaacctatccttgnatggtgcatgcttgttttgatcccaatgcaaatgcacagttgcctaatagcaacatcttcactctttgccgcggattcatgtaacatgcggtagcaacgataatgataagtaacagacggataacgaggcctctagaatttgaggcatacctgaattcaccaatcctcggtctgcttaatgttt

SEQ ID NO: 24452 - DNA, 371 bp, Zea mays
  unsure at all n locations
  Clone ID: cC-zmle189062d03d1
ggaatttttggggcgaccgacacgtaggatcgcctaaagcagccgagccaattcctcagatggcagtatggcctgaattgcaacaacctggagtctaccgaacaacagctgcggctacccctgctccagcgcctaatgcagcacctggatatgctgggatggcctaccaccatgtcatncaatcccaccaccaccaccaccctgcgccgcagcctgtagcaaacatggctggcaactacgggtatgagtttgctgatcctacgcgcccgcaagtctactactcacaggcagctgcacctccaacattgccacaggatccgcccattggctctccggatgctggccaggctgaaaaacattaagcagaccga

SEQ ID NO: 24453 - DNA, 464 bp, Zea mays
  Clone ID: cC-zmle189062d04a1
cacctgaaacttcataacatttcggaaaaaagagccacttgatctttacaacgcaaatttatatatattaccacgggtacaacgggcatttccgttaaagcatacacgggacagaggaaacatagtaggggaatctccaagcccaaagctacgtttagctcgtagatcagagaaaaaaagggtagctatggcaataaacccaggaactgaacacaatatatggggggtgctgaaaagctccagacttaaatccccatgtaaagcatttgacggggcctgactttatgggtagtacctacgccggttttcgatcacaggatcgaaatggatcgggcatcggttgatatttagggtcaccgaagcatttcggggacaggtgtgttgctgtcaagatcagctgcaaaactacactgggaagacctcacctgttacttgacagtgcggagcatccatggtggcaggtt

SEQ ID NO: 24454 - DNA, 453 bp, Zea mays
  unsure at all n locations
  Clone ID: cC-zmle189062d04d1
gatagccaaaatatatttttttcatcatgcgatcaaactcttctgtatcaagtaggagtattatttcagcataatttattgcaaaggaaacacttcttttgtcttttgcatgcatgaagaaggatatgcttatcagtatctctatggaggagttaggttcattgcatggagaggttaacgtaacctgaacggatcccacgactattggttacagtgcaacagagatacgtttggttagttaacgtcgaaaagatatggctccgtatccatttgagaatcgntacggactgacccaaccaaactgaaaagaaagggaatagatggatcacagataaaaatgtcataccaaacagcctctatactattttctgcttcgatgttccttgtatatgtgcatcttggcgatttttcagatagcctgagataaatgagcacaaatttctatacaaacag

SEQ ID NO: 24455 - DNA, 467 bp, Zea mays
  unsure at all n locations
  Clone ID: cC-zmle189062d05a1
gcgacatcgaaccacttcttttatacaaaagcacgcagcacggagctaaatggaacacaacgtcatcgtcatgggccgtaaccatcgtcccatcacgcatctagtacaacgccgttaccataccataccaccatctttagctggcccccggattcacgcttccttattttcagttcagttcggaagggggtccaaatccagagtcaccaccggcaaagacgagctcgcgcgcgcgcacacacacactactggccctctgccagcggctcggccttcggcgccgacgaaaacaccttggcgatgcgttcggtggggatggcggnngaggtacttggcccccgcgtagccgtgctccgctgcggctgcgaccaccctgttgtacttgtcggcccagtgcgcggccggtgggcaccaccgatctccgcgacgtgcgggaacaccggcaggcccgtcagcgagcgccaggc

SEQ ID NO: 24456 - DNA, 372 bp, Zea mays
  Clone ID: cC-zmle189062d05d1
ggaattgcagggtagacccacgcgtccgctggcggccgatgcgcagcggtcgggcgtgaggggcgcagcccgttcagcgctcgcgatgacggagccggtggcgcgggacgtgtacggccgcgaggagcccgaggccaaagacctctacgtgcggtacgagcccgcggcggaacacctggccgtctccgcctggcgctcgctgaacggcctgccggagttcccgcacgtcgcggagatcgtcgagcccaccgccgagcactgggccgacaagtacaacagggtggtcgcagccgcagaggagcacggctacgcgggggccaagtaccttcccgccatccccaccgaacgcatcgccaaggagttttcgtcggc

SEQ ID NO: 24457 - DNA, 416 bp, Zea mays
  Clone ID: cC-zmle189062d06a1
acaataaacgatggcaaaatctttagcattaactagcaatagccacataggtttataacaccagaacaaaaagaaccagagaggccgacccagtgcacgaggctttcaagacgatactcaagaagggacaaaccgcccctaaaaatggggagtctggttcgaatgcctgagacaaatatcaccaatggaccatgcctgcccttttagaacaaaagaactagacagttgtcaaaaagattcagataggtatttatgccagctcgcttgaactggtcaagatacataattctttttagtaaccccccttgagatcatttaccacatcatagggaataggagtaacggtctcaagtgtagcacccttaaccatgaagccaggtttgggtcccacaggctggctcttggggctgatcacc

SEQ ID NO: 24458 - DNA, 379 bp, Zea mays
  Clone ID: cC-zmle189062d06d1
gcacactcccgcagtagcagcagccgccgccgccgccgccctgccgcatgattctggaggaagatgccggcggggcacgggcttcggtcacggacccgcgacctgttcgcgcggccgttccgcatgtagggttacatcccgctcaccacgtacctgcgcacctacaagatcggcgactacgtcgacgtcaaggagaacggcgccgtgcacaagggcatgccgcacaagttctaccacggccgcaccggtcgcgtctggaacgtcaccaagcgcgccatcggcgttgagatcaacaagctggttaatggccgcatcatcaggaagcgtatccatgtccgagtggagcatgtgcagccctcccgttgcacagaggagttcc

SEQ ID NO: 24459 - DNA, 458 bp, Zea mays
  Clone ID: cC-zmle189062d07a1
aaaagctaatctcaggtcccatattagcgagcggttctgtcacagatggtagcaggaagggaagcaaaagtgcaaaacatgtccagactcagcatgaacctggcgacccagaggcacgcgccatccacatttattctcggcatacacaagcagcaaccatccatgagaagcagggggaaaaaacccctctactgggtcttgaacatgtggcggatcaggtcgacgacgcggttgctgtagccccactcgttgtcgtaccacgagacgagcttgacgaagtggtcgttcagagcgatcccggccttggcgtcgaagatgctcgacctgctgtcaccaaggaagtcggtagaaaccagatccttctccgcataacccatgatacccttgagtggaccctcggaagcagccttaatagctttcttgatatcctcataggaggcccccttctcgattctgac

SEQ ID NO: 24460 - DNA, 525 bp, Zea mays
  unsure at all n locations
  Clone ID: cC-zmle189062d07d1
cccacgcgtccgaaggcaagctcactggtatgtccttccgtgttcctactgaggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatcttcgacgccaaggccgggatcgctctgaacgaccacttcgtcaagctcgtctcgaggtacgacaacgagaggggctacagcaaccgcgtcgtcgacctgatccgccacatgttcaagacccagtagaggggttttttccccctgcttctcatgagatgggagctgcttgagtatgccgagaataaatgaggatggcgcgtgcctctgggtcgccaggntcatgctgaggctggacatgttttgcacttttagcttccttcctgctaccatctgagacagatccgctcgcttatatgggacctga

SEQ ID NO: 24461 - DNA, 551 bp, Zea mays
  Clone ID: cC-zmle189062d08a1
acagattatgtgcacatagcactatcaatataatccatgtactggttgtcagtcaaaggtacagaaatttcattcacagaaaaatcatagagctcgggttcaacaaatccgatggtcgatctgtgcggtggtataaataaaaaaaataataataatatcaagaactctatacgattggaggaagggggtcgttttctcctgtagttccaaacagaaagaggatctcggagtacgagttagtacagaatccccaactcgaatcgagttccagaaaccctgatgaaccgagttcattttttaaaaaaaaacagtaaaataatgaaagggattttatccctgagagctcggcagaaatcactacaactgatcagatcaggtataagaaaactaagaacagtttaggggttctgtgaaccctaagcacacgaacagaaaacggaacagatttcgaaaaaaaaagagagaaaaaagaggtcagccaagagaaactagcggccagctgctagaacaaaaaaaaacacagaaagtgagaaagagtaactagccagatg

SEQ ID NO: 24462 - DNA, 512 bp, Zea mays
  Clone ID: cC-zmle189062d09a1
tttttcgaactaaaaatgtgagaaatcttctcctttcggcattaggtatgtgttataataatttcgatgctttactcccaaaatttatacggtaatacaacataatagcaagcatatagatatataggctatggtcgataatacatgtttttgttacttgagcatcttcttgtagtccttgaaagtgcccgagaacggggtcaccctgccttccgacaccacccaaagctcgtccacgcttccagtgataagatgctcatcgtgactcaccatcagcacccctccctgaaaaatgagtaaaccctggatgagcgcctaacagcgtccagatcaagatggttagaaggctcgtcaaggagaatgatgtgcggcttttgaaggttattttcgcgaatgcaaccctactcttctgaccacctgataaagtgtacatagattggagggcaaggcttcccgaaacaccaaacgaaccagatgtgccctaacttctgctccgcacacccgatagcact

SEQ ID NO: 24463 - DNA, 491 bp, Zea mays
  Clone ID: cC-zmle189062d10a1
agcaaatattcaggctcattatacttgaaaacaatagaattacattaaaaaaggccgaaaccgtgaggctggattaacaagagaaacggtaatggtacagtaattcatgaagtgaaggattttacatcaccaccagctggtgctgaaccttcccgttggatccagctaactgcccttggcaggagcatttacaaccaatacccaaagtgggttatcttacttatctagagccctggtatcgcaagcccaatatgcctcagggtcagggcaggaccaagaaatgtggtgaagttcacattcccaaggcaaccctacgtctcaatgccacctcgaagtatcatctagtaaaagcaaagttcaacagaaatgctgtgccagcaagttgtcttggaaccgacgtggtaaaatgagcatcgtttgatcactttgtttttcttctcgatgcaatctccgctgcccatgcttttcccaagtctgtctgaaatttgcct

SEQ ID NO: 24464 - DNA, 380 bp, Zea mays
  Clone ID: cC-zmle189062d11a1
caaacgcgaactttgttacggagtacacattgttacaaaaatttaaaaatatcatgcacattccaggtatccaagaacccatagaatcgagtaaataatacaatcaatatatatataaccaaactacatacttcatacaggggacggctgactccacaatgttaccggatttattggcaaacacaaaaactgcgagctatagcagagcaaccacccatagatatgtcatcaaacgaaggtatttccagaggagaattaaggctaggagacgtctagaagcacttcctgaggacaatagctggaccagactcctcatactcagcccttgagatccacatctgctgaaatgagctcagggatgcaaggattgatcctccgat

SEQ ID NO: 24465 - DNA, 407 bp, Zea mays
  Clone ID: cC-zmle189062d12a1
agcaccgaaagtaggctcttgtctccattccatgttagagttgatgctcacacatacagaatggccatacacacatcggacaggctctatttcaaggcgagaacaaacacaacagaaatctaggggagggcactacagctacaggttgccgggacatggtccaggaatgggatcactgcaacccacttcagtaagcttcatgatccttcttgggcgtgacgaaagcgaggaacttgttctagggcttggccttgtccttggacgacagggacgccgccggggacgacgacgacaacttgacggagccggcggaggagaagccgagcttccagagctgctcgcgcacgaacttgtcagaaaagaaagcggcgcccctgaagttggggagcacgagccacgcgatgaac

SEQ ID NO: 24466 - DNA, 344 bp, Zea mays
  Clone ID: cC-zmle189062e01a1
ggggccccaaagccaacccaattccccctactttggccccaaaaaaaattttttttttacaaaaaaaaaaattggttttgcaggggggggcaaaaaaaaaaacccccccccccccaaaaaaaaaccacgggttttggaacaggaccggaaacaacatcccggggcccccttttttgggtggtttaataaaccccgggggggaaccacaaagctataccttcctttaaaaacaactaggcccggttaaaaaaaaaggcccctgcccaaagggtaaagaaaaacccccaacaacatgggaaaaaaggggggaaaaaccccccgaaatgtaaaggcccgtcccgggg

SEQ ID NO: 24467 - DNA, 98 bp, Zea mays
  unsure at all n locations
  Clone ID: cC-zmle189062e01d1
acccatcgcgtccgcccacgcgtccgaggacagcgagggcgagacgcgtgtgattgttctttttcttttatggatatgnagttgagaggaggcctttg

SEQ ID NO: 24468 - DNA, 482 bp, Zea mays
  Clone ID: cC-zmle189062e02a1
ttttgtcccatatttttctattatatttctttttttttttactgggaatcgaaatcttagattgatctaaagattattttgatttctttactatatttagtacaattgttatattacacatcgttttttttatagaataactacgtcctcgagctcgaggtctgaattttttcataatagtactcctactgacttcggctttagtgatgaataaattcgttttgtcgaaatccctataatgagtagcatttgctgctgccgaataaaccaactttaagatgggatacgatgctcgataaggcatgagattcagtatcataacggtttcctcgtagtaacgccagcgaatctcatctagaactctttgtgctttgaaaacagacatatgtatgcgtttttgtgctttgaaaacccgttcgaatttaagtagacgatcggttggaacttttctgcgagttttctcagccccttcttcttcttat

SEQ ID NO: 24469 - DNA, 485 bp, Zea mays
  unsure at all n locations
  Clone ID: cC-zmle189062e02d1
ataagaagccactctttaaaaagaaaaaaaggagtaatcagctgttacacgaaaaaaaacgaatccttttgtagctcgtcatttattggcaaaaatcgaaaaggtcaatatgaaggaggagaaagaaataatagtaacgtggtcccgggcatctagcattctacccgcaatggtaggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagnttcaaatcggnaaagtatacccctatgataaagaagaagaaagggctgagaaaactcgc

SEQ ID NO: 24470 - DNA, 503 bp, Zea mays
  unsure at all n locations
  Clone ID: cC-zmle189062e03a1
gaagaacatgcaattttttactctctattattatttagcaactctctacatcgtcttttagggagttttattttacaaaactactggagatgctcttaggaaggcaaacgggaaggtaaaaggagcctttttcacggacgaaacacttcaatggtccaaaaagtacggcagctgcatgtgcgtggtttaatttgaagaaagagaaacaccggatacaatttcctcgcaaacgtagacacctacgatacagagaacaaacagcagcctccatgcacaagactgatgcaagaggcttcatagttgctgcttcccacagggttttctatgtcaagtcggctggttcctccctttctgcattcctcgcccaccttctgacacccatctcatggttccgccaccaccttggacgccgatgtgtctggttcctcacgcttatccactggaggtaacttatcttggagacgcattatcgncgatattagcactctatcaccaactacatg

SEQ ID NO: 24471 - DNA, 445 bp, Zea mays
  Clone ID: cC-zmle189062e03d1
ccacgcgtccgaggacgcgtggagtcagaattcgtctgatctatcactggtgttgttctctagttcacctgattgtatttcacaggtaagaagctttacatggggtattaacaagatagtactgtaacactagagacaactgttgctaacttgatatacagaagagttccactgttggtgcagcaagagagcagtaattcagattctgagatttgactcaataattgacatgattgcattattgagattataacttggagctgattatattcgttatctatgatagaaacctccaaatatgataagtttccctgagaaaccatgctattttagccacgctggagtaggttaaagcaccagttaacaacttccttttatgcataaaacaggagatgaacctggatgcacctccagcattgggaggtggatgtgcagcccccatgct

SEQ ID NO: 24472 - DNA, 412 bp, Zea mays
  Clone ID: cC-zmle189062e04a1
ggaaccgcaaggtcaattatgggacttggctcgctagaacactggcctacaaacaagggctccatgcgcccaaaatccaatttccatggaactcctttacttaacaccccgggcacaacttatccccatggccaaaacatatagagcgcccaccggaaaggcttcacatttagcctagcccctttgtcaattgggccaaaggcgatgcacctgacttctgggagaaagatgccttccaaaagggccaaacccaaaaaaaaaaggggcgcccttgttgctgtaaacccccaacatatgaaacactggtttccctggctgcatacaaagctggacccctgggacgaccccggaattaccgaccggtgcctgaaggctgaccaaattctcctatacggaaaccgattaaagcctg

SEQ ID NO: 24473 - DNA, 364 bp, Zea mays
  Clone ID: cC-zmle189062e04d1
gacccaagcgtccgactctgtataccggccgggctagaagagtttcattatttttgttgttagagaaacactggaacaccttggtggttagagtttcgccctgtcttgctgtatctaccacccatgagagcagctgcctcgcctttgtacaaattcacagaagagctagccagatcaagatgccataccgagggcacatgtatatgtgccgcccatttggataaaccgtgcacatggcgtttgagaaaggagatccatggtcattgaaggtcacgcatatggaacacctgtatgagctccagtcttctgaacagccaagctccatagaggacctcgcggcccccaagaacataaaatttgggca

SEQ ID NO: 24474 - DNA, 551 bp, Zea mays
  Clone ID: cC-zmle189062e07a1
tttttaaccgataaatatttagatccacgtaataaataaaagagaaactacaaaaaatcgccgtatacagttcttgcaggttacaaccacgtatattatcggttcaaaaacagaacctctgtaatctatgtacacgctgtcagcgtgcgctgtagagtcctcctgtcccgagctgtctatcaacagaagcgcctaacaaaaatttttacacggcacgaagccgtcacaggacgaggccgcagtttgagttgacctgcaagcttcatccgcagcccctcagaatctcggcgagccccttccgctgctcgtccgtgaggtcctcggggaacacgacgtcgaacttgaccacgaggtccccgcgcgcgcccttggccccgccggcgacgggcatgccgccgcccctgacgaccttgacgtacccggggcagatgacctcgtcccggaacgcgcaccggaacctgtcgccgtcgagcagcctgaacgagagctgccaccccgtgagcgcgccgaccagcggcacccgggccctgagcaccaggtcgtcgccgagc

SEQ ID NO: 24475 - DNA, 378 bp, Zea mays
  unsure at all n locations
  Clone ID: cC-zmle189062e07d1
ctcgttcgctcgctctcactctctgctgttcgtccatccatccggatccgtcttcctcggtctcccacgagcagcgaggaggctacagctgggaccggccaaaggggaacaaaccgccggagctgtactacgacatcctccacgttgccagggacgcctccccgcagcgggtcaaggcggcgtactggagcctggtccgccaaaggcaccccgacaagcaccctccggagtccaggccagcggcggaagcccggttcaaggccatcaccgaggcttacgaggcgctgctgggccagcaggggaacatgtcggcggcgcccgcagncgcagcgcgcgacggcgaaaggagtagccccgccgacaaggaccgcgccgact

SEQ ID NO: 24476 - DNA, 414 bp, Zea mays
  Clone ID: cC-zmle189062e08a1
aaaattaaactactttaatttccttttttacatcactggggccgacactaactaatttttgaaaaaaaacagcaccaataaagaaaaaagaaccaaaaaaaacgacaagcgcaaaaacgccaaaaaggacaaaaaaccccgccccacggggggagacacaacaaaaaaaaggagggcccaaaaaaacaggcccaacacacccaaaaaggggggaaacgggaacaaaaaaccccgtttaccccggggagggaccccaaaaaaccccaagggaaaaaaaacaaaaaaggaaaaaaaaccccaaacccaacaggggggtaacccccaaaaaacggaaccgaaacccggagggcaaacagaatcccctaaaggggggtacaaaagaaacgggggcaaaaaaagggaaaaagaggaccc

SEQ ID NO: 24477 - DNA, 354 bp, Zea mays
  Clone ID: cC-zmle189062e09a1
ggaaacgggaaagggaacctctaatttggggggggccccataccttatccaaaaaacttttttatggaattccccctaataagccatctaaaagggggcccccccaaggaggggggggggggagggggccgcggggtttgccaaagcaggggggccaaagggcaacaatggggggagtggaaaaaggggggcggggttacccccaaaccgggggaaaaaaggccccaacgggggctgggtcaaaaaggaaccccggtttgctgcaactagcgggctaaaggggaaaagaatttgcgggggcaaaaaacccgcggggttcaaggcggccaattggttaaagggaaaaagttgttg

SEQ ID NO: 24478 - DNA, 388 bp, Zea mays
  Clone ID: cC-zmle189062e10a1
cgtgtacattaatccattgcacttatctgtgtacattgaatcaaccaccaaacaatttcaacgttaaacaggatggaacacaaatgaataccggatatacaacggaagctcacattaacttacactcagcaaagcgaaccgtgcaaaggctaaaacacaggcgggaaacggacatacggaacagcaagggggcacataccagcggtccgaagtcaaagccgattgagagcctccccaaacgaacgagaacgtagccagcaatcatcatgaaatacacatagagaataaacctaaccagacaagctcaggacaatcccaatccagaccctagatcagaaggagataacacacgtgatccatatgggacaggaagcaagcccgagcaacc

SEQ ID NO: 24479 - DNA, 404 bp, Zea mays
  unsure at all n locations
  Clone ID: cC-zmle189062e11a1
ttttggcaactcagaatattatttcttttaactgaacttagtacaaaatctaaacatgagggttaaaaagacacccataacacagaagctagaataaactagtcttcagcaagtcttcgtcgctgaagagacatagtatggcacaagtactggaaacattaggcagagaacaagcatactgaaaccttgattctcagctaaatttggcattaatctggggttacaaagaagatgtagcatggtgcagagatagcttaagtcaaaagtagatcattagctccgtagagaagggggtcgcagagagaccctaacttcatgttcttcaagttcattccctcgnttagggaccatgatctccagcactgaggcagcctcatcaaaacaagcctccagcttagcatctt

SEQ ID NO: 24480 - DNA, 485 bp, Zea mays
  Clone ID: cC-zmle189062e12a1
agccctccttcttacctcctcttcctcccttctccaaaaccaaaccaccacttaaaaagagaaaacccaacaactccaccataaaacactttactatttagttttagggaaaaaagaagaactcaagcacaatttttagccattcaaaaaaaaaacccccccaggaaaggggccccccccaaccccacccaaaaagaccccccaaaaaaaccaaggggaaaaaaaaaaaaaccaaaagcacaaccccaaaccccacaaaagggggggggccaaaaaaaaaaccccccccgggggaaaacccgccggccccccagggaaggcccgcggggaaaaaaacttcggcccccaaaggaatgaaaaaacccccccaagggggggggcccaaaaaataaaaaacaagagaggcccccccgggggaaaaaaaaaaaaaaaaggggggaccccggaaaaccgggcccaaaagggggggcggaaaatcccccccc

SEQ ID NO: 24481 - DNA, 383 bp, Zea mays
  Clone ID: cC-zmle189062f01a1
aaaaacaaaacccccccgccccggtttttccccgctttttcccaaacccccagggccccttcctgggaaaccaaacccaggggcgggccccccccaacccaaggttaaaaaccctttttgggccccaacccggcccccaaaattttttaaaaacccctttttttgggttttccagcctccagggggggggccctttttagccccccccccccgggggacccccggggggcgaaaaccccgaaaaagggggggggggttccccccgccaatttggggccgggaaaaaaaccggcccaccccccgggttttcctttaaaggggggcctttttagccccaaaaaccggggctcccctcttcccatttttgaccaaaaagaaggggg

SEQ ID NO: 24482 - DNA, 511 bp, Zea mays
  unsure at all n locations
  Clone ID: cC-zmle189062f01d1
gacccacgcgtccgaccatctccaacgcagcaagcagacagaaagacaggcaggcagcgtgagcaaccgcgagagcgatcagcgaagggctccttcttctcgaccttagtgacgccccctccggccgccgacgacccgaactgcgccgaggaggccgcgcactccaaggccacctacgacgagcagagggcggcccacatgagcagcagcaagctgatggagatcgacttctcggcgtcctggagcgggccctgccgcttcatcgagccggccttcaaagagctggcctcccgcttcaccgatgccatcttcgtcaaggttgacgtcgacgagctcgcggaggtcgcaaggacatggaaggtagaggcgatgccaacgttcgagctggtcaaggatgggaaggaggtaagccgtgtgataggggctaagaaggacgagcttgagaggaagatcaagatgttcgncacgtcatcttcctcgtcctaacttagcagggcatacactcccacct

SEQ ID NO: 24483 - DNA, 399 bp, Zea mays
  Clone ID: cC-zmle189062f02a1
ttttttttttctttttgttttttttttattttattttttttatggtttttttttctgtactggttggtacaatatttctttacagctacggtaggataccataccgtatattcagatctactgatcctatcatcattagaactggttttgatcaaatgatcatatcacatttctaatctcttgacacaagccaccgaactgagccagagaggcctctctttgactatcagcacacgggtcgtacgtagcagatggaaactatgtaaagatagtaagcccatttctccttgaaaagcgaaatgaaaaaggcagagggccggaaggtaaaacgcgtcatgttcataaacttccgcttaagaatgcccaagaagacaccctcggggacattgggggggggct

SEQ ID NO: 24484 - DNA, 453 bp, Zea mays
  Clone ID: cC-zmle189062f03a1
tttttgaaaatcgattatttttaggcgctgcaagcatcagcgttactgggtcaatgtacaaaaatgagcagagagaattacaatccacgaccacctttctgcagccacgcgaacgccaacggagcgagcttctgacgcagctacgggcccatcccgcacgtgacccggatcatgcacgcgatgaacgcgccactgagctgccgcgcgcgggaacagagtaaccgactgccccgcgcacgtacgcgaacgccacacgcactaattaacgctactatcagagcatcgctgagcttcacgcggcgagaccgcaaccgtggaggtgatggtcagtgccctcccggtggacctcgagcaccctctgacgcggcggcatgacccaccggtcgtgctccgtgctgaccatgcccttgatctccgcctgggaccacacggtcggcaccatgtggccctacc

SEQ ID NO: 24485 - DNA, 198 bp, Zea mays
  Clone ID: cC-zmle189062f03d1
cccacgcgtccgctctcgggctatcacaacctgcaggcgcagctttacctgctggagggctctcgcaggatgaggagcacggttgagccccggggaagggaccgggccctggcgaacaaggccaccaacttggtgggggaggaccacatggagccgacgatatggtaccggagggagaacaagggcctggcgcggacg

SEQ ID NO: 24486 - DNA, 342 bp, Zea mays
  Clone ID: cC-zmle189062f04a1
gtctgtgtattttatggcgactcgtggaatccacatgcaaactccaaaccggaacccaggacaggacaaaagcagatacagacagggataacagacgagggagtagacgggggaacaacttacatcgggcaaggcacaacaccagcccaaggccccgaccaaggaaccggccaacgcaaacagatcaacagccgcggaggacaaaggagggaaccagaacccggcagctcagaagcaagcaggggccgcatacccatgggaaaggcaactgtgcgaggcgcaagagcaacagctccaacagagggaaagagcggaccagcagccagaccgcctggaagggac

SEQ ID NO: 24487 - DNA, 497 bp, Zea mays
  Clone ID: cC-zmle189062f05a1
ggataaaaacattatctttttatgtttttttcatgtaaacccatgattttcgcaagtagtcaaacgcgtccttagcacagacagctactgtgatctggtcgacggcgtgacgctacgttcagtagcaatgtagcatacatcgtccgcagtctcgcgatggaaatggtatgctttgcccatctacgtacctacagtcctactatacactactacaggggcctgatatataccagtgccatgggggtggtcacagcttttccaccgggaagccgatgacgggcttgacctggcgcgccatggaccggagctccttcacctcgtcgggcgccaggctccacccgagagcgccagcgaactcccgcgcctgctcggcgttcttggcgcccgggatcggcaccacgttgccctggcacaccagccagttcagcaccacctgggttgaagtcctcccgtagcttcctccgatctccttgatccggttgataagtggctggagc

SEQ ID NO: 24488 - DNA, 330 bp, Zea mays
  Clone ID: cC-zmle189062f06a1
gggtcacaaaagcgaatgaatattaccattccaatcacgtacaacatatatgggcagtcaggcccaaaaataatatttggccaaccttggtactagcttcacctactaccgactccgactccccaggggatttcggcctttgattgaggggtcactactagcagtttacccgacccaaataaaataataacgggactcgttccatgcggaaaatgggctcccagtttttcggcaacatgctccccacctttcctagccatcaaaaacctaccttcttaggcccttaaccatggatgtagcatacagggccataaagggccggacccctgg

SEQ ID NO: 24489 - DNA, 413 bp, Zea mays
  unsure at all n locations
  Clone ID: cC-zmle189062f06d1
attttgggggaggacccacgcgtacggcactctatggacctgtatgctacattcatcgnagagggtttgttgatgtaggattctgacggcttggataggtggggatgtagttgacgattctctgtgagaccattcaccgcatggaacgagtaccgctattattttatttgagtcgtgtatactgcttgtagtgaaccctcaatcaaagaccgaaatcccctggggagtcggattcagttgtaggagaagctagtaacaagagtaggcgaaatattattttctggcctgactgcctatatatgttgtacgtgattggtatcgtaatattcattcgcttttgtgattctatctattttatattaattatatatttttgctttgttttctctagtatattttttatttttttttgg

SEQ ID NO: 24490 - DNA, 319 bp, Zea mays
  Clone ID: cC-zmle189062f07a1
gcgaacaaaaaccttgctcattcttctctcgtctcgtttcatagcgggagcaaacaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgcc

SEQ ID NO: 24491 - DNA, 333 bp, Zea mays
  unsure at all n locations
  Clone ID: cC-zmle189062f07d1
gacccacgcgtccgggcggcggaggcggctacagcggtcggcgcgagggaggtgtcggctgctacggaggcggtggcggctacggcggtcggcgcgagggtggaggaggcggctacggcggcggcggcggcggctggagggactgatgtgagggcccatcctggcttcggccgagttatcttatctatctatagtatcgngttaccgttcgcttctgtcaccgagttagagtccgttctacctttggattaagtgttggtacccctgttgttccctttgtttgctcccgctatgaaacgagacgagagatgaatgagcatggtttttgttcgc

SEQ ID NO: 24492 - DNA, 558 bp, Zea mays
  Clone ID: cC-zmle189062f08a1
ttttagtaaattgacgtcacattataaaccagttcagtaatgataacagaagtttcaacaccttaacagcaacatactgcagccgagagccaagtgcctaaacagcataacataaatctatcgccagtaacaaactcggcaataactagcagcaaccataactcctcaacctttcatagctttcgaaataaaaaaaaaggtaatattttcgagaaccataattcgtcacattcggccaatctccaaatcaagagcttattcttcctcctcagcctcctcgagccatttgacaaacggctccagagctttcacaaaagattgcctgcccttcgggtttgaacctttacggaaccaaaggactatagtatcttcagctaggacatcttggtcatacagtgttcttatgatttccggaaacagcttcatcagcttagcatcctcatagcactgtgtctgaactttgtgtataagttccagttcgagtctgcactcgtgcaaaaagcattcaaaagctcagtccaagctttcacctgcctaagtgctgcattggaattttgc

SEQ ID NO: 24493 - DNA, 412 bp, Zea mays
  Clone ID: cC-zmle189062f09a1
aaaacccccgggggggaattttaaaacccgggcccttgggttaaattatcaaccccaaaacttggaccaggacaaataccccttttaacaaaaaattatttcaaggggggcgggaaagggacaatccccaaggctaaggaccaaaaagggccacagccagccaaaggaaaccgggaaatgccaacgggatggaaaacctgggggggaaacccctggcctaaaaagggcacccccgggaagtttatggcaacggcccaccgaatgggcggttaaaacccccgatttggcggtttcccgaagaaaccccaggccttaaggcaaaaaaagtctcctcccaggttaaccaaaaaaaataacggggttgggaataaaacaatgggggggccaaatcttgggaaaggggaaaaggggg

SEQ ID NO: 24494 - DNA, 432 bp, Zea mays
  Clone ID: cC-zmle189062f10a1
aatataacaaacttcgtaagtatcaataacaaggtctcaaatttacactaaagaaaagctgttttttttaaagtagtcgcagaaaagaagcccttttagttcagcttctaattttccaaaccagaagcagaaccaaacatgtgtcacgccaagttgccagcctggccgcttacaatacagcaccgatacattgtaacctaagaccatctccagcaacgtccccgctcccgaccccctttctgcgcgttgtggaggacggggcccacagatgcgcggccaccatctccagcagcggcacgcatccgggcagcgacggcgcatctcgcctgtggagcgtcgtctgtgggccccgcgcggcggacacgcggcgcgtctcggttggcgagtgcgaaatgcggggcgcgagcagcgcgcgccggatgggcgttggcg

SEQ ID NO: 24495 - DNA, 149 bp, Zea mays
  Clone ID: cC-zmle189062f12a1
ctgggaagaacaaaggtgtgctacttgccttcggatctcacacatgattggcctgcctcccgctcccggtcgatccaaaaccaattctccgatttgtcaggacctgctatatatacatacccctgtatggatggtgccctatcttacaa

SEQ ID NO: 24496 - DNA, 552 bp, Zea mays
  Clone ID: cC-zmle189062g01a1
gatagattgatactatgcttgacaatcatagttgtagtttccactaattattcaaacctgaaaaaaagataaggatttggacttaaaaatctacatttaacttcctatcgatatcagaaaacatctcgaaaaaagctttgaagtgtctgtatgttgtgtccacatcttctttaccacacatttctcgtacactgtgcatcgaaagctgagggataccacagtctacagtccgtatgccaacaccagaagcaagtatgggtccaatagtggagccacatcccatatcattcctcacaacaaattcctgaacgggaagattatgaatccttgctatttctttgaagaggaaagctgtaacagcacttgtggcataacgttggttagcattgtgcttgatgacaagtcccttctgtagttctggtctgtggcactcttcatgcttttcggcatagttcgggtgcagagcatgagccatgtccgccgaaacaaggaatgaagaatgtattgcacgttccaaagctccctcccccatcgactgatgcatcaaggaat

SEQ ID NO: 24497 - DNA, 488 bp, Zea mays
  Clone ID: cC-zmle189062g01d1
cggacgcgtgggcggacgcgtgggcggacgcgtggggtacagagttgggaacggattcaacataattgcagcccacactgatagcccctgtctcaagctcaaacccaggtctgccactatcaaatctggccaccagatggtcaatgagcagacgtatggaagagggctgaggcatacatggttcgatagagatctaactttggctgggagactcatcctcaaagctacagaaggttcctttaagcatgagcttgtcaaactcacctggccattgatacgtgtaccgacactggctatccatcttaaccgagaatactgatgggttcatgcctaacctagagactcatcttgttccacttcttgccacaaaacatgaagacacacctacaaattctgatgaaaaaagctctaactctacaaaagtcacccaccatccactacttttgcagattctctcagaggaaatcggatgtgacccagatgaaata

SEQ ID NO: 24498 - DNA, 555 bp, Zea mays
  Clone ID: cC-zmle189062g02a1
tttttgattcaaccaactgactttgtttgacttcaaagatccaaagacaagctgtttacaattaccaatcaaatcagcttcaatcgtatagacaattattgagagtgttatcgtttggctttaggaaagcagttgggaggacagtcgtggatgtttctcacacaccagtttaggtccggtcatagaggctagcgaaaggatagagtgagcatggccaaatgattccaagtggagcaaactgatgctggctacgcgtcttatttcagaaacatttactatgcccgcttaaagtgacggctccctcatggctcaggttgcatgttctcacattcttctcttatggactgatagaggacagatgaaaggtacctctcgccgaagctcggaaacacaaccactatcagctttccagcattctctggtcttttggcaacctttatggcagcagcggcggctgctccagaggagattccaaccagtaatccttcctgaacagccaactgttttgctggctaacagcttcatcacttgatatctcaattacttcatcaagaa

SEQ ID NO: 24499 - DNA, 512 bp, Zea mays
  unsure at all n locations
  Clone ID: cC-zmle189062g02d1
cggacgcgtgggacaggatagggtacagtatgataaaagatgctgaacagaaaggcttgattactcctggaaagagtgttttggaggaagcaacaagtggaaacacaagcattggtctagctttcattgctgcttccaatggatataagctgatactaacaatgccttcatcaatgagcatggagagaagagtcctccttagagcttttggagccgaacttgtccttactgatgctgcaaaagggatgaaaggggccttagataaggctacagagattttaaacaagacaccaaattcttacatgcttcaacagttcgataaccctgccaaccctcaggtacattatgagactactggtccagagatctgggatgattcaaaggggaaggaggatatattcattggtggaattggaacaggggggacaatatctggagccggccgntttctcaaggagaataatcctggaattaaggctatctggattgagccttctgaaagtaacatactc

SEQ ID NO: 24500 - DNA, 416 bp, Zea mays
  Clone ID: cC-zmle189062g03a1
aataacaacatttgaggggaacttacattacaagtaaatgcgagttagttgcatatccagtacaaacccactgatgggttattatatatgaatgaactgcgacgcaacagacacaagaaaatttgtaccctggagcctgcagacacttggctaagcatttacactgaaaaacgcctcatgacgtcgaccctttgctgcctggagtcatgaaagactcaccggagccacactggcctttggaatttgggtttatgaacacaaactcggactttaatggatcatcaacatagtccatcttggtgcctataacatgcaccgtttttccgtgaacttgcgcacgcgcttggacttcaccacgtatgacttgatcgtgccaatcccgaccggcatgatcacccctaccatcattgcctaca

SEQ ID NO: 24501 - DNA, 192 bp, Zea mays
  Clone ID: cC-zmle189062g03d1
gggcgatcccatcgcgtccgcccacgcgtacgcggacgcgctgggcggacgcgtggggcttagttattggcaccaagatggactatgttgatgatccattaaagtccgagtttgtgttcataatcccaaattccaaatggcagcgaggctgcggagagtctttcatgactacaggcattaaagggtcgacgt

SEQ ID NO: 24502 - DNA, 346 bp, Zea mays
  Clone ID: cC-zmle189062g04a1
agggcatggtatgctgcttgaaagccattatgaaccatggcataccgtgaaagggctagccccccagaacaggggcgctgcagccccggatagagacaccgggagaaagagaagcacggacacacgcgaagcgccaacaagaagggacaaaaggcagggggggggggggggggggaccccccggggggggggcggggagagggggggggggggagggggggcgcaaggcgggggcggggaaccgggggccccgggcacgggccgcgagccgccgagcgccggtgccaacgaatgctggtggcggcccagggaggccggacgatcccagaagatgcctgccagatcg

SEQ ID NO: 24503 - DNA, 391 bp, Zea mays
  Clone ID: cC-zmle189062g04d1
cggaataccgggggcgacccaagcgtccgatccatgatcagcaaagcggcagagcgtagagaggatcgtcgaacagaacagcatgaagaaggtcatcgttctcgtcgagagcctggctctgtcagctgccagcgcctctgcaaagcagatgccctgcccctgcgcggggctgcagggcttgtacggagctggcgccggcctgacgacgatgatgggcgccggcgggctgtacccctacgcggtgtacctgaagcagccgcagagcagcccgctggaggaggcgccctactacgccgggtgagggcagacgagcgccatgtaccagccgctccggcaacagagctgccagcagcagacgaggacgatggacgtgctgtccgtcgcgcagcag

SEQ ID NO: 24504 - DNA, 357 bp, Zea mays
  Clone ID: cC-zmle189062g05a1
actaataatttttattcaggtcacgagcttattggcgtaaatcgtacaggagctgagtgcgtgcacctacgatagccaaggacgatgaccctgcacaaccagtcaaccacagacatacataaggcacgcaggcaggcacgaacgggcgtggatgccggccgacgggcggatcatttagccctggcaaggaagctctacctgccctcggggacctcgccggcggacgggttgatgaccccctcgaccctggccatgcgcaccacgaaaccgcggccgacggggtgaccatggcgttggtggccggaggatgccccagcacgcgaaaccgcgttgacctgatcgaacttatacttggcc

SEQ ID NO: 24505 - DNA, 438 bp, Zea mays
  unsure at all n locations
  Clone ID: cC-zmle189062g05d1
cggaatncccgggtcgatcccatcgcgtccgcggacgcgtgggctactttcatacagcccactggcggtggtcactgcccctccatgcctacaaccccaggggttgctaccaagtggaccacctctgactcaaggaggtgtggcaaaccctgctggccacttacaacagncactgacatggaaccaactggctgggtcaaactgtgatgcgtacctacaacaacgacaactgacactcaatccataggcagcagctaacccatcgtgggctaccttgctgccacagctacaacaagcgctagcacacaaccagggatgtctgataaaccctgccttgcaagatcccatagcgggaggagagatctcttagacaagatatgtgaagcactcgacagtcgagccctaataccgacatgggctgcctagaaaccatatgta

SEQ ID NO: 24506 - DNA, 410 bp, Zea mays
  Clone ID: cC-zmle189062g06a1
caatatgaacttaacatttatttgatttaattacataacgtatgggcaatatccatattaaatctaaccagggcatgcagttttcgctcgttgcttagaaaacgagacaatagctgacatgcgtttttgtctcccgatgatccgttcttattatattgggatttagcagtccgataacttgacgaatagccactatatatatatgcatggctaggggctgtagcttgaagcttcgtatgcggtatgcccatcaaacgctgcccttaacctggctgctgtagttgttctgcacgtcgttaaagcggtcccacaccatgatgccgccgtagttgccaatgcctcggatggcggggatcaccgtgcccgtaagggtgccggggtcgatgtacccgatgcccgcggcctgggga

SEQ ID NO: 24507 - DNA, 422 bp, Zea mays
  Clone ID: cC-zmle189062g06d1
gcttcctcgtctcatattcgagaccagtaagcaacatggcggcttatctcaagagggctcctgttctagccctcgtcgtcgtcgttgctgccatggttggcaccacgagcgccggcaacatcgcagtgtactggggccagaacggcaacgaaagcagcctggcggacgcctgcaactccgggctctacgcctacgtcaacatcgcgttcctcacaaccttcggcaacggacagaccccagtcctcaacctcgccggacactgcgaccccggctctggcagctgcaccggccagagcagcgacatccagacctgccagtcgctgggcatcaaagagctcctctccatcggaggcgccagcggcagctacggcctctcctccaccgacgatcgccacagcgaggccgactaccttggggacaac

SEQ ID NO: 24508 - DNA, 384 bp, Zea mays
  Clone ID: cC-zmle189062g07a1
gttcttacaagcctcccgggtcagcccgggacttaccagaaaccccgaaccgggacctggaagcggaacaacacagcgtactcaggaccccagcacgaccaggcccaaggctgggcagagcagttggccgaaggcaataggtaaccctgcaccatagccaacctgaaacgccaccgtaggggaaggcggaaacggtacagtgacgaaacagggagccaaggcacgttgaacacaaggagctgaaccgccacttgccaaaccgacaacctggcccgcccagagcaaccacgaaacggacgaagcccagggcgaggcagattgggtacggcccgccagcgaagcttgactggctacaagtaacaccggggacagacggagggcatt

SEQ ID NO: 24509 - DNA, 55 bp, Zea mays
  Clone ID: cC-zmle189062g08a1
agcggcctgttctttttattttttatttcattttgggaataattttctcaatcat

SEQ ID NO: 24510 - DNA, 497 bp, Zea mays
  Clone ID: cC-zmle189062g09a1
caaagataaagttttcagattaggttggaaccatagcatacaattcacggtaatggatcaaagataaatgaacaaaggccggagcaacccaaagcaaaagattcacaaaccatggatgcattagaataagagcaagatcccataaattggttcgatacataaaccctggatgcattggaaggagcaaaatcccatgagctggttcgatacataatactttgacatgtctattaggttctacatgtatggaaaatcagacactggaacataatctctggcagccagctccatgaacttgaaatgctctctatttctttttgtcagtgtgcgtaccagccgacctcatcttcctgaggacgcccgccatctcctatctcttcttctttgccctcttgtgagttccaagctttctcttagcaagcttcagggcacgcttgtccttgccaaccttcagaagctcagtgatacgcttctcataaggagcaaacccagcaacc

SEQ ID NO: 24511 - DNA, 490 bp, Zea mays
  unsure at all n locations
  Clone ID: cC-zmle189062g10a1
aagcaccaaacaagatagcatacttgtcattgtattgaaaacatacgcattggtgcattacaagctttagaacagggctgagcatgcgcaaagcagtatatagacgatacgtcccttattcttacatagtactgtactatacacattcgtcagacctgtgccatacagccatactaaacacagtcttcttgattctcatacgccttcacataaggcccaaggtgtgtgtcgtgccctggtgagtgccagacccaggaccatgtagctggtaagtctggctcggcacaacctggagaacacctggttgctccttgagatccttgacctgctggggggtgagcttcgcggagaagccgctggcggcgttcttgtagtggtagagcactgcgtccctggccttctgttcgctgccgaggacggnggtgaaggtgcggatgtggaactcctcaaggtcggcgtcctcggggcggtcaacgtacacgatgtgcac

SEQ ID NO: 24512 - DNA, 446 bp, Zea mays
  Clone ID: cC-zmle189062g11a1
ctatctataaaagtgcatacgcttatcaaatatgcttaaattccaattccaaataccaaaacaaaggtttaaatttctacaagttgatctaacagtacttcctaatacagaaaactgagcatattgaacttcagtgcatcttttagatgcagatgatctcttgagcacacatctagaattcatcttctgcaagcttctctagcaaacagcagcactggagattttctatcttccatatggatggtaacgaccagcagcaccactgccgccactgccaccatagcctgtcctagcaccatagagtccaccggtgccaaacccatcaccagtattagcccaggaagattcataactacgaccatagctagaaccaccatagcccccagcatcacgctcatatgcaccagctaatccaccatcataactaacaccaccatacccaccac

SEQ ID NO: 24513 - DNA, 399 bp, Zea mays
  Clone ID: cC-zmle189062g12a1
ctcaagtctagtttctgagaccaggataggcatcctacgcctagcttcaacaaagagctagacccaccaaagaagggaatacatacatttgcaaaatgacatgatttataccatatatatgatgctatgctctcaacaaagaattagatcatcctggtttatctccaactgttcaactgaactttttttttgtatagctaaggactgagagaactgagaaagaaaaaatacaggggaaaaaaagaatggcattacagcatcagccgaggtattccagtaacacattcccaacgaactacgaggcccatagcttttgtcagtaaggagagagcaaccaagcagctagaagcagggccaccaaaaatttccatggcatgtgcgctccttcatcctaacctt

SEQ ID NO: 24514 - DNA, 480 bp, Zea mays
  Clone ID: cC-zmle189062h01a1
gcgccgtcgtcgtcgtttagggttcagttcaccctggagcagtcggtggaggtgctgatggtgtaggggatgctgacgccgcacttggaggggatgctggcggcgttgaggccgctgacgccggcggcggcgttcttgaggcagttgcaggcggcgcggcggtcggcggtggtgcgggcggcgttgttgaggctcctgacgccgctgcagcagccggcggagggccccgagccctggccgcgcgcgtaggagatgcagggcgcgatggccgacgccacctgcccgcagctgatggccgcctccgaggtcgccgccgccagcagcaccaaggccaccacggcggtcgccactactgccaactgctgcgtgcgggccatgttccttgaggagggaggtgcctgccgctctgctagctctagctcgctcgggctgtttggaaatgcggaggtcacaggtcagtagatggcaatggcagctggt

SEQ ID NO: 24515 - DNA, 521 bp, Zea mays
  unsure at all n locations
  Clone ID: cC-zmle189062h01d1
cccacgcgtccgcccacgcgtccgcccacgcgtccgcccacgcgttcgcaccagctgccattgccatctactgacctgagacctccgcatttccaaacagcccgagcgagctagagctagcagagcggcaggcacctccctcctcaaggaacatggcccgcacgcagcagttggcagtagtggcgaccgccgaggaggccttggagctgctggcggcggcgacctcggaggcggccatcagctgcgggcaggaggcgtcggccatcgcgccctgcatctcctacgcgcgcggncagggctcggggccctccgccggctgctgcagcggcgtcaggagcctcaacaacgccgcccgcaccaccgccgaccgccgagccgcctgcaactgcctcaagaacgccgccgccggcgtcagcggnctcaacgccgccagcatcccctccaagagcggagtcagcatnccctacaccatcagcacctncaccgactgctccagggtgaactgaaccctatacgacgac

SEQ ID NO: 24516 - DNA, 573 bp, Zea mays
  unsure at all n locations
  Clone ID: cC-zmle189062h02a1
aacaccagcagcgtaaatagcactctttattttattgacaatgaacgtgatggagattgtctaaccttcaatacagtgcttatttatatccaacacaccgcccaatcggcaactacttattagcatcatacaagggtgacatcaccccatatctgttgccaaccaacccaagaatcctctgcatagctaaggaaaaatgatgctgttcgtcccagtttaaacaaagggacggtggtttatgatccacatccgacacaacagatgaaaaaatgatttggtctgggaacaaagaccaccaaagattttttatcggctacaataaatacaaatgttgagacaagctcaatcttcctcctcacgaatcagcgcgaaggagaatggggcaaacttgtagccatcaccttcatagaacttgttctggaactccacccagtgaagcctcagcgcgtgaaggaatgcactcagggtctccataacaagcaagacaccaatcgtggcaaagatgaagatgacgacaccaattataaggatgaaaacanttgtaaacccatatgccgtcattagtactttctc

SEQ ID NO: 24517 - DNA, 413 bp, Zea mays
  unsure at all n locations
  Clone ID: cC-zmle189062h02d1
gggtgganccacgcggacggtagaagttttagttcaccaactgattcacacgatagaattggttttgggtgcagactcaaacaccgcttcataccttgcggtttgggctctgagtcttgcacactctgagttgnccactggattctacgagaatgtacttatgacggcttatgggtttaacaatgttttcatccttattataggagtcgtcatcttcatctttgccacgattggagtcttgcttgttatggagaccctgagtgcattccttcacgcgctgaggcttcactgggaggaggtccagaacaagttctatgaaggagaagggtacaagtttgccccattctgcttcgcgctgattcgtgaggaggaaganagatcttgtctcaacatttgtatttatgggagccgat

SEQ ID NO: 24518 - DNA, 394 bp, Zea mays
  Clone ID: cC-zmle189062h03a1
aaaagtacaagactcgcagctatatttcacaccattttattctccatccatgaggcgcactggtaacacttgcagtactggttcagtaactaacagatgcctgccgttcttcaaactctggcgtgcgtagttgaacataatgctcagagcaaggatggcttaacggattcggctatgactgcccttacaccgtaatgggagggtggatttccggcgtgggagggagtgcctccggggccggatcgctatgctcaggcaccgggtggtgctcgggaaaccgtttgcggggcttaggtacgggtcggtactcaggcaccggcagaggtgcacagtgaaagtggcctaacaagcgctccttgagcgggaaacagagacaatcggacgctcactgccc

SEQ ID NO: 24519 - DNA, 199 bp, Zea mays
  Clone ID: cC-zmle189062h03d1
gtacgactgtacacacacaagctatctctagctatagcttagcagctccttttcagcaagaaggatgctcctcggcgtgtgtgccgttctgaaggagggcaccgtcacaaacactgcggacggccagtaggtcggccgtcgagggcctggcgatgagcgccgacagcacgtgagaagaacatgaaggctgaagccggtt

SEQ ID NO: 24520 - DNA, 557 bp, Zea mays
  Clone ID: cC-zmle189062h04a1
gatgaacaagggtctaacacaacattctcaaattgaaagcgcggcacagattattgctatcgcataccaagaacacttcaccttcctaccctacttcattggtttagaacacttacctattctctcatcatgccaaggaaaaaaaacatgcaattctgacatcaggatacacgatcgcagcttgccgcgaccggctggtaaagaccgggttacatattacagaagttagaaagcaggcagtgcgctgatgctatttcgttaaccctagggcatatcctacgtactcactccgccctttgttattcgtcgcatttgattttaaaaatgaactaggatacgatcaatatcgaacaacggagacagtataccacaaacggctacatcatacaacaggatcaatgcgggccactggattccagaacctatccatgtacaacagactacacatgagagactccattagatctcacatcttccgtttgtgccactggaactaacgtggttatctctccccttgaacatcgatcatagatctctgctgcattatgacgagagac

SEQ ID NO: 24521 - DNA, 168 bp, Zea mays
  Clone ID: cC-zmle189062h04d1
gaacgaaacgttggattctctagaacgggcaggctccgtatggttcatatatttctgcaaacttcagctttatagagcaaacgtatgcggtacaaccaacctgcagatgatttctagccccatagcaacggagactggcagactcaaactatatggaaaagatcgata

SEQ ID NO: 24522 - DNA, 303 bp, Zea mays
  Clone ID: cC-zmle189062h05d1
ataaaaaaaaaaaaaaaaaaaaaggcagacaaaaaaaaaagatttctttgggacggtcgctctcaatgaaccaaagtgacgaaacgcatacaggcaactaaattcaattcactagggcggcacctaactacagcgagcctagcaaaaccctacaacgacccaactgaaaaacccaggaggacacccaccttaagccagttggagcacttgccactttgcccaaaccgagcaacctgcacaacagctgcgcaagccgacttgccaaagagacgcgcactttatcggcgcattaagccccgccct

SEQ ID NO: 24523 - DNA, 457 bp, Zea mays
  Clone ID: cC-zmle189062h06a1
gggaggaacagaggtttgttatttgccaacagattacacacatgattggcattccacacgcaaccgatcgatatgacgattatactcctatttattagcaccagctatatatatatagccatgtctggagtctggactagcaagcaaccgagatcgatgatacagagatagattcatcggtttgcatgagcatgacttgttggcagccactatgttacaccaccatccaccaacgcatgtacaaagttctgcatcatcatcgcatcgccttcgcctgatgatgatagatcagtgcagcgccgtcaggacagtagaccctttcaccaccttgaaagtggcaccgcagatctcttcttcgtcggcggggacagcggtgaccttgcgcttggggttctcgtagcacttgagccctccagggcgttggagttaaagcagccttgcgggaacggcgcgagcg

SEQ ID NO: 24524 - DNA, 526 bp, Zea mays
  unsure at all n locations
  Clone ID: cC-zmle189062h06d1
gggtagacccacgcgtgcgctgagccagcagcacgggctagtcaagcaagggcgccaacgatgtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggagccgctcttctgggggatcaccgccgacggctgcgtcgccttctccgacgacatcgacatgctcaaaggctcatgcggcaagtcgctcgcgccgttcccgcatggctgcttctactccaacgccctcggagggctcaagtgctacgagaaccccaagcacaaagtcaccgctgtccccgccgacgaagaagagatctgcggngccactttcaaggaggaggaagggtctactgtcctgacggcgctgcactgatctatcatcatcaggcggaggcgatgcgatgatgatgccnaacctcggacatgcgt

SEQ ID NO: 24525 - DNA, 217 bp, Zea mays
  Clone ID: cC-zmle189062h07a1
gcaccacttgaagacaatgatgatggaatgagatttaacaacagaatgcttttcgaaacaagctgctgcgttgaacaatgcaagacatatctaccgcgatcggcactcgggagtttattgagaaaaacacatttctacatgcggtgcgtgtatatgaatgctgtcgcgcacgtcgacggatgtgcttcccacgaattcagcagctggccccgggggg

SEQ ID NO: 24526 - DNA, 580 bp, Zea mays
  Clone ID: cC-zmle189062h08a1
ttttaaaacattcaagggcactagtagtgtataaatgtgcggcaaaatgtacatggaatggaaggcaacaacatctgtcctgccctgtcctgtgcatccatccatcaagaacagcggtgacgaacaaacaccattgatgattaattagatgaggaacaggaagcaagaaatcgtcgggggggcagggcagggcactgtgtgggacggacggcgaccgcgcgaacggatcggggataacaaacaaaccaatgaatcagttgcgggagcactcggcggggaagccctgcgggaagcgccagccgtcgtcgcagtagttgtagtgcatgtagttctgcctggcccaggcgacggtgccccactcggcggcgtcgagctggcggctcatccagcggtcggtgccggcggggcaagagagcgggcggccgtcgccgtcgggcacgcaagcgtcggcggagtagccgcggtaggagacggctaagggcgcggcggaccagtccaccttcaccttcccctgctgcgttgcccagtagctgccgtcccacagcgtggcgtgcaccgacatgggcttcccgcccgggta

SEQ ID NO: 24527 - DNA, 240 bp, Zea mays
  Clone ID: cC-zmle189062h09a1
ttttaagaaatgctagaagtccttgatcattattaatgaccacaaacgtaattacatttagggaaaatataaaggcataacctcaaatggctcttgaacagaggaagaaccaagctagcatcatgcaacaacataaataaaggttggcagtgctgttgtcgtcatcatcgatggcggcatccatcagctatctccgttctgctgcccataactgcaagatcctgaaggcaggaatgagaa

SEQ ID NO: 24528 - DNA, 311 bp, Zea mays
  Clone ID: cC-zmle189062h11a1
aatcttgactttccttccttcccctttttgaccctcaaaaaacaaggggggagcattttcatacccagaccagccggagaggggggccccccggccccccccgaccaaaaaaagggtcccccccaaaaaggccaagaaccgggggggccccaaacccatcggggggaacccaacctccccggggggggagggggactttccccccaacaacaagaaacgcgcgagggtccaaaaaaaagaggggcgagacccctccgtattttacccacagaccggccggggggggccccccgaaaatccccacggggccc

SEQ ID NO: 24529 - DNA, 439 bp, Zea mays
  Clone ID: cC-zmle189062h12a1
agtgaaaggctgtataattacagtttaaaagtttacattttagtatctcttcccgtaaattctgacgacaaattcgagtccatgattcctctgggatttaagaagtaatttaacgttgctagatcctgcgccaccgttctgcaaaatggcgcatccgccgtttttgtcggagtactggtctaaagcttcgatgtaggtgatggtccctttgatatctccgggctgaggatagttgatatcataggtgacaaccctcaaaagtttcgtgctcaattttgggtgctccacatgcaacaactggtctccccactgtctagatccgaagaacgcattgaggcttttattcgtgccacaagaaacggccaacgctggctgcggagcgcagatgttcaaagccaaagccaaaaaaaggcccaaacttaaacttggcacaatttca

SEQ ID NO: 24530 - DNA, 218 bp, Zea mays
  Clone ID: cC-zmle189063a02d1
aattcctgggtcgacccatcgcgtccggcctcaccagcttgccaaatctctaaccctaggtgcagcggcggagatggcccccaagcgctcggctccacctccgccgcctccgaccccggctgcctcctccgaggagaccgcctctggttcgggctccaaggaggaggaggaggaggaggagaagaaggatgattggaaaacggccaattaaacggctt

SEQ ID NO: 24531 - DNA, 633 bp, Zea mays
  Clone ID: cC-zmle189063a03d1
ggctttaatacaagatctggagtttctatctaacaactgtagatcaaatagctgcatagaacatgcaacaggcattatggaggaggagattgttcctttaaaactttctaaaggagtctcaactatgtcacttgctgataataaaacaaaggagaacaagtatctccttgatatgctagagagctatgaatcagcgattggtgagccgaacaccaaagctccatgtcgcattgctcaattcccacctcctttccaagcagttccatgcaatcctattgtgcttgatatggcttacaactcagttgagttcccaaaccttgagaaccgtatgaaaaaagaaaagaagggtcttctgagcaggttctggggttgaaagatggcatatgcctaggattttggtacattgtcccatcatttgatatgctctgtgcatgaacagtgtaaaactagaatgtcctgataatacctctctgatgggtgaaagatcttcagtatcccgcccaaggatttttgagattctttatcagaaggctaatttatccgttgcacagtacatctagctcggtgactgatcagcataaccttttgctgttactaacatttgagcaatgactgacttctcggatcatcgat

SEQ ID NO: 24532 - DNA, 196 bp, Zea mays
  Clone ID: cC-zmle189063a04d1
attgaatactagaactcagatacagattgcatgtgaacccttttacatagatcaaatttaaatacgtaaagataatatccgtaccatttatattcctacgcggcgtgttaggtggcagccacatatcaaaataaaacctgaaaattattagaaattttaaaagataaatgaattactgactggaaaaaaattttag

SEQ ID NO: 24533 - DNA, 558 bp, Zea mays
  unsure at all n locations
  Clone ID: cC-zmle189063a05d1
attcctgggtcgatcccatcgcgtccgggcgcggaccagtgcgctgcgagagcatcacacaatcattcatgggatatctgctagctcgagagactagctggtgacggagagccagttnaagtgcaggagagatcgtgcatctgaccctgaacagcggtgctgatggaacacctcatgtcaccagtgtaaatagcccgtgcatgctctgcgtgcgcatccgtgagccgaacattcatcgacatgctcaggaccgcattaacgatcacatgtcactcgctccccgagccagagccagtgatgatcctgcgctggagctgagtccaacatgcatggccgtgccgaggatcgattcacgacagcaggaagggagcatacagtcaagggagtacagatgagatcatgtcaggggaggaccgccgaagaatatgtagatatgtatcatccagaccttcgatagtaaattaccagtagtaagaagtgatcaagatgatgggggcttacgctaaagacgggctacctggctagcttcttgacacacgaagcttttgaaaggctgct

SEQ ID NO: 24534 - DNA, 560 bp, Zea mays
  Clone ID: cC-zmle189063a06d1
cccacgcgtccgcccacgcgtccgggacagaaaggtagaattcgggctacctgacctggagggccgtacccaaattttcaagatccatacacgaaccatgaactgcgagcgagatattcgttttgagcttctggcacggctctgccccaactctactggagcggatataaggagcgtctgcacagaagccgggatgtatgccattcgtgcccgctggaaaacggtgacagagaaggattttcttgatgctgtcaataaggtcatcaagggctaccagaaattcagtgcaacacccaagtatatggtgtacaactagtgagtgtcttcatggaatatgttgattttagaactccgggatcttttcggtgattgtgtcatcgtgaggttctatgcaaggattgctgtttgtttagaaatctggatccccagggattgcatcctgtaccacatgtttttaagacaaggttatccgcttggtggctcactgtacctgtggcaattgttgccgacaccgaactgaacactaagtcagaaacaggctacagtgagtgttgataagg

SEQ ID NO: 24535 - DNA, 590 bp, Zea mays
  Clone ID: cC-zmle189063a07d1
attcctgggtcgacacagccccacgcgtccgcttcttcgcgcgcgcggacgccgtcgggcgaaggcgcctcgctccgtcgcccgccgtgtcgagccggtggcttgcggacgcgtcgccccagccggagcaggaggccaccagcagaggcccgtgacgagacatgggccggccggctggctggcgtgaagcgatcaagcaaggtagagagagagagagagggaagcttttgttgcattggcagtacctaatgaggggagggtccagtacagtaggtaggagcaaagtgaattcgttttagcaacgtgagagagagaggcccgatagtcagtgcagtatcagttgttgagcgtagatggtgaaactaatgtagcagctcagttgtactcctcccaaccacctgatgaatcctacacaattgtagagtgtggctgcagcaaatcccggccatggcaccggagctcctccaggaacgcaagttcaccagctgctgctgctgcttgccatggcggtggcggattgctagtgctaatgttccacaggctgttgattgctgagacgcaaggtggcggggtggtggcgggcagcagac

SEQ ID NO: 24536 - DNA, 99 bp, Zea mays
  Clone ID: cC-zmle189063a09d1
cgcaaaagtcaaaaaaaaaaaaaacaaatctaaccttgagttagaaaaaaaaggggctgactttttagagagacctgacttacgtgacgcgtacatgcc

SEQ ID NO: 24537 - DNA, 446 bp, Zea mays
  Clone ID: cC-zmle189063a10d1
cggaagacttcgggtcgatccacgcgtccgtccacgcgtgcgctattgcagcagtgcttgaggattcagtgatctgcagatctgcaaggacaaaaggaccaaaggagtgagctggtttttatattttaactgatgcacctggatgctttattgagcggtgtctatgaaatgagttggatggaagattgtccagttttggacaatgccatcctttgtttccgctgtgcctgccaaggttgtggcttccttgggtgatgcttatttgagaacatagctgttgtgctctgagcatgtgctgtgtgcctgtcatggcggcttcttttggcgtcatcataccaacatattcaatgttaggctttaaagattggagaaacgcccatggtcctggcaaactgcggcatgcggctttgaactttgcctattggagacctgatgcggatcatttt

SEQ ID NO: 24538 - DNA, 490 bp, Zea mays
  Clone ID: cC-zmle189063a11d1
gtcttgtgttgttcggagcgggcagcagcacacattcccatcccaatcctagtcgatcttcttcccctgctcaagagcgtgcccatgggtgcccaaggttgtttaggagacttaattactgtaatttgggttggtttgaaggaagaaaagaagctgaaccatggggaagagaaagtcagctgctaagccacctcctaagaagcggatggacaagcttgacactgtcttttcctgcccattctgcatccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaatgcgacgatgatgcgtgagcttgccccatgtgatgaaactgttacctacaatcgtaatgtaatgtgctggtattctcg

SEQ ID NO: 24539 - DNA, 514 bp, Zea mays
  Clone ID: cC-zmle189063a12d1
acgcaggggggcaactcaacaagggccaagtcgagctcgggggctaggaagacgcccgctcagaggcaggcggaggccggcgcctagtgcgtggacgcgagggcggaggcattcatcgacagcttcaggcagcagcagcaggtgcaccactaccaggaggaggaatacgtcccgcctccggcgcccgcgccgccgctgtcgcgcacgtcgtccgtcctggaccgcctccgctccttcggcctgtaccgcttccgctccggcgacctcggccccgaccttccctccgtcaccgtcgccacggagacggacaaggagaagcagcaggcggcgcactacgggcggagccggtcggagccggcgcgggagcagggcaagaagcaggacacgaggatgaacaagtcgagctcgagcggcgtcgtggcggaagcggacgcgcatcagtgcgtgaacgcgcgcgcggacgacttcatcaacaagttcatgcagcagctacagctgcagcgactgaactcgc

SEQ ID NO: 24540 - DNA, 551 bp, Zea mays
  Clone ID: cC-zmle189063b03d1
cggacgcgtgggcgcggctgggatctagcacgctagcgagcgagagagacgcacatctatctgtcaagcgacgccgcggcctcgatcagagtcggaggcgaacacccccatggcggcggctggcggcggcgcaggagggaaggttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtagtcatgtcttccggttagaggatatatacagtccaatgcataatgagcaaaacttgagagaaataaagctttgatgttggccttgcttggctgtaggatgttgttacaaggataataagcgaaccttaccgtacatgtctcaagttgtatgctctctgtttgtatgtggagagatttctgaaagtgaatccagtatctgaatcgactcataat

SEQ ID NO: 24541 - DNA, 551 bp, Zea mays
  Clone ID: cC-zmle189063b04d1
cacagcaatccatactagcacttcgtcgtcgcacgggcgctgctcacagtcacaccatgcgttggctccaatggcttactaccaggaggtggactactgctcggaggaggtgaggtcggtggccccggccggcttctgccgcctcggaggcggcgtccagctgcacgtcgtcaaggagaagttcgaggaggtcgacacggtctcacgcgcctgcgccaaccaccaccaccaccaccatggtcaccactgcggccacggcttcatggtgcgcgagaccagggtcgaggaggacatcaacacctgcaccggcgaggtccacgagcgcagggagatgcttcttgccagggctaactgagccgtccggcggacggcatccacgcccgttcgtgcctgcctgcgtgccttatgtatgtctgtggttgactgagtgtgcagggtcatcgtacttggctatcgtacgtgcacgcacttagctcctgtacgatatacgactataagctcgtgacctgataaaacttcttcgaatactaatacctataaaattatttttt

SEQ ID NO: 24542 - DNA, 448 bp, Zea mays
  Clone ID: cC-zmle189063b05d1
cattgacggcgaaggaaagtgggagctatgttccatccaccaattaccgattgacatcaaccagtttatttatgttcatcggagtagggtatttacaagttgcaacgcacagagaataaaaaaaactcgtccactcgggtgtagagtgtgtgacggagtcttttcttttttgggttcccttttctttttctctcccctttgatggaaatcttgcgatacggaaagggagggaggaaggaaatatacggcaggaaaggaaagcattaggagaggttatagatgcaggcttcgtcatttgggatagcatagtacatgttcctggcatgatatgccagcctgattgatttttatacgagatacagaataagttaaaataaatatggatatggcacaaagtgtgcccttgtaaattaaatgggaaactaatctataggaaattcatccaaaa

SEQ ID NO: 24543 - DNA, 547 bp, Zea mays
  Clone ID: cC-zmle189063b06d1
ggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaatgactttctaccagcgagcgccgcttatgaagccatacagcactctatggacctgtatgctacatacatcgttgagggcctgaggaggtaggattctgatggctaggaaaggtggggaggatgttgacgaaaaactgggagaccatttaccgcatggaacgagtaccgttattattttatttgtgtcgtgtatactgctagtagtgaaccctcaatcaaagaccgaaatcccctggggagtcagagtcggtagtaggtgaagctagtaacaaggttggcgaaatatattttcttgcctgactgcctatatatg

SEQ ID NO: 24544 - DNA, 560 bp, Zea mays
  Clone ID: cC-zmle189063b07d1
cccacgcgtccgagaacacacctgctgtgaatggccactcagcccccatatccccaaccattactcctactctaataagcgtgccaacagcaaccatgcctgtcagcaatgacagatgcggttgctacatgtcaaccaacagaatccaagtctaccctcgccacactgatatggttatcccggaaggcgcggccgtgcttcccatcagcgataatcagtgggtagctgtcagcctaccttattccatggaacaaagggatttctgttgccgtaatccggactgccacttaggaagataaaagcagacaaaaggatggatgctttgcgatgattatatagcttgtgatgctgagcattgcccgtgatgtactaaaatctagtgtaacaagactgccttgcgctggactacgattagtgtccctaatgcggagacttgtgtgactcctattgtatctagattaagctgtacttgtttgactatgtgcggaagtcttgagctacactgctatagtagaggacttgaactctggatggaccattcgcaacatttatcatgatca

SEQ ID NO: 24545 - DNA, 584 bp, Zea mays
  Clone ID: cC-zmle189063b08d1
ggggagaagactgttgcagcactggctttgctttttgccattcacagttttaggccatcaccgttcttcatattggacgaagtagatgctgctctggacaatttaaatgtggccaaggttgccgggtttatcagatcaaaatcatgtgaacgtgttggtgatgaacaaggcagcgatggcgagagtggttttcagagcatagttatatctctgaaggacagtttctatgacaaggccgaggcacttgttggtgtttatagggactcagaacggagttgctcgaggactctcaccttcgacctgagaaagtatagggaatcgtgaagcagcttttgttgaatgtttgtatcgaggactctcaccttcgacctgagaaagtatagggaatcgtgaagcagcttttgctgaatgtttgtactatgtgtgtagttgcctgctccatcagcttgctagatagctgtcgtgagccttcgatgctataactatctgtatactgctagtcctacataagtgctagctgaacatggaccctgaaatattcatttggtaggcggataactgatgtttcgaacacgcataaactt

SEQ ID NO: 24546 - DNA, 339 bp, Zea mays
  Clone ID: cC-zmle189063b10d1
gtcgacccacgcgttcgaggagatcttccagccgccggctagatattaggcagcagcagtacgtcgagaaagatgtgcaactgcatggaccgagctgccgtgccggcgaatagggcctggctcggcataaggcgcgcgcactacgagactgaggcgagagaccggtacgtacgtacgtacgtatgacatattagctgcgtcgatcgatgtgagcgatctggtgcgcaccctatacctctgggccggagaccgtcatccacagttgagggtgtctgtccactgtactagcacgcccatgttggttgttgctatgccaccgacgtatatactcatgaatgc

SEQ ID NO: 24547 - DNA, 405 bp, Zea mays
  Clone ID: cC-zmle189063b11d1
ttcgacccacgcgttcgtctacacgggccgagacggaggaccaggcagacgatcagcgcggcgtggcgctcctgagcgagaccatgtccacacccgtgctggaggccacagcagaccagaccctggaggacgtcgagtgccactttttggccaagttggggcttgcggacgccgactgcggtctcagatgcgtaggggtgatcgtttagaacgaccgggctagagcctctcatgggtacaagacgatgatctcagaagtgatgacatgtccagctatgagactataacctgtcaaaaccgagatggatgctgccgatatcatgctgaagaagaaaaggcacatatttcctgttgtcaaaaaaggacgaacaagaaaattgcatagttacccgagctgatgttctt

SEQ ID NO: 24548 - DNA, 426 bp, Zea mays
  Clone ID: cC-zmle189063b12d1
ggaaacgcggtccatacatattatcagtgcaagtttgtgatcatgtgatacatgaagcatatacgtgtacgtatttcaccagactacctgcaccggtgagcaagatgatctcctacttgcaccaccattagagcagcggatatgatctcatacttgcgcgttgcactagcagaggtgtggatacttaggatccatcattgcaaactctgatacaaaccagtgcaagctgagctgcatggattgcacacctgtatacctacggctcatgcagctataccggcctggattgtaccacacaatcaatattatcaaatgttagatacgacttggagggaagcttataaagacttccccgtgaatgggagagcaatcggctcatgaatctgaaaaatttaaaattaagggttttaaaattttaccggcccc

SEQ ID NO: 24549 - DNA, 397 bp, Zea mays
  Clone ID: cC-zmle189063c01d1
catggtggagcaggagctttctggaggcgggctcctcgtgtaccagagctggtgtgctgctgaagacgctgttgctacctcgcccaaatctgttttccactgctttgacggcgagaacgtggagagtgctcctacttctatgatgaaggactacaaactggctaatcttctatgctgggaggaggaagcggatgccatggaggagaaggcgggagtgcttgatgagtaagacgggcttctggggtcgatttgcttctgagttgtttattgtatatcgtcgcaatttcgaggttgtcgtttggttattctgtgaagctgcctagccaagctattgttatgaaaatttgtcgtctgtaagcatgtgaacttccgacgttgccacatgctggatcagtct

SEQ ID NO: 24550 - DNA, 609 bp, Zea mays
  Clone ID: cC-zmle189063c02d1
acccaccagttcgcggacgcgtgggctgctcccgagcttgaagcctctgctgccagttgcagagtcgttagtcgagagaagcgcaagggaaacactgatgaggctcatagcttcgacaccacctgcaagcaatcctctacctggaagtatatcctgggcgaataacaatgtgaagaagcatgctgatgtgtgtcccaatgaaaaagcatccggtacgtcttgtgttgctgctgtgtttggaagtgggattgcacacgctgaggatgaagttccaagcggaggtgattcacaagagccgtttgccgaatacgatggtaccagcaatgaatgtgatgtacatcattggcagaaattctagcttggctgcatcagcatggtaaatagggcttagaggattcgggggttcgatgccctgtacgcagcagcagccttaaaagtttctgtgcccagccagcatctctatttggtttggcaaatgtaagtactagtttggactgtcttgctttcggcaactttgtgcgagcctcgtgcttagctaggttatctatttatgaactttaagcctgttcaagcacccagtttgaagaaaatggatatataaactgaagt

SEQ ID NO: 24551 - DNA, 593 bp, Zea mays
  Clone ID: cC-zmle189063c03d1
gttcgtccacgcgttcgcccagccgccgccgccgcctaaggagaagaggttccggccgtctccttgccccgatggcgtgcgagaagaagctgtccaacccgatgcgggagatcaaggtgcagaagctggtcctcaacatatccgtatgggagagcggcgaccgcctcacccgcgccgtcaaggtgctggagcagctcagcggccagacccccgtcttctccaaggcgaggtacacggtgcgctcgttcggcattcggcgtaacgagatgatcgcctgctacgtcacggtcaggggcgacaaggccatgcagctgcttgagagcggcctcaaggtcaaggagtacgagctgctcaggaggaacttcatcgacaccggctgcttcgggttcggcatcctagagcacatcgaccttggtatcaagtatgatccatcaacaggcatctatgggatggacttctacgtcgtgctcgagcgtgctggctaccgcgtcgcgcgccgcatgaggtgcaagtcccgtgttgggattcagcatatggtgaccaatgaggactccatgaagtggtccaggtcaagtttgaagtgtcatcctaac

SEQ ID NO: 24552 - DNA, 320 bp, Zea mays
  Clone ID: cC-zmle189063c04d1
ggagtcgagggagatgaggctggacaggaggttggagtgaagcttgagaggcctgtcgagggagatgaggctgggcaggaggttgctgctgtcgagtagttgggttgctacttgtgtatctaggcgagtctggacatgaggttgcttatgacgtgaacttatagagttgtataggctacgtgttttgatctggcccgtagattttgtcttgaaacatgtttaaaattaagattactcgtggcgatcttctgtgttcgagtactgatgtactaagtgactttgcatcctaatttgtggttggtcatcgataataagaaaat

SEQ ID NO: 24553 - DNA, 492 bp, Zea mays
  Clone ID: cC-zmle189063c05d1
ccacgcgttcgaagggaacttgtgcgatatagctaccatgaattcttacattcagcttgcagacgaagtgtatcagcagagacgttatcaagatgagcgcgcatttataagcgcatgaaaggttatgtgcgacatgggtccggcaataagcagggaggttcagcttgttacgttccacactgtgtccaaagggtactagggagagagtggacaacgtggtggatacttcgaaatgacaaaatgttccttcaaagacagtagatgagatctacaaggttgcattaatagtactgagtccgaatgttcccgggcaaatctttatgggaatgatggttaacccttctaaacctggagatatctaatacccgaagttcactggcgaaagcaagttcatactcgaatctttgaggaggagagcgcgcatgatgacagacgggttcaacagctggacgaaaacgtgagtgagctatttgaacagaaggagctatgtac

SEQ ID NO: 24554 - DNA, 546 bp, Zea mays
  Clone ID: cC-zmle189063c06d1
ggtcgacccatcgcgtccggccactcgcgcggtgtctctccatacggtgttaatgctttctcctgcccagaatgctgacgccacacctgcctcaggagctggctcatatgatgcatccaggatttagaaacaccaggatcgctctgcatgcggtgctaacacaccttcgcgtagagatgcagatgcgggctatgctcctgatgaggacagggctctggagaaggcgaagccagcctgctgcagcctctcttcagacggtgacacttaccaccgcagattttgaagcattggatgctcaagtgattcatgtaaggacgtttgcgaagagggtcgtctgtctttcaatgctctgttcagttgggaaaagcttacacatagctttcctgcagcacacgcactagactctaaggatgctgccatggaggaggaagatgacgcgaccactgaggcagctgatcctaacatgactgccacttgcattgatcttgatgacctggacacattggctgatcccagagcttcctttgccatgaatatgcacacctg

SEQ ID NO: 24555 - DNA, 433 bp, Zea mays
  Clone ID: cC-zmle189063c07d1
agtcgccccacgcgtacggccactcgtaccggagctcctatgcattcaacaatcttttctggatcgttcgagctcggcaacacacgcgggacttttataatgcatcaggcgttctcgtctaatcctaaatcacacaacgcattacagcacggtgaccaacgtggaggcagtcctcactgttggaacactggtcgtcgcatactcggcacctgctaggttcacatgtgctcctatgactgtctgaaggatacacgccgtggcccatgggttagcacggcttggacggcaactgctagctgctcaaccgaagacagctataggaatgtgttgccaactggtgagaccgacaaatacaaccaacctgactccgtgactgtgtacaaggatgccagatatcacggaatcgaagactacactgaagatcacattcaca

SEQ ID NO: 24556 - DNA, 100 bp, Zea mays
  Clone ID: cC-zmle189063c09d1
tcccgggggcccatgccaatgaataatgatgtcactcaccaatccggcgcggcgcctaactttaccttgtactgcctggctctctcaccgtaggtcaggc

SEQ ID NO: 24557 - DNA, 147 bp, Zea mays
  Clone ID: cC-zmle189063c11d1
ggactatctacgcaaacttctgcttatgctataataaaaagaataacattttaacctctttatccgccaggtcggcaggtccggggaagtcttatgggtcaccggtcattctccccccttatttaggggcccaatcaataccctgcc

SEQ ID NO: 24558 - DNA, 510 bp, Zea mays
  Clone ID: cC-zmle189063d01d1
gagagtctagagaaagtgagacaaagtgaagcgaaagagttgactttgtattataattaggtctatatcatatctaagtagaagggaaatcaaaaagacgggaagcggggattacattggatgaatccttaaggaagacatatcacaaaagaaatacaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagctagccttattcctattttggtattttggatttcaggacttctagccccggttagtgaaggaccagagaagctttctagttatgaatcgggtatagaacccatggtgggggcttggttacaatttcgaatacgctattacatgtttgcgctagtt

SEQ ID NO: 24559 - DNA, 598 bp, Zea mays
  unsure at all n locations
  Clone ID: cC-zmle189063d02d1
acgcgtgcggattattagaataaattttaattccaaatatccaaacatggcctaaataaatactgaattggacattgtatttaaatagacaacagggaacatgagcatatcaccagacacacactagaactcataaaacagggatactatgctattagtctctcttaaatgcagtacatggaagcaaggtttatgatcagatttttgtataccagagaacactcaagtctcccaactgcccgcctgccgaggtgagctccgaatgcctgccctccacctctgatccgtgttgcggcttcgctcctgtgtggagcaagttaattttttttaacatgcatcaacatagatgtcgtccaattacgactgaagcaaaaaaatattgcaaggctaaacactcgggtcaattgctatgtctaggtaattagttttttgtttaagtttcatttagtctatatgtttggattttccccttgcctacagaccagcctaggtattcatcacttgtgaaaaacagaatatcagtggtgatggtaaaaaaagtatggatggctaaaagtctggctcatttcttgtanggtggatgtggcttcaccagcac

SEQ ID NO: 24560 - DNA, 567 bp, Zea mays
  Clone ID: cC-zmle189063d03d1
acgcgtgcgcaccgctcagcaacgagaggggcaaacaagcttgctactgtgatttgtcgtccgagcagcggcggaggagagagagagagcatggacgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctcctattcgaggtcatggagtaccatctcctcaccttggtgtgccactgtctcatcctctcgctggccatcctcttcctgtggtccaatgcctccactttcatcaacaagtccccaccgaacattcctgaggtcaaaatccctgatgatgtggctagtaatgttgccctgtcactgagatatgagatcaac

SEQ ID NO: 24561 - DNA, 556 bp, Zea mays
  Clone ID: cC-zmle189063d04d1
gttcatcagtgaggtcgccaccattggcaagatccaccatgtcaatgttgtgcgcctcattgggttttgctccgaggaaaatattagggcacttatctatgagttcatgcctcgtgggtctctcgacaagtacatcttctcatcagagaagagtttctcatgggacaaactcaatgagatcgctctgggcattgctagaggtctcaactacttgcatcacgggtgtgatatgcagattgtacacttcgacatcaagccacacaacatccttctcgacaacaactttgttccaaaagttgctgattttgggcttgccaagttgttcccaaaagatgacaatttcgtgccactgagcgctatgcggggaacgattggctatatagctccagagatggtatctcgaaactttggtgttatctctagcaaatccgatgtgtacagctttgggatgctactattggagatgacgggcgggcgaaggatcgcagatcctcatgcaggatgctccagtcaagcatactacccatccttggtgtacaggcagctattgccaggt

SEQ ID NO: 24562 - DNA, 535 bp, Zea mays
  Clone ID: cC-zmle189063d05d1
cccacgcgtccggggacagcatcatgctgtcacccccgctgatcttgactcccaatgaagtcgaagaaatcataagcaaattcggcgatgctctaaaggctacagaggaacggattggagaactgaaatccaggaagaattagccgatgctgctggttgtaacgacgacatgcaattgaaaatgataattgatcttttttatgggcgaagtgttgaagatggctttggtgaaggaaatgtctcgctagcatcaagtaagtggcagacatcacaacccctacaagcttgtgccttagaacaagaggatacaagaagttggagtgcttttgtgaaggcttttgcgaatcacttaaagcgttagtacttttgtgaatgattttgtaaagtgtttgcaaatatgtgcaaaacataataacatgtgtaggttgtgtgaatgattctgttgtggtgtctgctgatggttcatgtatgtggatctatcattgtgcaatactaactaaattagtatatctatgtgattatgtggataaaaatt

SEQ ID NO: 24563 - DNA, 319 bp, Zea mays
  Clone ID: cC-zmle189063d06d1
gggtcgatcccatcgcgtccggatgagtcggccttgtcagggacggtgaggagctacgagtcgtttacagagggcaggatggcggccgtgcacacgtccgtctcgacggggaccggtctggtgatgatggcctccgccttggactcggatggcacatccctgtccagaagcatcatgtcggagacgctccggagcctgcagtccatctacgagcaggagtccgccggcaccgtcagccgtcggcggaggagggtgcggttccatatcgacgaggaggagcggatcgagccgcaggtgagggacgagctgtccgacctcc

SEQ ID NO: 24564 - DNA, 534 bp, Zea mays
  Clone ID: cC-zmle189063d07d1
tcccgggtcgacccatcgcgtccgcggacacgtgggctgagaaggaacggctgaaggaaggtgaggctgctgatgaggagcagaagaaactgaagaaggatgcaaagaagaagggctccaaggattccactgctaagggtttgaagaagaaggctactactgctactggctctgatgaggatcactcatcctctccaactcgcagccatgatggtgacaaagcagctgcagatgatgatgacgatgatgtccagtggcagactgacacttcaattgaggctgcgaagcagcgcatgcaagagcagctgagtgcagcaaccgctgaaatggtgatgctgtcgactgaggagactgagaagaagatgaaacaggcaacccacacagatggaagcactaatggttcagccaaagaaatccctaatgacaagcctgccgtcactaagcctagctcctatgaagaactgatcggagacatcaaggctagcctatgaagtgctccgacccctacccagctcaaggctgtgctggccttat

SEQ ID NO: 24565 - DNA, 119 bp, Zea mays
  Clone ID: cC-zmle189018c10a1
taacgcggggagccttagagcggcgccctttttttgttttttttttttagtttcatcatggttactgggggggggagtgggattttaaagtatcctaccgcccaccccactagaccaaa

SEQ ID NO: 24566 - DNA, 491 bp, Zea mays
  Clone ID: cC-zmle189018c10d1
aaaaaaaaaaaaataaaaaaaaaaaaaaaaaaaaaaaaaaaattatatatataaaaaaaaaaataaaaatataatgaaaggagttattttttactttacaaccccctctttccctcttctttatatctccaccgcctttcttttcttttttttttttctccttctttttatatacttggcctcgcttcgctcttgccccttgcttgtgatttcttttcctgtctcttctttctctgcctgcgtgatttctccctttctccccctggggttcttttctttttcgcctcgcctcttttttccttttctatatatctccccttcggttgcctcctttggaatatctccccttttccttttttattcattcccgccccctttgctttttttctagcaactttgccctttttccttttctctcctgcccttatccccctcctctctgacttgttttaacctttgcctttttcccaccatttattcccgtttttttc

SEQ ID NO: 24567 - DNA, 365 bp, Zea mays
  Clone ID: cC-zmle189018c11a1
atatagaaaaaaacggttgggaacatttcatatattaactcacccacgtctaaactctaagaactaaatgttttatccatgaaatccttcacccatttgctattatagaaagtgtctaattctaaagaattaaagaacactcccttaaacccggttatataaaaagcataccgagacaaaaacggcaggggctctctcgcgtacataatattcagcggcaccacaaattgggacatgattcaaaaatgaaccacacaaactccctgtcccatgtcaagtacacttcaccactatatcagtgccgatcacatacatgcaattcatgcgcacttatgttgatacttgaagttattgtgtttcactac

SEQ ID NO: 24568 - DNA, 477 bp, Zea mays
  Clone ID: cC-zmle189018c11d1
attttgcatagcaccatccaggtcctgtccgaagatagatatcttgttggtagtatgggtgttcgaggacgggatcgtgcgcgctgccagacagataccgcgacatgtgggcgctccccatcggcgtccaggacgaacacggatgttatgcgcacgttcccactacagaggtggcgacgttaaaggacactatcgagcggaagttactgaaggtacggtgggagagctacgttttcaaagacgggatgctacagaatcacgcagttggtccactggagcacctgatcaaaggacgggatgacggtttcctgcgaatgctcgttcacatgaaccacgtgttgaagatgacatgaaacgtttgctatgggcctgacggctcgcctgctagtatgtctgggggagcacccatgatgttggtgacggcgcatgaccttggtgctggataaccagaccagctatttgtggagctctatattc

SEQ ID NO: 24569 - DNA, 541 bp, Zea mays
  Clone ID: cC-zmle189018c12d1
ctcactctccgctggtcgctcactcttgcagctccacccttcactcagtcttagtctcttattagctctagggtctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgacgaggaggctgctgctgctcctcctgctggtgccgaggagcccgccgcggccgagcctgtcgccgaggcagaggctgctgctcccgaggagctcgccgcggac

SEQ ID NO: 24570 - DNA, 477 bp, Zea mays
  Clone ID: cC-zmle189018d01d1
ccgtccggaagtctactcacctgatgtatctctggagagctttgcctttcttggaatttgttctcttatcaggtgaggggctttgggattacataaaaagctcttaaactgtatcttttgtcagaaaacaacttcgtcagcatggtgattgttcaattggtctgccaggcacttggtcataaagctctggatcaacggtcccaagacaattttagcatagtcatatctgacttggggaggacaaactggaaggcgttgcccgatgaaaagccgaacttgttcttggaactaatccaagcagtcgcgactgtaggggttgtctcaataagaatttgggtctccttcctcctttggttacagtaaaaatagcttcttccttccgctgtgtatattacctactggtttacatttttcttctttccggtacaactgcaaaatgtatgttttattcgatatattgtgtgaattgatacggtc

SEQ ID NO: 24571 - DNA, 231 bp, Zea mays
  Clone ID: cC-zmle189018d02a1
acctttaaataaaattaaacataaattatttaatataaataaaaaatcaacaagggactgagggaggaaaaataaaattaaaaacacagaaaacctaaatattaccaagcaaaagggatgaaaaaatatagactgaaaagagaaacaagaatgaaaaatataatgaaattcggcgaagtttatattgagaaaacataaaaatgaagggggggagaaaataaagaaaccaaa

SEQ ID NO: 24572 - DNA, 544 bp, Zea mays
  unsure at all n locations
  Clone ID: cC-zmle189018d02d1
cccacgctccggctaaagcttatgaaagttgatggtttgactatatatcatgtcaaaagccacctgcagaagtgccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaagagacatcgcacggactgcagaactgggagaacagttcgtctgacctaggtgtaaaacaaaanactcgtagagatcgaatctggtacncgaagtagccacaggcgacagatttaagatct

SEQ ID NO: 24573 - DNA, 427 bp, Zea mays
  Clone ID: cC-zmle189018d03a1
ttttgacaagataattggacacccgtcgaatttattctaaggcacagcttgctgacgaattgaattaagttcacagacgcctcggtcggatttattctcaggcacaacatcccgaggaactgattcaagttcacggacgcctttgtctaatttggcacaactccgtgtggagtttattcaagttcacagaggtctccttgagagcacacacaaaaaaaaaatctatcactctacccaacaaacatagcaactcacaacccgagtctttctttttccatttctcggcttatctggattcccttcgtcatataattaatcccgtggccaaaattgtgctgcgagcctgtgatttatttcaacgaaagcgaaaattttatgcggttgacggggacttttcccacttatttcacttcctctttcaatttgt

SEQ ID NO: 24574 - DNA, 328 bp, Zea mays
  Clone ID: cC-zmle189018d03d1
gattcggagtctgtggttgtgaggataactggatgccctaatggatgcgctagaccatatatggcagagcttggtttcgttggtgatggcccaaaaagttaccagatctggctgggtggaacaccaaaccagagtacgctagcagaatcatttatggacaaggtgaagcttgatgacatcgagaaggttttggagcctctctttacctattggaatggcacacgccaggaaggcgaatcttttggaagcttcacaaaccgaccaggattcgacaaattgaaaaaggtgtggattaatgggccaaatcaaccgccggccgattgaaaat

SEQ ID NO: 24575 - DNA, 410 bp, Zea mays
  Clone ID: cC-zmle189018d04a1
aatataataatatggaatccatcgataagaaaccaacaaaatcgaactcctgacatattacacaagctgtggctagttcagcactccatttgcaagctgttttgataatatcattacctacaagagcaagatcgcgccctacgtatacgagctagtacacaggcttttaaagccaaacgattagctgctgcaccaggtgcatttccccaaggaagtcctaaagtacctccaccaaattgtaatacggaatcatctccaaagatttcggtcagagctggcatatgccaaaaaagaatacccccagaagccaccggtataacacctggcatggatacccaaacctgagtgaaaaagaaaccgggagaaagatctttttcaaaaaaatcattgggcaataaattaacaaaacc

SEQ ID NO: 24576 - DNA, 100 bp, Zea mays
  Clone ID: cC-zmle189018d05a1
aatatctatactatttattattttaatgaaggataatcatataaaattaagagggtggaaaataaagctagataaaatgaactattacttatttatacat

SEQ ID NO: 24577 - DNA, 343 bp, Zea mays
  Clone ID: cC-zmle189018d05d1
ctcaaacaccaattgcaaaatctgaagatgctgtccaagtctttctcccttctcgcttttggcgccttggcctatggccaggagctggtccaagagggcgctccagcacctgtcgtcctcgcaaccgcaaagtctggtgtcatccccgcgaccccaacagctacacctttcacgggcgtcgataccatccagggtgccattgtctctcctctccctcctgcgccaggctaccttccaggtgagacgggagggctcaagggtaccgcagcagcctcttccaaccagccttcagctacgtaccgtgcaaccatgcctgaggagcaatacaaacccttcgttggca

SEQ ID NO: 24578 - DNA, 68 bp, Zea mays
  Clone ID: cC-zmle189018d06a1
ctatttcatttttgttgtattgtttattgtaattgttatttctaaatttgatggttggggaggcattc

SEQ ID NO: 24579 - DNA, 294 bp, Zea mays
  Clone ID: cC-zmle189018d06d1
cttaacccaacacatgatcttagtgagaaccagttgtttagtgtccataatacattgcaggttgctctactcgtgcttgctttagtgtgtgtaccttggatgttgattccaaaacctcttcttttgaagaaacaacatcagcacatgcatcaaggtcaccagtacgctatgcttcagggcattgatgaatcagtgggagcagaaacgggggaacatcatgaggacgcacatgaccacgacgagcttgagttccgtgaagctcttgttcaccacctgattcacacgatataattt

SEQ ID NO: 24580 - DNA, 715 bp, Zea mays
  unsure at all n locations
  Clone ID: cC-zmle189018d09a1
aaaaaaaaaaagaaaaaaaaaaaaanaagaaaaaaaagaaaaaaaagaaaaaaanaaaaaaaaaaaaaaaaaanaaagaaaaaaaagaaataaaaaaaaaaagaaaaaaagaaaaaagaaaaaaaaaaaaaaggaaaaaagaaaagangaaaaaaagaaaaggagaaagaaaaaaagaaaaaaaggaaaagaaagaaaaaaaagaaaaaaagaaaaangaangaaaaagaaaaaaaaaagaaagagaaaaagaagaagagaaggaagaaaaaaaaaaaagaaaaagaagaaagaaagaaagaaaaaagaaagaaaaaaantaaaaagaaaaaaaaaaaaaaaatagaataaaaaaaaaaagagaaaagaaaaaagaaaaaaaaaaaagtaaaaagaaaaaaaaaaaaaaaaagaaanaataaaaaaatatataaaaaaaaaaaaaaaaaaaaataaaaataataaaaaaataaaaaattaaaaaaaaaaaaaaaataaaaataaaaataataaaaaaaaaaaataaaaaatataaagaaaaaattaaaaaataaatatatataaaataaaaattaaaaaaaaaaaatacaaaaaaaaaataaaataaaaaagaaataaaaaaaaaatataaatgaataaaataaaaatataaaaaaaaaaaaaaaaaaaaaaataaaataaaaaaaagataaaatataaaaaaaaatattataat

SEQ ID NO: 24581 - DNA, 122 bp, Zea mays
  Clone ID: cC-zmle189018d09d1
tcccgggtcgtcccacgcgtccgttcttctcacggcaggaatcggctccgatcatattgatcttccagcagctgctgctgccggcttaactgtggctggggtcacttgaaagcaccactgtc

SEQ ID NO: 24582 - DNA, 368 bp, Zea mays
  Clone ID: cC-zmle189018d10a1
ttttactttccttttcattcgatccaaaaaaaacataggggcaaggactatcactcatatcctcatccatatctatcctatttccaaaaccaatattccatttttaccttcttaatccacatatatcccttattagatggctcacaaaactcttataaacacaaaaaccctatctttccaatataccattcctccttaccattttcttctttcaccatactcttgcaatcatttcattttgctaccttcttctacctgtcctaaaaaatacagctatcacctgatcttttcattttttggtttctctttctttactacatcattctcttctgcagccaccccatttattgaagcccctcccccttttt

SEQ ID NO: 24583 - DNA, 521 bp, Zea mays
  Clone ID: cC-zmle189018d10d1
aaggcggatggtcgaaagatttggattcagtaagaagatcggtcaagttgcgatcggaggaccggatggaaaccctggcttggggcaacagatgtcaagccagaaggactactctatgggaacagcggatgttgtggacgccgaggtgagggaactcgtggagaaggcctactctagagcaaggcagatgatcaccacgcacatagacatccttcacaagctcgcccagctcctgatcgagaaggagaccgcggacggcgaggagttcatgagcttgttcattgacggccaggccgagctgtttgtcgcttgagatgtcacaaggcttgcggtgcgtatgcttttcggtgttttgtgtcacagcgagcaatcacaaagcaatggagagcccagcttgtaggaaccacatcgatgtatagtagatgatacgcatgtactgactaatttgagcaagtaaaatgttactgctcacaagtatagcacacggttcatatgtgaaaacaaatatgctcatctcgcct

SEQ ID NO: 24584 - DNA, 543 bp, Zea mays
  Clone ID: cC-zmle189018d11a1
ggttggggtttttttcataaaaaaaaaaaatttttttaaaaaaaaatcccttttttttaccccaaaggacacaaaattgaaaaaccccccttgaccttttggaaaaaataaaatcccgtggagttttttttataatcccccataaccgccgggggaaacatcgttttggtcctctttttaatcagctttgcgggggaatccaaattcttcccttttttcccccggaaagattcctaaccattggtcatttaggttgcacccccttcctccaaaaattgggggtttttgaaccatgaacccaaatcttaaggggggggttataaaaaaaaaaagggttgtttttttaacccctttccttgaagggttttctcccacaaaacccaaaaaattccggttgataggacccccacaattaattcccaccccttttcttggttaaaaaaaaaactttggtcaacccccctccttttttttccccctttaaaaaggaaaacccttttttttccccaccccccaaaacaaacacaacccccaagttatttt

SEQ ID NO: 24585 - DNA, 600 bp, Zea mays
  unsure at all n locations
  Clone ID: cC-zmle189018d11d1
gtttcgtttaaaggacttctttttgtacctgggaccctcccaagcgattctttcaacaaatacggaacatcaaatgaccacatcaaactttttgtccgacgagttttcatcacagatgaattcaacgacctccttcctaaatatttaagtttccttcaaggaattgtcgattcggacgacctccctcttaacgtcagtcgggaaactttgcagcaacataaacttctcaaagtcatcaagaagaaattagtaagaaaagcgctggatatgattaagaaattgggtaaagaagaaatggaaaaattctggaaggaatattccacgaatattaagcttggtgtgattgaagatccagcgaataggacgagattggcgaaacttctgatgtttttatcttctaaagagaataaaatgacatctctggctgattatgtttcaagaatgaaaccgaaacaagaacacatctattatgtggccggatcttcaaaagaagaagttcanaaatcaccttttgtggaaaggttaatcaaaaagggatatgaagttatctatttggttgaagcagtcgatgaatatgcgatatcatctttgccccgatac

SEQ ID NO: 24586 - DNA, 408 bp, Zea mays
  Clone ID: cC-zmle189018e01a1
ttttacatcactcttgaatgattacaagttaaacataccacaaaactgtcaagagtaatagtcaacaaatttatcctatattaagaagaaactcacagtagctgatgtgaaaactcatatttcctattgcagttgggcacagaactttgttaaacagaaaaagtctacttgccaatataccattcaacccttgattttgcggggaccacaatttggcttgttatcattcaagcagcaaagcttcttcagcctgagctaaaaattagagcagagagcagagcatcacatcttgtggcactatcctcggactcatcatgctgatctgtagcactgccattaggtaaagcacctgcaccttttcggttgacgtccgttgaagggtctcttccttgatgaggatggttaaaa

SEQ ID NO: 24587 - DNA, 197 bp, Zea mays
  Clone ID: cC-zmle189018e01d1
gactccaaggctaaaacggttaacctccgaagcatacaccatagaagatcgaaccgagcacctaaggatggggctgttccatctccactgtatcgtcaacacaatttgagtacaccaaatcagctgcccgacccatgatcatgacgcactattcatgccattttgtatatgaacaatgtcgcgcacctgcttaagtg

SEQ ID NO: 24588 - DNA, 141 bp, Zea mays
  Clone ID: cC-zmle189018e02d1
cctaattttaccacccgtccgcctcccgtcctcaatactctctctcctgcacaccacacattttggccttcaagtcgcgctacacaattccggagtccgggtgctctccaaacacgctcacatactctcccatgatctata

SEQ ID NO: 24589 - DNA, 411 bp, Zea mays
  Clone ID: cC-zmle189018e03a1
tttgcagagaacatggcttaacatctaacgagtatcccctttttacactggatacaacatagtacaagtacaccatgcatcgcactcgcaccacgagcattccatgattagacagtctactaagcagcccttccccaccaaaaaaaaggtgaggttatatatttatcggccatcaacctgacgacgcatgtgtggtagcactcctcaaaatgctaataataaggtcaactcctcattttgggggtgaaggcctggatgatggtggcgtggccagtgtctgtgaggtgggacaagaggttgtttatggggacggtgcccgtgtacttggtctggatccacccgctcctgaccgcgaacatggcgaggcgttcgttcttgatctccttggtgggcagctccttgatctttttc

SEQ ID NO: 24590 - DNA, 371 bp, Zea mays
  Clone ID: cC-zmle189018e03d1
gccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctga

SEQ ID NO: 24591 - DNA, 259 bp, Zea mays
  Clone ID: cC-zmle189018e04a1
ttctacgaaaatttcaggcagacgaatcaatgatcagggggtacgaaacctaccggtgatcagaacataacaataatgtatgtatgtaaccaggaagacgataagaattcgtaacatcgatcttcattacctgtacagagctacaacgagcctactaaacatgtacgtaccgacgacagcggtgggcagggagcaaagtattagacctagcgcgcgtgcatggcttcgctcctaaacgacgcgatggtggattaagcgt

SEQ ID NO: 24592 - DNA, 542 bp, Zea mays
  unsure at all n locations
  Clone ID: cC-zmle189018e04d1
gaattgtgatgtgacattggaagccaatccgccagtgccaaacgcaaaaaacttatctagggcgacagtgatggttacttgcacgattgtgcatacacatatagggtttatttggaatacataatagactcgattaattaaaattttattttttctaataaattttacttatcgattagtctctattttatttgctagaccatagttagctaatacttaggctttttatttggcttccaagacttgacctaaataaatccaagcgtcgtcgttgatactgtcaaaggattactcctgtggtagtttatatatagataatggtttgatggtttcttgagtccaaatcaactattagtaccggctctcaagtctgaactgctcccaatgctctgaccgttgcattattgnggcatgaatttttcgttcctagcacacatgcctacatttcaacgctctggtgcgctttcacgggctttttatggttgcaaaactcaaacatctcacgatgctgctccatttggaataatncatcagcaattaaa

SEQ ID NO: 24593 - DNA, 347 bp, Zea mays
  Clone ID: cC-zmle189018e05a1
ctattgtagaaaggggctttcttatttcggggaagccacaaacatcaaacaaaaaactttatttttgaactttaactcaaaaaaaaactaaaagaggcccccccccattatggggtgtaggaaccaatgttttgggtttgtcaaaacaagttggtctaatggcaccatttgtttcattttttaaagggtgccctcttaaggtccaccgttctgttaaaacggcaacaactggggttgtgataaaaaggtatcaggcctcaccccatcttacttgttcaatggataaacttgttgctccttaaaaaaactggaaaacttccatgccctccattgggtgaaaggaaaaa

SEQ ID NO: 24594 - DNA, 585 bp, Zea mays
  unsure at all n locations
  Clone ID: cC-zmle189018e05d1
gagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacnacttgtgctagcaaaccttgctgcctactctcagcacagcaagttcttccattcaaccactagctgcattgaactctgcttcttatttgcaacaacaacaactaccattcagccagctatctgctgcctaccccagcaanttctccattcaccaactgacagcattgactctctgcttattacagcagcacaactactaccattcagccgctgctggtgtgagccctgctaccttctgaca

SEQ ID NO: 24595 - DNA, 149 bp, Zea mays
  Clone ID: cC-zmle189018e06a1
attattatatttttatttttttgatcacagaaaaaattcttttagggggggagggggacgcacaaacaacatgttattaaaaaaaatccaataaagctcatttgaaagggaaaaggaaatgtgatggaggaacattcaaaaaataaaaa

SEQ ID NO: 24596 - DNA, 489 bp, Zea mays
  unsure at all n locations
  Clone ID: cC-zmle189018e06d1
gcagcaagcagtggcatgtctagtctagacatcattacatcgtcatggcatcgtcgtcagtacaatacatcatcatggcagctcgccatatatggatgaatcattattatatatatattctgaatgagctgcagcacgtacgcatgcatggactttgctcgatcatattgggtaagtcggatcatcgatcgaatccacttcacttttttgcttggcacttattttgatgttcatttggggggtgtactacggttatggtcatttcagttcttatatataaacttcattcattcaagaggtacggtgcaatatatatatgggaatggttttgctattatttatatatcatagtcaacaatccatgttcttagccagaatatatngcatctgttgtagtcagtatgtagctactaaatctgtagccttcgagctaatttgtacgagaagcttactaccgactacgtacgtactcagtttcaagtttcctct

SEQ ID NO: 24597 - DNA, 454 bp, Zea mays
  Clone ID: cC-zmle189018e07d1
gccccacgcgtccggtgccaattcctatccctgatccccgtaccgcagcgtaaactctagctccccgcatggaccttgggggctgcgatgagctctgactggagcgcgtccagacgaggagctggcgcggccagcaccaatctaccatggctacccggatacagtgagagatcaaccgcgaaaccggtgttttctccaccctgacaaaagcttactgtctggtagcgattggagggtcagagaacttctacagtgcctttgaggctgagcttgcagatgccatccctgtggccaagacctctattggtggcactacaataataggccgactttgtgttggaaacaagaatggacttctattgccacatactacaaccgaccaagagcttcagcatctgacgaattgcttgcctgatcaagcggtgcgataccgcattgatgagaggggatctgc

SEQ ID NO: 24598 - DNA, 458 bp, Zea mays
  unsure at all n locations
  Clone ID: cC-zmle189018e08a1
aaaaaaaaaaaaaaaaaaaaaanaaaagaaatagaaaaaaaaaaaaagaaagaaaaagaaggagggagagggaaaaaaaagaagagaaagaaaaaaagaagagaaaagagagagaaaagaaaaaaagaaaaaaaaaaggaaaaagaaagaaaaaaaaaagaaaagagaaaagaaaagaaaaaagagaaagaaaaaaagagaaaagaaaaagaaaaagaaaaaaaaaaagaaaaaaaaaaagaagagaaaaagagaaaaaaaaaaagaaaaaagaaaaaaaaaaagaaaaaaaaaaaaaagaaaanaagagagaaaaagaaaagaaaaaaaaaaaagaaaagaaaaaaaaaaagaaaggaaaagaaaaaagaaaaggaaaaaaaaggaagaaaaagaaaaaaagaaaagaagaggaanggaanaaaagaaaaaaaaaaaagagaagaagagagaggaag

SEQ ID NO: 24599 - DNA, 503 bp, Zea mays
  Clone ID: cC-zmle189018e08d1
gcctcccccgtccggtccctgcctctgaagaaagtcaacaggtgcctgttttcctgtttgcgaaggatgttgacaaaaggggtgggggtgattacacctaccatggtctatagaataagcttgaaagtttcccacctggagctttattgttgggtcccagattcagacatatgctcggaaagataagtcaaacaatgggtctccttggctcaagttctcatacagccaagcagcaatacttgaccttgcatttcagcttaatcgaaggtgtattacaacgtaattaattaaccaggagctttctgatgccacgggaaccagaagaccatatcgtccaagttaatattgctgccagcaatttatgaagcgcatccgagggacttgtatttattttatgtaaagtttaatggaatacttgttcctctatttattttgtgtacttagtacactggcatgcccgtattttttttctcccacgtgaaaaagatgtttgtaattttctc

SEQ ID NO: 24600 - DNA, 152 bp, Zea mays
  Clone ID: cC-zmle189018e09a1
ttttggggcatgagcataggctccttcattattgttagggaacgggtacacatacaacagggtgttaatcttttttaaacacagggtgaaaatttgacatagctacatattcacagaataaatatttgttctttaccctagcctataaattt

SEQ ID NO: 24601 - DNA, 341 bp, Zea mays
  Clone ID: cC-zmle189018e09d1
cggacgcgtgggaaaaaagaggaccataaggcgaggaccctgatgagtgggacgcaccggacaaggggcggccggagcggtggatgcgcggtagtccctcggtggactccagaggttccgactaccatctcatcccgttcggcgacctgccggaggatctgtcccggcatgaactactggctgacggtcttggagctcgcgcttgtcagccttgtgcaccacttcccttgggagctccccgccggtgtgggaaaagcggacctcgacgtgggctacgcgccggtgatgacgacgactgggcagagttcgctcctccttgtccccaaattcaggacgctcgt

SEQ ID NO: 24602 - DNA, 602 bp, Zea mays
  unsure at all n locations
  Clone ID: cC-zmle189018e10d1
gcccacgcgnncnancgactacaaggtggagatggtgaacgacgggatgcaggaattcttcgtcgaattcaagggcccggccgaaagtatctaccaaggtggtgtctggaaggttcgggtagaactgcctgatgcatacccttacaaatccccgtccatcggcttcatcaacaagatttatcacccgaatgtcgatgagatgtctggctctgtctgtttggatgtcataaaccagacatggagcccaatgtttgatctagtaaatgtttttgaagtattccttccacagctgttgctgtacccaaatccttctgatccattaaatggggaggctgcagcactgatgatgcgtgatcggcctgtttatgaacagaaagtgaaagaatattgtgaaaagtatgctaaaccagaggacgctggcatcaccccggaagacaagtccagtgacgaagagcttagcgatgacgacgacgacgacaacgactccggngacgaagctatacttggcaatcctgatccttagtctgagtaggaaacagcgcagtcagctcatcatacattgtccattgcagaanactgcagtaacaaaactgaaaactaaa

SEQ ID NO: 24603 - DNA, 312 bp, Zea mays
  Clone ID: cC-zmle189018e11a1
caacacgatgcttataataggtggattgggacacggtacaggggggaagtcgaataaaaataaaagcgacatttattctttgggcattatatcacagtgcattgcccggcaggaaacacagttacagtattattccatgcacacttgacagaaacgcaaacagagacgacggtacggtgtattagttgtccatggcgacgccaggcatttggaaagggtcgtcgtcctggttgagctgctgcttgagcatccacttcttgaaggggtggaagaggatctccttggagcaggtgtactgctgcggcgcggggc

SEQ ID NO: 24604 - DNA, 601 bp, Zea mays
  unsure at all n locations
  Clone ID: cC-zmle189018e11d1
gggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgctnttatttttattcgacttcccccctgtcccgtgtggaaaataaacctatataagcatc

SEQ ID NO: 24605 - DNA, 164 bp, Zea mays
  Clone ID: cC-zmle189018f01a1
ggacagggaagacaattattccttgtcgattgaacaatagtttacatcatgggacaaaccgaaaaccagcgtgcgcttacatgcatccggacacctaaagggcaccgggggcgccttcctaacttggcggggacaaaattggtggtgtaggcccaaacgttttt

SEQ ID NO: 24606 - DNA, 574 bp, Zea mays
  unsure at all n locations
  Clone ID: cC-zmle189018f01d1
tcgatctgcaagtctcgctacgtagcagtgcaataaaaaaaagcagccgcaatggcgagcagcaccatggccctgtcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggagggtgatccactcccgctgggccatgctgggcgcgctcggatgcgtcttcccggagcttctcgcccgcaacggcgtcaagttcggcaggccgtgtggttcaaggccggctcccagatcttcagcgagggcgggctggactacctcgggaacccgagcctcatccacgcgcagagcatncttgccatctgggcctgccaggtcgtgctcatggcgccgtcgagggcta

SEQ ID NO: 24607 - DNA, 525 bp, Zea mays
  Clone ID: cC-zmle189018f02d1
cccacgcgtcccccagatcattttaggtattgcaagaggcctaacctatcttcatgaggagtccagcgtgcgcatcgtgcatagggacatcaaggccagcaatgttctacttgaccaccacctcacgcccaagaattccgatttcgggcttgccaagctctttgatgagaagaagactcatgtcagcactaaaatcgcaggcacgtttggctacctggcgcctgagtatgcaatgagaggccatctgactgaaaaggccgacgtcttcgccttcggggtattggcaatggagactgtcgcaggtcgaccaaacactgacaattccttggaggaacacaggatctatctctttgagtgggcctgggagctgtactagagggaccaagcacttggcattctggacgcaaggatcgaagaatccgacggtgaagacgcagtcatcagagtcatcaatgttgcgctcctctgcacgcatggttcgcctcaccagcggccaccgatgtcgcgtgtagtgaagatgctcac

SEQ ID NO: 24608 - DNA, 271 bp, Zea mays
  Clone ID: cC-zmle189018f03d1
cggacgcgtgggattcacgggttctaagggacctgtaaatgcttgtgccctatattgtgtgcctccacatattggggagcttgaagcatcgacagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctataag

SEQ ID NO: 24609 - DNA, 526 bp, Zea mays
  Clone ID: cC-zmle189018f04d1
acccgtccggagacgaaataggaccgcgaaatgcatatgctttcggaacccgtgcgcgagcggaaccaaagcaccagaccagggagggcctgctgtcgttcctgtaccgggccatccattacctcgccaggggaggacagtcgaccatcggcaaccccttcttccgcgacgactcgccgccggagtcgccgctggcggagcactactacgtacgcctcgccgacggcgccgacatgccggccttcctctcctccgcggcgcgcgggtactacgaccgcgggtgagagcccggccggaccaggaacgacgctgggcctgtgcgtgcgagcaggaagaatcctcgtgtgctccttcagttgcgtgttcagagtgctgggtctcctcccctcttcttgtggctttttggagaatatactcccccttcccctcctttgctccttggaataaaagcatggatggatgatgttcagccattcagggggccgcgtcgttttctttcattgtataaagccatatatgacgtgat

SEQ ID NO: 24610 - DNA, 497 bp, Zea mays
  Clone ID: cC-zmle189018f06d1
acgcgtccgcccacgggtacgaattcttatcccctaccccctcaccgtatttttaaccttagggcccggcggtgaccttgggggctggggtgcgctctgactggtgcgcgtttagacgaggagctgtggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaaggggcggttcaccgcattgatgagaggttatctgtccttgggatttgcatagcccgctatggccatgttgcactta

SEQ ID NO: 24611 - DNA, 412 bp, Zea mays
  Clone ID: cC-zmle189018f07a1
aaccattgatgatatgaatgggtatggaaccaaataaaaaatatatagggtccactttatgaatctaccgcaatccacaacgatccatgcagttaaatactagcgacttacatattaaacgttcccaacccccatggacttccaagtttttagcaaaatcaagcccggaccaaaccataccgaacaccttgagactccttcaactaggcccgggcccaaatgatagcaatcgtttttcatgggttaagggcaccaaacttccactggacgctgacagacaaactttttcagttctaggcgattcttgttgcatttgcaaccacacccactactttattgggggttggtcggttttggtttaaaccctttgccataatcaggggacttatactagccactttccttaaatttg

SEQ ID NO: 24612 - DNA, 431 bp, Zea mays
  Clone ID: cC-zmle189018f07d1
cccacgcgtccgccaatggaaggaacggggcacgggcgctgtcaagcttctcaagcacaagcagaccggcaaggtccgcctagtcatgcgccaggctaaaacgcttaagatctgcgcgaaccacctcgtggcctccaccacgaagatgcaggagcatgcgggcagcgacaagtcgtgtgtttggcacgctgctgactttgccgatggcgaacttaaggaggagatgtttgccatcaggtttggttcggtagaaaactgcaagaagttcaaggagttggttgaggagatagctgagtcgcttacaaagaacgagggcaaggaaggtgaagatgggtggttccacggctggattgctggcgaagctcactgtgagcgagggcaaatctgagggagtggcaagtctgagtccactgattctgcaaaagtgactg

SEQ ID NO: 24613 - DNA, 57 bp, Zea mays
  unsure at all n locations
  Clone ID: cC-zmle189018f08a1
aaaaaaaaaanggaaaaaaannaaanaaaaaaaaaaaaaaaaaaaaaaatatataag

SEQ ID NO: 24614 - DNA, 483 bp, Zea mays
  Clone ID: cC-zmle189018f08d1
taggccgtatgagggagcgttctttttcccttcctccgtctcccgtcgcctcgccgggcgcggcgtctgtcgtccctctgcgctcattgacagccaatttcaaatgctggcttatctactttttatctaagagaaatgtttgagcatctttttgaggacaccttcttcgttcactagactctaccctgatggcaaaaagtttgatagagattctttagttttagctcgcactgagcaacatgatatttctattcagctagatgttgccacagatgtttatcctatgcatgctggcgagaaatttaacatgggtatagcgcctactctgaatgtggatggcaccccaaatactggcttctatactcaggctggcagagaaactctggcagacatttattattacctcatgcaagggaagcttttccaaatctcagaagacacatcattcagccaaacgcttaagaggagatgtattcattgttc

SEQ ID NO: 24615 - DNA, 299 bp, Zea mays
  Clone ID: cC-zmle189018f09a1
ggggtaggggttttttttataaaggaaaaaaaaaaatattggggggtgtattaaattaactgtttataaaaaaaaatttggagtaaaacttgtttaaataaaaggataaaaatattttgaaggggggggtaaccgtggaattacggaatgggacttttaaggggtaaaaatttttcattttgtaagacttatttaagcttgggggaaaaatgggatatattggttcatggaggaaaaaggtaagctgataaaaaattcaaaaaaaataatgaattggagagattaattttaaacctggg

SEQ ID NO: 24616 - DNA, 97 bp, Zea mays
  Clone ID: cC-zmle189018f09d1
aattattttgctcatttatgtaagcagttgaactgcaaaatcttctttctaggcagttactgtaatacgacacgcaatatttgtttttatccataat

SEQ ID NO: 24617 - DNA, 604 bp, Zea mays
  Clone ID: cC-zmle189018f10d1
attctcgggttgacccacgcgtacgcggacgcgtgggcggaggacgtgcatacctgaacgctggacattccacatgctgccatgcgagaagccagatgggaagggcggtgaggccgccaccatggagcattttgtagggacgcttggcaggatcggtaggcgtctgttgcaggaaggcactgctggggctgagcaatgccagaagaagggaaaagttccacttttgtcccttgaagccatacatcagctgcacattttcatatttgttctggcaatcacacatgttattttcagcgtcacaactatgcttttaggaggtgcacagatacaccaatggaaacagtgggagaatggaattaaaaaagatgctcctggaaatgggcctaaggtaaccaatgtacatcatcatgaatttatcaagaaacgttttaagggtattggcaaagattctataatattgagttggctgcattcttttggtaagcagttttatagatcagtatctaaatcagattacaccacaatgcgtcttggttttatcatgactcactgccctggaaaaccaaaatttgatttccatagatacattgtaagggttttagag

SEQ ID NO: 24618 - DNA, 339 bp, Zea mays
  Clone ID: cC-zmle189018f11a1
catactgtcttttttttttgtgggcggggtcaactaggattttcattgcgcaacataactgtgttaaagttgagacatatttttacacttttgttgtatacaataacacaatatttagctttgtctcatacccaaacatgataacgatgaggggcttcacgctgaattggtaaacccggaagcattactttctggtcccttgaaaaaattttcgggggaaatcactcccgcaggggtcgataaagaaccccattggtgtttgggtttttccttgggcctgaatcttgaataccacctttgttgccccacctttttttaacactgtaagagcccacattg

SEQ ID NO: 24619 - DNA, 521 bp, Zea mays
  unsure at all n locations
  Clone ID: cC-zmle189018f11d1
cttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggncacaagcagaagaggaggccaagatg

SEQ ID NO: 24620 - DNA, 606 bp, Zea mays
  unsure at all n locations
  Clone ID: cC-zmle189018f12d1
cccacgcgtccgcggacgcgtggggccaaccatctaccagcgactcagcgagcgagagcagcacacacgcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttctttgcgatcgtcgtgtanaatcagggtgtctgtctataatctagcctccatggatgctcaaccttcgtcatgtaacaataatcagtgctactct

SEQ ID NO: 24621 - DNA, 313 bp, Zea mays
  Clone ID: cC-zmle189018g01a1
tttatttttatttttttttttattttattatttttaatttggataggttttcatctatttattttatactcactcataatactctcaaaaactctaatttcttcgcatcacactagcctttttccccctcttcccacacaaacaaaacaacaatatcactccttttgtaatcctcacccctcccaaaaaaaataatactccttatgaaaaaaaaccacccccgggcggataatattttcttcctaaaccacacaaagcataaccaccccaatatttttaaataaaaccccccccctagccgcgttgtgtttat

SEQ ID NO: 24622 - DNA, 469 bp, Zea mays
  Clone ID: cC-zmle189018g01d1
gtaatctcgtcacctgatgtatctctggtagagcttggaccagacgtggaatttgttctgttagcaactgatggtctttgggattacataaaaagctctgaagctgtagcttttgtcagagaacaactccgtcagcatggtgatgtccagttggcctgcgaggcacttggtcagaaagctctggatcaacggtcccaagacaatattagcatagtcatagctgacttggggaggacaaactggaaggcgttgcccgatgaaaggccgaacttgttcttggaactaagtcaagcagtcgcgactggtaggggttgtctcaataggaatttgggtctcgtcgttccttgggttacagtagaactagctactccgccggatgtgtatattacctactgagtttacatctttctgctagcagtagcagctgcaaatgtatgtatattcgatatatagtgtgaattgatagggt

SEQ ID NO: 24623 - DNA, 315 bp, Zea mays
  Clone ID: cC-zmle189018g02d1
cccacgcgtccggtcctttgtgttcccttattcgttacaaaaaaaaatggccgatgctgtgcaaatggaacacgggctcttcagacagttgctgctttgagggtgagaaaatctgaaatctgattcgtgtagaaatctggctggatcgagttgtcggggctctgaagcgtctgcagggaagtcacgcctgagagaacgaggagagtcttgcatcctccattctgaccaaacaggatatcggtatccaatcgggcccccaccatgcatatctgggacgttgtgattccgaacttctttgccaggtagtccatcatg

SEQ ID NO: 24624 - DNA, 454 bp, Zea mays
  Clone ID: cC-zmle189018g03d1
tctggggtctacccacgcgtcccgcgtccgcccacgcgtccgcccacgacgaccggaagatctcatgggaacactccaccatatatgggatagatgggatgggcgggtgatggcacctacagacccccgactggcttgagtgcctcaacgctcacacagtcggctagacctatcatttatggacaatgagaagcttggagacatctaaaaggttttggagcctgtctttacctattggaagggcacacgccaagagcgcgaatcttttcgaagcttcacaaaccgaacgggatctgaacaattgcaagaagtggtgaatgagtggagcatagccaccgtaacccgtccgaagatttctctttctttggataaaatcccaggctcgcaacacaattttggccacgggagtaaatatgtgacgagacgaaaaacgcattagccgagaaatgggaaa

SEQ ID NO: 24625 - DNA, 417 bp, Zea mays
  Clone ID: cC-zmle189018g04d1
ccaagaccggcagggattcacaggaggcccttgctccactggttgatgttgcgctcaagctctccaagatgcaagagtacactggccgctctgcccccaccgttatcacataaatttttgaagagtgatttacaatgagttgaggcgcttacacaaattttcattcaagcctcttgttctatagttctacttcctgttgcatctcaccaatgaataaaatgtatgtatcagactcgccccgttttttttttgtccatgtactgcagtgcaacggactgagccgctggcacagcatgcggcaataatcttgtcacagtgacagtgctgtaatcgggagcgtgattcttgtaatcttgtaggaagtgtttctggctttagctgagcatttgcttatctttttttctgagtgctaaaaat

SEQ ID NO: 24626 - DNA, 331 bp, Zea mays
  Clone ID: cC-zmle189018g05a1
ttttaacgcagataaacacaaactcatgcattttaatattaaatggggcacgagacggacatgaccgcgagcacgtgacacagatgaacatgaaccctaggagcgaccatggatcgataatggtgggtgcagttgataggatctttattagacgctgctataaattattattattcgcctcgtcgtggtttgtctcttgactctcgtgctccatcgccgggccgggcgggccggtttatttgtagctgcagcaggagcagccgcagttggcgccgcatatgcaggtgttgaaatctcagtcgtctgcctctgtggcccgcctataagaccg

SEQ ID NO: 24627 - DNA, 330 bp, Zea mays
  Clone ID: cC-zmle189018g05d1
cggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataattaatagcagcgtctaaataagatcctgtcaactgcacccgccattatcgatccatggtcgctcctggggtacatgttcatctgtgtaacgcgctcgcggtcatgtccgtctcgtgccggatttaatatttatatgcatgtactgtgtgtctttctgcgctaaaa

SEQ ID NO: 24628 - DNA, 320 bp, Zea mays
  Clone ID: cC-zmle189018g06d1
aacgaactttgtgataacgatttttttttttttcataagacatggcaggtggttctaaatggggttgcgttaatgtgtgtacctagcatgtagaccacaaaacctgttcttttgaagaaacaacatgaacacaggcatgaaggaaaccaggactctctgcttcaaggcattgatgaattagtgggagcagaattcggggaacatcatgaggacgcacatgaccacgacgagcttgagttaggtgaacctcttgtccacaaactgtttcacaccacggaatatggtgtgagtgcagcgggcaacaccgcttcatgccttct

SEQ ID NO: 24629 - DNA, 242 bp, Zea mays
  Clone ID: cC-zmle189018g07a1
gaaacaacgcatacaggatagattgtgtggagtttaatagttagcttcgtgaatgttgaccgaatattagccaggataatttgacttctagtaaatagaaaggtgcaagtcaccatgaattggaagtattaaaaacggaaaagaaaggtttaatagggtaaaactaaataagaaggttaaaaggggaaagtaactggaatacaaaaaaggttttgataagcagttcaggtgccaaacaaaag

SEQ ID NO: 24630 - DNA, 308 bp, Zea mays
  Clone ID: cC-zmle189018g07d1
aagaggcgtggcaaagacagcgcatcacctgcaagtaggagccctagtcgctcccctcctcgcaagacgccaccttctcctaagagatctcctgtcaggcacaatgatgaccggtctccacgctcacggagcccttcaacataagcacaattcacttgcaaagcatcttgaacagctcaggatgaatggacttgctctgatcctatgtgtgtgtggctatgcttgtgctcaatggtgggcacttttcagttaaagttttgtagtgctgtctgtcagttgctgcctcaaacttggatactacttctgtt

SEQ ID NO: 24631 - DNA, 132 bp, Zea mays
  Clone ID: cC-zmle189018g08a1
ttattttttttttttttttttttttttttttgtttttaaaagctgaagtaattttttgattttttataggaaacatacttgggtttgagggcactatttatcataattttttaaatgttaaaaaaaagatgg

SEQ ID NO: 24632 - DNA, 248 bp, Zea mays
  Clone ID: cC-zmle189018g08d1
tgagcattcagaaacacaccaagcgaagcgcactagcaacgacctaacaacaatggctaccaagatattagccctccttgcgcttcttgccctttttgtgagcgcaacacatgcgttcattattccacaatgctcacttgctcctagtgccattattccacagttcctcccaccagttacttcaatgggcttcgaacacctagctgtgcaagccaacattgcacaacaagcgcttgcggcgaagcgtt

SEQ ID NO: 24633 - DNA, 268 bp, Zea mays
  Clone ID: cC-zmle189018g10a1
gggaatatccgggcggcgcactgcttcatagtagataaatcatacaggttgagtgttgatagtcaggttgctatttcttcaacactcgatatacatttcttttgctcgtttctctccaaaattcgcgaaaaaaactgtttgcacgtacctagctctaatgctagtcgtagatatggacactcgtagacttcaggaatcggatcatatgatgatataacacttagttcccgagcagagacgtcaggaatttgatcattggacgcttggg

SEQ ID NO: 24634 - DNA, 267 bp, Zea mays
  Clone ID: cC-zmle189018g10d1
cccacgcgtccgatgatccgattcctgacgtctctgctcgggaactgagtgttatatcatcatatgatccgagtcctgaagtctacgagtgtccatatctacgactagcattagagctacgtacgtgcaaacagtttttttcgcgaattttggagagaaacgagcaaaagaaatgtataacgagtgttggagaaatagcgacctgactatcaacactctacctgtatgatttatctactatgaagcagtggatgcatggatattcac

SEQ ID NO: 24635 - DNA, 392 bp, Zea mays
  Clone ID: cC-zmle189018h01d1
cgcattgaggccaagatcattatggaggacggggctgaaactacaactggagttggcgagctctgcattagaagtccatctcttttcaaggagtattggaaaagaccagaggtcaccgcagaatctttcattgatggaggattcttcaagacaggtgatacagtaactgtagatgaggaaggatacttcataattttgggacgcacaaatgccgacattatgaaatttggcggttacaagctgtcagcattagaaattgaggcagtactgttagagcatgatgctgtactggaatgtgctgtccttggcttgcctgatgaagcctatggggaggttatatgtgcaataattgtgcctaaggaggatgcaaagaaaaaggctggacaggactc

SEQ ID NO: 24636 - DNA, 466 bp, Zea mays
  Clone ID: cC-zmle189018h02a1
aaaagaaaaaataaaagaaaaagaagaagaaaaggaaaaaaaaaaaaatgaaaaaaaaaaaaagaaaaaaaaaaaaaaaaagaagaaaaaaaaaattaaaaaaaaaaaaaaagagaaaaaaaaaatgagaaaataaaaaaaaaaaaaaaaaaagaagagaatgaaaaaaaaaaaagaagaaaaaaaaaaaagataaagagaaagaaagaataaaaaaaagatggagataaaaaagatataataaaagagaggataaaaagaaaaaagaaaaaagatacatagaaagaaaagagagaaaaaaagaaaaagaaaaaaaataaagagaagaaaaaagaagaaagaaaaagaaaaataaaataaataaaaaaaaaaaaatgaataagaaaaaaataaaaaaatgaaagagaaaaaaaaagagagaaataaaataaaaagaagagaaagaaagaaaataaaaaaaaaagaa

SEQ ID NO: 24637 - DNA, 405 bp, Zea mays
  Clone ID: cC-zmle189018h02d1
ttcttgggtttacccacgcgtccgcccacgcttcggataaagcttatgaaaagttatggtttcactatatatcatgctaaaagcctcctgcagtagggccggggggaccggtataaacctgacccgtcatagggtacatcggactaaaagacagccactgtagaggtggtcctggacctgaaaaccagcctggagcttactttaccggcaacccttaaggactacatccaaaaaccgctttatgatcagcttgtgattgacaggaaatggcctgtgcatgttggagaccatagaaagtatctgcacattatgcttgggaagctaaatccatcgagcaccgagaaagatcgggactcactctcctgggatacaacagtttaacacgtgtttaattaaaccccctct

SEQ ID NO: 24638 - DNA, 279 bp, Zea mays
  Clone ID: cC-zmle189018h03d1
tttgggttacccacgcgtccgcactccgagtctgtggttgttaggataactggatgccctaattgatgctctagaccatatatcgcaaagctgggtttcggtggtgatggcccaaaaagttaccagatctggctgggtggaacacccaaccatagtacgcttggagaatcatttatggacaaggtgaagcttgatgacatcctaaaggcttgggagcctctctttacctaatggaatggcacactcccagaaagggaaatttttggaagcttcccaaaa

SEQ ID NO: 24639 - DNA, 209 bp, Zea mays
  Clone ID: cC-zmle189018h04a1
aactctgatgcatcacaaaatgcatccagttcatccctggttttgtttaattcacatccccctcttaggggcgttattacttgttttatatttctctttacattaacgctggttcaacatcagagcttatttctgttgtttatatgcacttttagcgagtttaatctgataacttacctaagtccccaagacatgcggatctgctgctt

SEQ ID NO: 24640 - DNA, 307 bp, Zea mays
  Clone ID: cC-zmle189018h04d1
tcgccccacgcgtacggcactcatgttgcatcgatgaaaaaggtactttgttcatatttgggcagaaaactgataacggattgggacgagcgtacgaagaattcaaaccagatctcgatgaagagatacgattttcagaagaagtggcctgtggaggtatccatacttgtggtgttacagatatcggtgatcctcatgactggggatccattgcaagtggctgacctgtggttggaggggcggttcttgtccggtctacggcaactctgaccagaactctttgagaacattccgtatctcaagtttg

SEQ ID NO: 24641 - DNA, 417 bp, Zea mays
  Clone ID: cC-zmle189018h05a1
aaattataatttttatacaatgaataatgtcttaacaaattattacacgaaaatcttgtcacatgtaagtttaactggtctccattgaaaaagaaaatgatgatgaaaaatgcttggataaaaaatcttttccattcccttttaccctcgttctacccggatgagattttttcatttacatccctatttttttcatttacatccctatggaagaattttttctgtcccagaatttcccaaaaaaaaacccattgtcatttttgttatagacaattgttgcgaggaaaaattggggatgcaaagcaaggtgatgtgctgtatattttctttatgcgggtttgtttgacggttcaaacattaaatattaaaaagcatgctctaaattaagatattttgctactgaagtttaaaatgact

SEQ ID NO: 24642 - DNA, 428 bp, Zea mays
  Clone ID: cC-zmle189018h05d1
cattgtcaacaactgggatgacatggagaaaatctggcatcacaccttctacaacgagctccgtgtttcgcctgaagatcaccctgtgctgctgaccgaggcccctctcaaccccaaggccaacagagagaaaatgacgcagattatgtttgaaaccttcgaatgcccagcaatgtatgttgctatccaggctgttctttcgttgtacgctagtgggcgaacaactggtattgtgatggattccggtgatggtgtgagccacacggttccaatctatgaaggatacacacttcctcatgctattctccgtttgggatcttgcagggcgtgacctgaccgaccacctaatgaatgatcctcacagagagaggtgtactccctcactacgagcgctgagcgggagattgtcagggacataaaggagaagc

SEQ ID NO: 24643 - DNA, 344 bp, Zea mays
  Clone ID: cC-zmle189018h06d1
cccacccctcccgctttcctggaacatgaaactagcgaaaaccatcgctgtaatttccagtttacaactcaggaatcgatatacgtgctcgctgaaactccctggccttctatgttgcttccataccctcattttccttaacaagccccaagatcctcagccatgatgggtacctcgtaccctattggacgaactctaggacattcttggggaaaagcacctggtgcagcagctaatcgcgccgatttagaagcctgtgtacaatctcgtaacgaatggggcgaccctccttttgacactaatgaaattatcgtaacagcttgcaaaaagaccgcttaactact

SEQ ID NO: 24644 - DNA, 98 bp, Zea mays
  Clone ID: cC-zmle189018h07d1
aaaaaaaataaaaaaaaaaaaaaaaaaaaaaaattactacgccatttatgaacaaccaagactaatcaatagaggaaaaggtggggtggtgccgtttt

SEQ ID NO: 24645 - DNA, 268 bp, Zea mays
  Clone ID: cC-zmle189018h08a1
ttttagatgtatttggatgcattatacagacataaaatacagaacatgccacaccttgtgttgcccaagacgaagcacagtgccacagcatggctattcctacacagtgcacaatagctggacacaggaagcaacatggggatccatacaacataaaaccttaaaaccttacagacttatccttttagtggacacaggaagcatgcctggatggcttgtgcaccctcacctttggtctcttcttgcgtgccagtcttcgctccagcac

SEQ ID NO: 24646 - DNA, 264 bp, Zea mays
  unsure at all n locations
  Clone ID: cC-zmle189018h08d1
gtgctggagcggaggctggcacgcaagaagagaccaaaggtgagggtgcacaagccatccaggcatgcttcctgtgtccactgaaaggataagtctgtaaggttttgaggttttatgttgtatggatccccatgttgcttcctgtgtccagctattgtgcactgtgtaggtatagccatgctgtggcactgtgcttcgtcttggacaacacnaggtgtggcatgttctgtattttatgtctgtataatgcatccaactacatct

SEQ ID NO: 24647 - DNA, 899 bp, Zea mays
  Clone ID: cC-zmle189018h09a1
ataaataataaataattataaaaataatatataaataaaatataaatttatagaaatattataattatataaatattaatatataaaataaatttaataataataaatatatatattatatatataaaatatatttaataataaatattaaatatattataattaataaataataattataataattataaaaaaataaaaataaatatatattaattttaaaaaaaaataaaaaaaatataaaaataaaaaggaatttaaataataaaatatatatataaattaatacatatacacataatattaaacatataataataatatattaaattatataattaataaatataatattaatatataatatatatataaataattaactaatataatgattaatataataaccataatatattatataatagaatattattaattataatatatataatgaaaataattaataaataatataatataaatatttaattaatataaaaaatttaatattataattatttataaataattaatataatattaatatatataatattataaataattatagatattaaataaaaataatatttaaatttaatatataataaataaatataaattataataaaatataattttataaattataaatataattaataataaataatataaatatattatataaataaattataataattataataataataataatttgataaatataaaaatataactattatataataataaatatagtattataaataaataaaattaatatcataatttaataataattaatataagaatatataaactaaatttataataataattattataataaaattaatttatatattataataatataaatatttaat

SEQ ID NO: 24648 - DNA, 105 bp, Zea mays
  Clone ID: cC-zmle189018h09d1
ccacgcgttcgaccacactgaatccgctccgatcatattgatcttccagcagctgctgctgccggcttaactgtggctggaggcactggaaagcaccactgtctc

SEQ ID NO: 24649 - DNA, 515 bp, Zea mays
  Clone ID: cC-zmle189018h11d1
cccgacggtacgctgttcgacagcagctacaagcgcgggaggccactgacgatgcgcataggcgcaggcaagatcctccgagggcttgaacaggggatcagtggcggcggcggtgtgccgcccatgcttgttggtggaaagcgcaagctgatgatacctgcgtcactggcgtgcgggcctgaaccggcaggctgcttctcaggagactgcaacatccccggaaactccacacttctatatgaccttttcctcgtcgggatctacaagtgagccctcgatgacagggaatgttcagaacctaagagcagagacaaggaggaattcttggcggtgaaagcacctgcagaggcagatccacttgcagaagcttctgtactccagagagctacctggattgaataaaatgatgatatatataaaccatccttgctacgtaataacgccattgtggaactttgtaaagaccaatcatattgttgactatatagcagtttgatacagccaataaagaaatg

SEQ ID NO: 24650 - DNA, 348 bp, Zea mays
  Clone ID: cC-zmle189018h12a1
ctgctaaattcccatacctgggggggtttttacaaacatccagcagatcacgctagaagtttagaactatatgttaggtccttaaaaacctcccgtcggctctgccatcgttgacatgacttcctgaactcaactgtgcggcggtggcggcggctacctttaaaggcgggaaaaagaccacttggttggagtccgaggtccccggggacaccccccagttctcggacgtggactgcgcggaaaaagggctgtgctcctgcacaaggcacgccggtgtggaggaaaaaagaaagggcatgggctcttttaaccaaccccgccgctgttgcttttgttccaaggccggac

SEQ ID NO: 24651 - DNA, 360 bp, Zea mays
  Clone ID: cC-zmle189020a01a1
gggttggggggtggggcacatgttcttttaactagctttacaaataggccttttcttaccggcttccgtaatttgtttttgggggggaaaacttgcccgccttaattttaatactaaccgggggggggattttaaagtagcatacccctccccatttattagggggaaaatgccctgccccttattttcattggcgggggtttaatataatactaccccgcgcccggggcccagggggattattgggcccccccaaattcccagggcacccaaccgacgtaggggggaggccaaccaccgttgcccgttcgcccggggcaaatgcgacccacgcattaaagccggcagggagaaaagcct

SEQ ID NO: 24652 - DNA, 512 bp, Zea mays
  Clone ID: cC-zmle189020a01d1
tgacgcgcatgaccaaccatcttctagcctctcatcgagcgacagcagcacacgcgcagggtgctattatcagcacccgccccggcaccccccgcggcctccatgatctcctcgccagctctggcggtggcgcctcaaggcctgccgcccctcggccgccgtgcctcctccttcgccggcgtctgctccaagaagaatatcaataccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgaactggtctcccaccggcgacctctacgtcggtggaaccaccggccttctgatctgggccgtcaccctcccttggaatcctcggcggcggcgccctccttcgctacaaacaccaacgccctcttcggctaaagatatcccatgcatgcgcttcttgcgattcg

SEQ ID NO: 24653 - DNA, 425 bp, Zea mays
  Clone ID: cC-zmle189020a02a1
gcgggcagagaaatccaatcaagggttgcaaatcccaaacaaaacaactgccaaccatcaacaacaaacagacagcacaagtatttcgtgtgcaatacatctgaatgacaatacaattgacaacctaccaggatatgcccatacgtaacaaactgatgaaaaaaaacgatatacacatatggacagtcacaacacaaagctatgagcattttaggacctcgcaagcagcacaacccaggccatgtacaaataaaagaatcggcctataaaattggttgcaaaaaaaaaacaaccgagcaaagccaccagtagcccgtcctcagaaataaccagcaatatattgagattactctcatgggaccgaccattcacgacgagagggtcgcattttctagcaggcgcttgagaaaggcgtgttcttttaa

SEQ ID NO: 24654 - DNA, 496 bp, Zea mays
  Clone ID: cC-zmle189020a03a1
gaatatagcaaacttggatattgtattagctggaggggtagtatgctattacacacgactctagctatagctagctcatatacaaaccatcacatgatatatagatacacatacgcatgcatcatgcatgcacatatatatagtatgtagtaatctataatacttaattacacgcacgcgcgctatctctcgatcgtgaagaagagagattgctagctttattccggtccgatgatgatggaggcacatatatatacatagatccttggttctacaatacgttgacagtaatctgtatatatgcttcgtgtagtggttttggttggttcttattgtcttcaccgccgtcgtcgtcgtggtggatgacgacgagtcgccgccgtcgccgacgccatgatcagaacaggaacgccgtcggcgcgaacgctggcagggacgacgcgccctcaaggtgccggtactgcttgccgccgtgcgcgcggggcagcgcccgggc

SEQ ID NO: 24655 - DNA, 434 bp, Zea mays
  Clone ID: cC-zmle189020a04a1
ggttggcctttattaaaatttccttcccaaacaacccccaaaaaaaaaagatgggcaaacaaaaatgacacccccaccacaacaaattcccaccaaaacccccccccggaaccccccaaaaaaaacaaaaaaaaaaaaccccccccttttacccccccaaaataaacacacccccaacaaaaccccccccaaaaaaaacctccccacgaaaaaaaaaaaaaccctttaaaaacaccacggggtaaaaaaccacccttcccaaaaaaacaacccaaaaaacccccccccaaaaaaaaaagcaaaaaaaaaaaccccggcccaaccaaaaaatcccgcccccccccctgggggccccccccctttcccaaaccggagaacaaaaaaaaccccgcaaaaaaaaagaaaatcctcctcctcgcaaaaatgatccccca

SEQ ID NO: 24656 - DNA, 511 bp, Zea mays
  Clone ID: cC-zmle189020a04d1
aaaataaacaaaaaaacaaaaaaacaaaacaaaataaaaaaaaaaacaaaaaaaaaaaaaaaccaaaaaaataaatataaaaaacaaaaaaaaaaaaaaaacaaaaaaaaaacaaaaaaaacataaaaaaacaaaaaaacaaaaaaaaaaaaaaaacaaaaatcaacataacaaaatcaacaaaaaaaaaaaaaataaaaactataaaaaaaaaaaaaaataaacaaatcaaaaaaaaaataaaaaaaaaaaaaaaaaaaatataaaaaaaaaaaaaaaaaaaataacaaaaaaaaaaaacaaaacacaaaaaaataaacaacaaaaaatcaaactaaaaaaaccaaaaacatacaaaaaaaaaaaaaaacaaacacaaaataatcaacaaaaaaacatacaaaaaaaaacacatctaaacaaaaaaaaacaacacacaaaatcttaaaacaaacaatacaaattcacacaataaacacaaaaaaaataacaaaaaaccaaaaatacaaaa

SEQ ID NO: 24657 - DNA, 497 bp, Zea mays
  unsure at all n locations
  Clone ID: cC-zmle189020a05a1
cagccatgctttcgtcgtgtactattggaccgggtgatcattctgcatgcgggggggctctaatcatgctggctgttggcggcctaatgccatgctgcgtttttctcatgcgctgctcttcatgccgncagcagctgtgttgccagggaaagcccagtgcggcttggccagggtgcgcttcgtagccttcactgacagtgacagtgggctgtccttgcccatgaggcaggttccctgcttgacgttgcagacggggtagtcatgggggcagcagctgtagtggtcgtcgcagcaggtggcgccctcgagcgggcagcagccccaggcgaagcagtacttgccgtactcatagatgcagcagcaggtggtgctgtcggggcacgagtagtagttgtcgcagacggtgggcggcggtgtggtggaaggcggggtcggcccagggttcggggggttggcgcccttcttagagggtacgacggctcaacggcgataccaca

SEQ ID NO: 24658 - DNA, 429 bp, Zea mays
  Clone ID: cC-zmle189020a06a1
tttttttttttttttttttttttttttttttttttagggggggggttttttttttcttgcctttttgcaaaaagaaaaaaaaattcgggccctgcaagggggcaatatttataaaaaattctgtcacaaacagggcgcttggggcacacagctgtgttttgccacccagttggttggcccactcgggggtcaaaaaaaagacagcctggcgacccgtttgcgctttgtgggaaaaacaacccccccaatcggttttcgggggcgtgggaaaagacccttaaataaatgttgaaacccccgggggggggggcccctctgggccggtgaatccccccgaggtgtaggcccccctgctcccctcattgtgccggaagcctaacccccgaaacctgggaaatcaaaccgcgagccgttcttcctccgcggggg

SEQ ID NO: 24659 - DNA, 254 bp, Zea mays
  Clone ID: cC-zmle189020a07a1
acaaaacaaaacattttgaatgtaatccccactcgctgtcaggcgcaggcgcttgttatttcgtaatagaaacaaggaaacgtcagacaaccggaggtagcagcggtttgttgagcacgtgccccttcaaggtcccaaaccacagggcggcccagggctctccccttttggttggggccgctgccgacggggggcaaaaactcgatttttcccatccccagaagcgcctcgggcacgttaggtttgttcttaaa

SEQ ID NO: 24660 - DNA, 160 bp, Zea mays
  Clone ID: cC-zmle189020a08a1
caaatgcgaactttgttacggagtacacatggttacaaaaatttaaaaatatcatgcacattccaggtatccaagaacccatagaatcgagtaaataatacaatcaatatatatataaccaaactacatacttcatacagggggcggctgactccacaat

SEQ ID NO: 24661 - DNA, 186 bp, Zea mays
  Clone ID: cC-zmle189020a09a1
gggggggaaaacatgaatttttttgattagggggccgcctgttcaaaatattcttcgaatctatcatttcatgccacgcagtacaatcgaatttttaggataagcaaccgtcccgagtttgtttaaagagacccaaccccactattcgagtgacaccgattgaaaaaattttccggggaaagcaaa

SEQ ID NO: 24662 - DNA, 364 bp, Zea mays
  unsure at all n locations
  Clone ID: cC-zmle189020a10a1
tttttaaaagaagaaaaccttggccccccctttttttaaaaaaccccccccccccggggggggggggtttttttttttttccccccccggagttttttttttttctttaaaggagggaagacaaaaattattttttcctcctccccgccccccaagaaaaaaaaaaaaaaaaaacttcctcttctttttttcttccaaaaaaaaaattatttttgtgggggggggcggggaaaaaaaaaaaactttttttttttttnttnntcccccccccccaaaaaaaaaccaccaccccccccccccctcccatgaggtgggggggcctcctcccccccccccccttcttttgtgtcccccccccccgggg

SEQ ID NO: 24663 - DNA, 305 bp, Zea mays
  unsure at all n locations
  Clone ID: cC-zmle189020a11a1
taagtgttttaatttacatcagnngctcccatctcatatggtaataaatagttagatgacaagaaattgcactgctcaactcatattaatatatcatcaatggcacgcttcattccaaagctgacgattgggatggcattagacatgttatacacgcaaagccagctttacttccacgcgctagagctatggtttatttgaggtgatgagacgccatacatcacggaggtacctttctttcatccgcgggctttttacatagctcatggggatggagatatccagagagccctgcttttggacta

SEQ ID NO: 24664 - DNA, 237 bp, Zea mays
  Clone ID: cC-zmle189020a12a1
aagtcaacccaacgatcatctattcatcgggttaggattatcccacatcacagttcacagagttcacgcaaacaccttcagctactagataccagacactgaacaaaactactctcgtagtccaccacaaaccagctaacattacaagcatatgaacccaacctccacacaccattagtgatgacatacatagaaacagagcagaggaaacacacgacacggcccacggtgtgatcc

SEQ ID NO: 24665 - DNA, 391 bp, Zea mays
  Clone ID: cC-zmle189020b01a1
aaaaattaaagcggatcatatccccaatcagtacaacagggtgaagcagattttaaataacatttaagcaaaccatttgccgattgaaagaacagtttaatagcaacaaaacgcaaaaaacaaccacataaaattgcaacagaattgaacatatccaaacatagcagttttgtaaagggtgataataccacaagataaaaggggccatccatgacacagagtcagcacagggaactttgggtcagatcacacaggtaagcactcattattcgaacaagttcaagaaaactagataattttattattttggggaacgctacttggccatcctcactccttaacctaatcgccaggattgccgccaccggttggctttttttgattttttttt

SEQ ID NO: 24666 - DNA, 570 bp, Zea mays
  Clone ID: cC-zmle189020b01d1
aaaaaaaaaaaaaaaaacaaaacaaaaaactacatttaaaaaaaaaaaaaaaccaaagaaggtaaaaaaaaaaacccacccacccaacccaaaaaaaaaaaacaaacaataaccaaaaaaaaaacaaaaaaaaaaaaaaaataaaaaacataaaaaacaaaaaaaaataaaaaaaaaaacaaaaaacaaaaaaaacaacaatacaaaaacaacaaaaaaaaaaaaaaacaaaaacaaaaaaaaaaccaacaaaaaacaaacaaaaaacaacataaaaaaaaaaaaaacacaaaaaaaaaaaaaaaaaaaaaaacaaaaaaaacaaaaaacaaaaaaaataaaataacacaacaaaaaaaaaaacaaaaacaaaacaaaaacaaaaataaacaaaaaaacaaaaaaacacacaaccaacaacaaaaaaaaaaaatcacaacaaacaaacatcacaaatctctacaaaaaaaaacaaaaaaaaagatacaaaaaaaaaaccaaaaaaaaactaaaaaaaaaaacaaaccaatcaaaaaacaaaaacaaaaaaaaaaaaaaacaaaataaaaa

SEQ ID NO: 24667 - DNA, 335 bp, Zea mays
  Clone ID: cC-zmle189020b02a1
aaaaattgcaaggcagcttttcttgggcttataactgatagcccctcccgtcaaatacccatgattttttaaacatgaagattgggctacatggaaaacttttttcttatctaaaatggcatgggaaaagggggggggctaaaaacttgtttcccaacaaacaggaatcatagatcaccccttgcacctttgtttgtaaaaaaaatgccaaacccccttttaggattaagggcccattggaaatatccatgctaatgcatggaaaacaaatcttgaaatatttgaaagcccccgtttcggatttcactctttgagaagggattccctctgctttt

SEQ ID NO: 24668 - DNA, 461 bp, Zea mays
  Clone ID: cC-zmle189020b03a1
ttttgattctatcttctgctcattttcaaaagaataagggttagtggcaatataagcattgatcaacagattgcactcccgaaatattcacaaattcccccttcgcccatttccagcgttcatgacattactagtatgtacataaccttctccgccatcaaaccaatctgaaaaccaatgggaaagtgatcaatgctaatccacatcctctattctaatgttccacgggtcctccctctccggctcctgctgcacctacgcccgcccgccttcgaacactaggtagctgacgactaccgcggccctgggcctccgcctttccttctcgccgacctccgccgacgccgagctgtcctcctccttcttctccttggccggcgctggcagctcgcggcggcagacggggcatttgccgagcacgcctagccaccgttccaagcagcgcccgtggaaacggtgcc

SEQ ID NO: 24669 - DNA, 437 bp, Zea mays
  unsure at all n locations
  Clone ID: cC-zmle189020b04a1
aataataactcagtaattgggtgggtgctttcaaggtatagatggacgatgagacgacgatatgcggatgcggtcagccagattattaccatgtggatgcatacataatactgctatagatggatggatggatggatccatattagatgagatagatgcaactccgaaaatcaaatgggcggccggacggacaagaaagcgaggacgccggtgtgcgcctgcctaggacggcagctgctcgacggccacctcctccatcttctggtgcgcccgggcctccatctcgcagcagaggcagggccggttgagcacggngccgtgcgcgtgcgcgtgcgcgtgccccaccccgccggtggcgtgcgcgtcgacggcaacgggcttgcgcgcgatgatcacggagttgatcacctccccctccgggtggtgcacggagagca

SEQ ID NO: 24670 - DNA, 64 bp, Zea mays
  Clone ID: cC-zmle189020b04d1
aaaaaaacaaaaaaaaaaaaaaagaaaagatttaaaataaaaaacaccaacccacaccccaccc

SEQ ID NO: 24671 - DNA, 378 bp, Zea mays
  Clone ID: cC-zmle189020b05a1
aaatgaaaaaaaaccaagtcggttgctagtacacattgcataggcaaaacacatgcatgtaaacacaaaactccaaatggcacaccatcccaagcggacataactgaacagctatcaataccttcagaaaccatattttgttaaaaaagaatttttacctggaggctagcccccaactaccacttattaccataaaacagcgctttatcgtggaggtaaaataagaatctttttgaatgacaaattgagtccccccatcacctattcaatttggaatcaagcctggacagcccttggtatggcactgcttctacctgaggtaaaagttcaaaaactccttcggtaagaggaaccttcacagtgtgctcgctaaaacca

SEQ ID NO: 24672 - DNA, 445 bp, Zea mays
  Clone ID: cC-zmle189020b06a1
aggaaagccatacgacgcggtttgttgattatcaaacatgttacatcgtttaccagtctgaagaataacaccagagggttcatcgaccccaaatacagtttcctttcaagagaaagctactctgctagttcatgtgccacctgtgcgtttgtaaattggacacagcattctgggagcagtgcacggcatcctcgtgaaaaacgagaagaaaaaaaaggatatttcttcactgcctccgtctcctttcatctccggtatacgtatggctggacaagacacacatctatacagatcgcatcactggtaaacttgcacagagtaaatgattacacgtccagcttcttatgcggctacagctagaggtctttggctggtctttattcctttgatagcttcagcgtagtctggagccccaaaaactgcagaacctgcgacaatggcattt

SEQ ID NO: 24673 - DNA, 171 bp, Zea mays
  Clone ID: cC-zmle189020b07a1
taccgagataaggtttaaagccctaaccctcatcgtctggggtttgggtaaaactctaggtcctggagctccatacatagcatagctccatgtgcaaacacatatcatgccacaattttttagaatttttgcatgaatatatactattaaacactgcggattacaccagtt

SEQ ID NO: 24674 - DNA, 230 bp, Zea mays
  Clone ID: cC-zmle189020b08a1
ttttacttttttttttatttacgtatgcatgtttgtgttgggtagggttagtttacatagggaagaaaaattgattcaaggaaaatcgaaacaccatatcagggcccgcaaattgctgacacccaaccatgggcgggcgactaaacaattgtgcatttaatatatgaatgcgcaaatacaaaaaaaattccctcaaccccaaaacaaaaatgggaaaaaaaccgaataaa

SEQ ID NO: 24675 - DNA, 289 bp, Zea mays
  Clone ID: cC-zmle189020b09a1
tttttttttttttttttttttttttttttttggaggcaagaatcccactatggatagtccattcatacattgcccaacaagaaccaggtaaagtttcgcatgaacatcatgcattcttcatttggtacgggattacaaacaaacacatttgctaacaaattttggggaattttttcccccccccccaatcacaggggcaaaaaattttccctttttatttccccccaaaactggttttttttcccccctgtggggagggagaaaaaaaaatgttttcacatttgggggg

SEQ ID NO: 24676 - DNA, 526 bp, Zea mays
  Clone ID: cC-zmle189020b10a1
ttttaacttatagttattgaagtttaacaaacaacaggacatacatcaacagtttttgttcatatatggcagatgcattatcataggtcctacgagacatttaatggcacaaatgcatttctacattctggactcttgcagatgggaacgactgcagtttgcataacagtcttgttgtcacagaagatgcaggccattctccgtcagttattaccattctatacacagctgcctttgcccgcaaaatacgctaagcattttttccatcctggattatgaaccctaaatataatttttttttttggtggggcccaaatggaaatcctagtttaggttttcccaaaagggttacaatattttggtttttttcttggataaaaatttggggcatatgaggttattttttttcttctcccccaattttttggcctctttttttttttgggggggggagaaaaaaaaaaaaaaaatctttttatatctatttaggggggtgttttttggggggggggggcaccctcccccc

SEQ ID NO: 24677 - DNA, 293 bp, Zea mays
  Clone ID: cC-zmle189020b12a1
tttttttttttttttttttaaaaacaatccttccatccaccagggggttctattcagatgggggtaattttattaattaattcaaacacatgagcccatcataaatggctttgatcgccccattgagctttctatcctacactagacaaagattagcagcagcagttgtttatcaacggggttgcccttccccccactaaaagtttggcggggggatttttttacatgggaaagcgccccccattccattcatttttatttttttaaaaaaaaggggtgtttttttttttttt

SEQ ID NO: 24678 - DNA, 502 bp, Zea mays
  Clone ID: cC-zmle189020c01a1
ttttaactttaacagctgcctcagattcccattccctagcgtggatcggttacattacatccagcagatcacgctaagaagcttgagacatagatgtcgaggtcctcgagaaactcgccgtcggctctgtccatcgctgacatgacttcctcgaactcgaactgcgcggcggcggcggcggcgacctcgaaaggcgggaaagagacgacgtggttggagtccgaggtcgccggggacacgccccagttctcggacgtggacggcgcggagaaggggctgcgctcctgcacaaggcacgccggcgtggaggagaagagaaagggcgtgggcgcgtcgtcccagccccgccgctgctgctctggctccaaggccggcccctcggtcttcaccatgaggttggcgtcgtacaccggcgcctgcgcgtccgcggcagcctgacgacccgccgtcgctgccgccctctggctctgaacgcaagtgtggtcgccgaggtagacgacgt

SEQ ID NO: 24679 - DNA, 448 bp, Zea mays
  Clone ID: cC-zmle189020c02a1
aagacgcaagcagggagggcaacactttattagtacaagctagcagcaccgggcagcagccataatttaagtaggagtgtacaagatcacatggcaaacaaaccatccctgactggtatttcttttttctttttgattataatagcacgatacatgcatgacaccagggaaacactacatcagcatcagctggtatgaatcctccatccagcaagcatacatgtgttgcacctgtgctgcgacaccagatctcagtcgctgtcgctgctgctgctactggggccgccgtcgtggtcgtggccctcgccgagcttcttctttttcttggccttcttttccttgagggcgccggacttgtcgccgtgctcgccggagatcttgtccttgatcttctccacgatgccttccttgtgctccccgccgtccttcttgtggtgctccccctcct

SEQ ID NO: 24680 - DNA, 409 bp, Zea mays
  unsure at all n locations
  Clone ID: cC-zmle189020c03a1
aggaaaaccttcaggggaagtttttgttatcgnaggttcaagttaagacctacagcccatcatttcctccactgatgctgtttggattcattcatggacctaaatgcatcaccggggtgtcccactgtcccttaacatgagactcaccttcaccttgcccctcccaggcggatcacctcttccgttccagaatccctgtgcgccctatcggcaccagcatcattcttcacgttcgtcgcatcgccggacagatccttcagctttgccaggttcgacgattctggagccctaccaaacgggctggagcgatgtttatcaccatcacttttgccacggactggactcctgctcctgcttctgcggacgcttgcatgtctactccggtcagaatccctgtccctccttttac

SEQ ID NO: 24681 - DNA, 179 bp, Zea mays
  Clone ID: cC-zmle189020c04a1
ttttattttatctatcttcaaaaatacagaacattctcgttaagttatacatagacaaaccatcctgaacccacatctatttcataattggactctttgatatcattatacaaaataatattctccgaccaatccaatcaaatgatttgaactagaacagctcatgatacatgcatcca

SEQ ID NO: 24682 - DNA, 144 bp, Zea mays
  unsure at all n locations
  Clone ID: cC-zmle189020c05a1
tttttntttttttgacgaacgagaaccatcgactttatggatagattacattcctgaacacaaggtatacctccaacaatgcagtatggtacaaaaagaataagcaatagcccaagatcacaacgcccacccagggggagccca

SEQ ID NO: 24683 - DNA, 593 bp, Zea mays
  unsure at all n locations
  Clone ID: cC-zmle189020c06a1
actnanaacgttactggatttatatttaccacccagaaaggacacccagcggggcgggtcagtttaaaacatacatgtgcgttaagcgtgtgtgacagcatacatgtaagcgagcgaggtcttgttcctgttgtaggtgaggggtgtatgtcctggggtggcacatcacccctttctgacaccatgaccaccactactaccaccaccattggacaagagagtggttcttctctctctccccccatccatattagagagagaaaagcgcgggtgttaaatagagggttaattatcactgtttagagaaggaccttggaatttttttcttttgttgagaactggcgggcgcccaaaaaaaaagtgggggggagatgtttttttcttttttaaaaaagggggggccccccccccccccccccttttgttttttttttttcccccccccccccaaaaaaagaagaggggggttttttattaaacaaagctccctcccccccctttttttgggggggggaggaaaaaaaaaggggaggggccccccccggggggagaaacttctccccccccccccttttttttgtgcccctcccccc

SEQ ID NO: 24684 - DNA, 274 bp, Zea mays
  Clone ID: cC-zmle189020c09a1
ggcagcaccaagaagcaccatttggtccttaagattaacttagaataaagcctgccgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccacc

SEQ ID NO: 24685 - DNA, 312 bp, Zea mays
  Clone ID: cC-zmle189020c10a1
ggggttggttttttttttttttttggggaaaaccaaattttaaaatctttttgggaaaggtgaaaaaaaaaaggtaaacccctttgtttcccctttaggggggctaaagggtttcccttccccaaaaattttgttttccgtgtgtaccggggacccccccaagaaagatcctcttattgggaaaggggggggggcaaattttgggccttggtcccaaacccccgtgattttgggtccttttattccgggaagggggggggaaagtcctgtggattttttcccagggcgggccctggggaaaacccctttttt

SEQ ID NO: 24686 - DNA, 223 bp, Zea mays
  Clone ID: cC-zmle189020c11a1
gggcgtggtttttttataaaaaaagcccacctctcgagttgaacaacaatttaggggaggaacacaacaactgcactatggaacccaaaaggtttccaggtgagccaaaaaaaaggcccatctactttgcaacttgacccacccacccccccccaaaactgtgtttttactaccaaacccatacgagggggggcttgggaaaaccacccggggggggagggtg

SEQ ID NO: 24687 - DNA, 252 bp, Zea mays
  unsure at all n locations
  Clone ID: cC-zmle189020c12a1
agnnnnncttttagccattgcggtggggttcatatatacatagatgtgaaagaacatgacagacgcacatgagccgtattgtcacagatttcaagaacaggccttaaggttattggataaaaaataatcacccgccgggtcacctcctaaatagacagccttattacttaacaagaaatagactgtcttagcactcggatacaaagcttaagaggaggcttttccttggggagcgccagaaacttctaccta

SEQ ID NO: 24688 - DNA, 502 bp, Zea mays
  unsure at all n locations
  Clone ID: cC-zmle189020d02a1
ttttacattaaattaaatgtaccaacgatgtcattcagacagggatgcaacagacattgcacccaaatgtgcgttataccgtagcattccagacattcaagtccccctatatatcgaaaccatcactctagcaaatcccacaaacagaagttaaaaggtacccagctatgcctgggtagcattttttatgttgcagcaaaaaaggatacattccccgcttgcgaggtcgattcagcttcctatttcccagctcggcgacagcaaaaccagagatcactcccatgctttaagggcaccacccctcccaattgccttgatgatagtctgcttactgttgcgcgcactgcactctctgggctccgcccggcatttcgtcgtcctcctcgtacgcctcctgggcagcgtgagcttgcttcctgcgcatctcttcctcgatgttgttcacatcatgcatangtcgtctcctcgcattcatctatctccatgtctgtcagcttggatg

SEQ ID NO: 24689 - DNA, 247 bp, Zea mays
  Clone ID: cC-zmle189020d03a1
acgtacttaatttgttgggttgagttgttgtacatgtgaggaaaacaagtagagatggatgcatcatccatcgacgggcggagtacatacagatcgagatgcatggaatggatagctagctttagttgactgtgatcttgccgaccattcctgctccttggtgcggctcgcagtaaaagccgtaggtgcccggcacggtgagggtgacggagtaggtctcgcctggcgcgttgaggtactcctcctg

SEQ ID NO: 24690 - DNA, 118 bp, Zea mays
  Clone ID: cC-zmle189020d04a1
ttttgaataggtttcacacaaatccatccatgtgcaaagcggaggattaacatttatacacggggccaatcaccgatggcgtgaaatgaaacaaggaccagaccacctacaaaccatg

SEQ ID NO: 24691 - DNA, 249 bp, Zea mays
  Clone ID: cC-zmle189020d05a1
tttttttttcttttctcacccacaaaatacgccgcccaagcaacgttgaatttaaaagaaaaagaaaaccccgccacaccttggttcttccaataaaccacccacaaaaactccagcttaatttttgctttcgactagtcccagttgcgacacacaaggtgaattttttaaaaaaggaatattatcctgccccccttaaaaaatccccctccacaaaaaaaaaaaaagccgccctcacattttttctcc

SEQ ID NO: 24692 - DNA, 593 bp, Zea mays
  unsure at all n locations
  Clone ID: cC-zmle189020d06a1
actnanaacgttactggattttcatttaccacccagagaagacaccctgcggggcggtgttttttaaaacatacatgtgcgttaaccgtgtgtgacagcatacatgtaagcgagcgaggtcttgttcctgttgtaggtgaggggtgtatgtcctggggtggcacatcacccctttttgacaccatgaccaccactactaccaccaccatttgacaagagagtggttcttctgtctctccccccatccatattagagagagaaagtgggggtgttaaaaagagggatttttctctctgtttggtgaccccccaaaaaatttttttttttgtaacaccccccccggccacccccacaaaaaagggggggggtatttttttctttcccccaaaaaaaaaaagaaagccccccctcttctcctctcttttttttttttttcccccccccctttttaaaaacggggggggattttttttaaaaagagcccccccccccccccttttttgtgggtgtgaaaaaaaaaaaaaaagggggggcccccccgcggggggaaaatacttctccccccccccccttttttttgtgcccctccccc

SEQ ID NO: 24693 - DNA, 233 bp, Zea mays
  Clone ID: cC-zmle189020d09a1
ttttgatgtcaaattcaacaaaagagatatgcacaccaggggtggggtatgaagtaaaccatccccatgcgcatccctctgatgaacaaagtgctgcacattgtagatgatgcgaggttggcggctttagctgttgggcaagacacaacacttccatcagggcatgtcattcttgaacgccgtgtgcaattgcaaaacgggcacttttatgttctccatggatggacagaggt

SEQ ID NO: 24694 - DNA, 291 bp, Zea mays
  Clone ID: cC-zmle189020d10a1
ggagcaagcacagtacaggccggccccatgaatccacacaaaaccaggggtttttagcacaatacgttgacagccaagggttacaggacataatcaggcggggcaacacgaacgaagtagccgtttaaacagcggcctacaacccattaattgccacacagggtatatatatatatggagtacttggtttttagctgagcaaaaaatatgcttttgctgcttactaaattttggggggggggaaacattggaagaggtcgttcttgggaagcctcccctcccaatgttctt

SEQ ID NO: 24695 - DNA, 55 bp, Zea mays
  unsure at all n locations
  Clone ID: cC-zmle189020d11a1
gcccatgcgttcgcccacncaaccattaaaataaggggcaggttttaatttaaaa

SEQ ID NO: 24696 - DNA, 412 bp, Zea mays
  Clone ID: cC-zmle189020d12a1
acatcacgtctgggaccaggtctaccttcgacgacgatccgctgtggcccagcgacgccgccgtgtaggagctgtaggacggctgcttggcggcgacggcgacgcctccaccaaagtcgaagtccacagcggcgccgcagctggatccatcgttcggcacgacgctatcggcgtgcgggaacctggcgaagttttgggcgaggaacgggtcgacgacgtcgtccgcgaacaggaggtccagcttactggcgtcgacgacgaccttggtcgcgtcggcgtcgccgacgtcctttccttttcgcggtaaggccgaacagcagcgccgcctttttcgcggcgggatcagcggcggcgccgatgggctgcacggggacgcgctcgtggcggcgcgccagctggttggcgtcgtgga

SEQ ID NO: 24697 - DNA, 262 bp, Zea mays
  Clone ID: cC-zmle189020e01a1
gggagcgctttatttaacaaaaaaaaccaaaccccaccccaatgaagatgaaaaagaaccagacacacggcctttcttatacagaaaaaaaaccataccacctcccaaaaaaaaacgacactacaggtaaaaataaatttggcatccacaccccaaccaaaaaaaaaaaaagcccaccaccaaataggcatcatccaaccgaaaaaaaaatataacccccccccaaaaaaaaaaggaaaaaataatccccccccaaaaaccc

SEQ ID NO: 24698 - DNA, 226 bp, Zea mays
  Clone ID: cC-zmle189020e02a1
ggaacacaagtttgggttggagttccaactcatcatccggaacatggtacccaatacaaggatcgatcagtaggagtttatgagatgaaccaaattagttaaatccgacccagcagattcatcgatgcccttgtccgcagcgatcttgagctcgttcatccttttcctgatgccctccccttcctcgctgccgcccatgagcctgtcgatggcggccttgatctcc

SEQ ID NO: 24699 - DNA, 418 bp, Zea mays
  Clone ID: cC-zmle189020e02d1
aaaaaaaaataaaaatcaaaaaaaaaaaaaaaaaaaaaaaaataaaaaaaaaaaaaaaaaaaaataaaataaaacaaaaaaaaaataaaaaaaaaaaataaaaaaaaaaacacaaacaaaaaaaattacaaaaaataaaaaaaaacaaaaaaacaaaaaaaaaaaaaaaaaaaaacaaaatataaaaaaaaataataaaaaataataataaaaacaacacaacaaaaaaaatctacaaaaaaacaaaaccaaataaaaaaaaaaacaaaacaacaataaaaaataaaaaaaaaaaaaacaatataaaaataaaaacaatacaaataaaacaatctacaacaaatacaaaacataaaaaaaacaaaaacaacaaaaataaatatatcaataacaacaaaaaaaaaaaaacaataaataa

SEQ ID NO: 24700 - DNA, 245 bp, Zea mays
  Clone ID: cC-zmle189020e03a1
attattataatataggttttgtttttttttatataaaaacaccacccacccccgcaaagaaccaaaaaaaccaacacattacataaataaacacaaaactccccctatatgaaggcaacaaaaaaaataagagcgaaaaaaacataaaacataaaaacaccgcaaaaatgctattgttaaaaaattaaaaaaaaaaaacgagccagaaaaaaaaattcaaaaatcagtgatgcaaaaaaatagac

SEQ ID NO: 24701 - DNA, 234 bp, Zea mays
  unsure at all n locations
  Clone ID: cC-zmle189020e04a1
ttttagttggaacggnagtaatagaagaaaccgagatgggcagtgttatgtcaacaacacagggatgccaccaaatcaaatcgatgttctaatgaacaaacaggtcaacatggaaggccttaaaatttgccttctccgtatataccaagattgaagagagtaaacagagcacaagcatcataataacaaaaaatgttctcactagttgcaaagcagcacaaacgaagcaagaaa

SEQ ID NO: 24702 - DNA, 507 bp, Zea mays
  Clone ID: cC-zmle189020e05a1
agcataaaagcagctccattattgggtacccacattacagcgctctcacagcataggaccaagagatgcccatggcctcaaacaaaaccagcaacagaaggtaagatgcacaaccgcaacagccagaactgagtactcgagacacggcactgcataattccaactgaatcatgcatctaggctacagacttgacacctatccacaccactgacaaagactgataagataaatggatggagtccaccaggtagcaccaaagcacaaggctcttatgcattcaccttgggcgcccatcccgcaatcacgtgctcctcggatggcttagtcttgacaaaagattcacggctgaaaagagccttggtgtaggcatggacattggttaggttttctgggatcttccagcctttgaaatgctccagtgcgatctgtaggtggaaaagctttggccccaggctaagatcaggcgctgacacgttctcccatttatgtaggggccatgagctttg

SEQ ID NO: 24703 - DNA, 447 bp, Zea mays
  Clone ID: cC-zmle189020e06a1
gggttgggggggctcaacccaaccaccgaaatttccatccccatccgatgaatatcaggggtcaagccttccagggggcacaaccataccgatgcgagactttttccacgcccaccatttttggatttagccatgttatttggtcgcatccatttcctgggggcacagattttaccgggttggcaagcaagacaaaagtccatggccttttaccaaaggatgccttcatccgcgacccagtgcgcaaaccgggcaaaatagtcccgaacgtttgaaacctggctggttgaacgggaaaaaaccatgtcatcccttcccttatcagggggtccttgttcactgtgcgacgtaaatgattcaacgctgaccacatccataggtgaattgatcagggatgacctctcaaaaacttccttgtcacaggaattcccagaagacgacaacaaa

SEQ ID NO: 24704 - DNA, 174 bp, Zea mays
  Clone ID: cC-zmle189020e07a1
aagctgatcctcacagcggcgccttgcttacgttttttttttggaacaaacgatcttaggggtgggttcattaaaacccaacctccgacccctttatcaacccaaaaaaagccccctcaaaaaccggaaaaatttttaaaatctaccccatccttaaacagcccaagtctgttt

SEQ ID NO: 24705 - DNA, 170 bp, Zea mays
  Clone ID: cC-zmle189020e09a1
ttttactttcataataataacaacaataataatggtacgagcatcacaggcaatgttattacgctgtacatggacttttttttctgtaatttcagattttttagttccatacaacaagacatggacactcgttggccaaattatccattcccagttccaggttagaaaag

SEQ ID NO: 24706 - DNA, 276 bp, Zea mays
  Clone ID: cC-zmle189020e10a1
ttttacattattcccaggatggaacttgaatccggccagggacacggtgcatacacagaatacacaccatccctagactaatccaatggacatcgacaaaataccagtagtcttataacagagagagagagagagaaaaaaaaggaaaagaaatgagggcgataacgcaggacaaagctagaatagcacggcccagtttcagttcttccgtaagctgggtgattcacttgcagccgagttgaaacccggaaggatggatccgtcagaagaaggcgt

SEQ ID NO: 24707 - DNA, 180 bp, Zea mays
  unsure at all n locations
  Clone ID: cC-zmle189020e12a1
atcagtgctacattttctgtaactacggcggcggnggcatatagacgccggggtacgtttcagcggtccagcacggcatgcctcaagtgaacatcaagggcaacgagtgcggacggtcactgacgtcgtatccaaccgagaaggaatacagtcgctccaaccacaaaaccccttgatctt

SEQ ID NO: 24708 - DNA, 324 bp, Zea mays
  Clone ID: cC-zmle189020f01a1
aaatccttggggaggaaaaaaaaccattcaatcccaaaggttttgcaaagggttaattaataccccaagggctctatggggttccaaaattattcccaacctaattggttcatttattgacccaaaataggctttgaaatttaatcaaattgggggaccaaaagttcaccccccttggctcaaaaggagaggggcccagtggcctaaagttggaaacggtaaacatttccaagaaccccagggcgggggtcctccttttccccgaggataagctaaggggctccccccaaaattaaaaaaagcccctttcccgggccttcctta

SEQ ID NO: 24709 - DNA, 467 bp, Zea mays
  Clone ID: cC-zmle189020f02a1
caaaaccggtaaaaaccggaagggcattatagtagtaacgaaattacaggattcagtgcgtggcgttcatgaataaaaacattgccaaacggatcacactgacactgttcgcccagggaacagccgtcaggggattacattacatccggccagaaaacgaaacgaaccataccaaaaaaaaacgacaacagaagggtccaaattgcatggccctcggctttcaagaatctaggatggcaaaatagcgcctggaagcaagcgaacttacaggcaatacatatgctacacaacatggtacattctactgccggggctccacaaaagtcacccaaaattttagacaccgatgttaagtattaactgttgtttgagaaatagtgaaatagaaccgcagctactgcaacaaatacaaccttgaatagcagcttctttgacccaggcgattcaaatgaagaccctgactccga

SEQ ID NO: 24710 - DNA, 421 bp, Zea mays
  Clone ID: cC-zmle189020f03a1
acattaaaagatgtaggactggggctatttttatttatcgaaacagaaaatctacatatattactttagccaagatcttttaaagtctactactttactttggcttcttagtctatcatgcatcattttttgctttttccttgagagtgggtactcctgattttcttgaattggggaaggtcatctttgtcatcagttgtttcttgtttgtcatagtttgggtctccaaagcttcttttgtttgaaatctgagattcttcccaaatgccagatggttcaatgtccatattttgagtttcttcggtgtgttctggttgggaaggggatcgctcctttttttctatgtctttggagggaattggcactagcaatggcaattccttgtattttgccattgtagaggaagatgattttgctggta

SEQ ID NO: 24711 - DNA, 418 bp, Zea mays
  Clone ID: cC-zmle189020f04a1
ttttttatatttttatttaattttttttttttggtgttgtggttttttttaaaattatttttcttatatacacaaaataatttttttatttttaaaaacactaaattttaaacctccacctaaaaaaaaaaaacagaaaacccaaaaaaaaaaaaacaataaacacatgagaaccctttaaaaacaataaaaaaaggggaaaaaaaaaaaaaaagcaattccccttctaaaaaacccccactaaaaaaaaaaaaaaaaaacaactgcttaaaaaaaaacagcaaacaaaaaactcaaacaaaaaaaaaaccctggcgaaaaaaaaaaagacaacccaaaaaaaaaacatcaagcgcggatcataaaaaaaaaagaccccctgaaagaaaaaaaaaaaaaatttaccacccaactccct

SEQ ID NO: 24712 - DNA, 638 bp, Zea mays
  unsure at all n locations
  Clone ID: cC-zmle189020f04d1
aaagaaaaaaacaaaaaaaaaatcttatctctacaaaaaaaaaaaaaacacaaaaggnaagattaatttaaaaanaaacatccaaaaccaccccaaaataaaaaaaaataaaaaaaacaataaaaaaaataaaaaaaaaaaaaatataataaaaaatataaaaacataaaaaaaaaaaaataaaaaaaaaacaaaaaaaaaaataaaaaaaaaaataaaaaaaaaaaaaaatcaaaaaaaaaaaaaaaataaaataaataaacaaataaaaaaaaaaaaaaaataaaaaaaaaaaaaaaaaaaaacaaataaaaaaaataatcaaaaaaaacaaatacacaaaaaaaaaaaaaaaaaaaataaataaaaaaaaaataaaaaaaaaaaaaaaacaaaaaaaaaaaccacaataaacaaaaaacaaataacaaaaaaataacaaaaaaataaaaaaaaaaaaaaaaaaaataacaaaacaaaaaaaataaaaaaaaataacaaataaatcaaataataaaataaataaacacaaaaaacaaataaatccataataacataaaaaacaaaaaataacacaaacataataaaaaaataaaaaacacaaaacaaaaaaataacaaaaataataaaaacaaaaa

SEQ ID NO: 24713 - DNA, 381 bp, Zea mays
  Clone ID: cC-zmle189020f05a1
ctactaccatttttttttgacacggagggggtcagttttcaggtgacacaatacaccagcctttagcaccacacgcaggactgtactgcagacccaattcggttcatctttatacaggagggatagaacgaatacatggaggcccttacagtgtcgggcaacacaacacaggatggaccccaaaggcctattatagaaaatactacatggcctacctatggacccagactctgggggggttttggtacttgagccggcccgccttgaacatgtgagctatctcctggaccaaagggtcgtcggtgttctgatcaatcagaaggggacagatggacagcaactccttggagatggatagtgccggacttcactggtgcttta

SEQ ID NO: 24714 - DNA, 450 bp, Zea mays
  unsure at all n locations
  Clone ID: cC-zmle189020f06a1
ttttatttaaacagnacaagtgataccaatcgattaaggcgagaaatcaaaacgtgcataacgtctcggaatttgactctcaagtttcaacaaccccactttatttttttctatattacaaagtaaaaacaccacttcgaggaatactatctacttccgaaaattaagaagcgagttagctcacagagagtccaattgtttctgcatcaacaccgacgcatttaccatagagaaaataagtaacatattatctagtggccctgtaggggggttgtcacttggaatccatctcagactgggtcccaccggtagtactactcccgtgcttcgaagggtttctcagataaggcgagtctttgtacttggcatacattggcaggtctagtgccttctctgctactcttccatcctcgtgaattctctctatcaagctctcgagcaaagaaagtt

SEQ ID NO: 24715 - DNA, 211 bp, Zea mays
  Clone ID: cC-zmle189020f08a1
aaaaaaaaaacatgccccttaagaggggcataaaatttgcaaaatttttatcccttgtggctttggggtttggtccggtaaatacaaaaaaaactgttgcaagtgtggctttgaaaaaatacaatgcctgccctttaaaaaactaggtcctattgtaggaaagggacattttttttgccaaaccatttggggggaaaatacccatttcccc

SEQ ID NO: 24716 - DNA, 552 bp, Zea mays
  Clone ID: cC-zmle189020f09a1
gggcaaaaacaactcctggaggggggtcggggggcatggattactgaccatatccacatcccttgttttatttgctcaaccctgaatcatttttgcagagattcccgggggtgggaaggggcccactcctaaacgggggggccccccccattttttttataaaaacaaaaaaaaaagttgctttttttgtccccccccaaaaaaaaattttctccgtttttttttctttttccaaaaaaaaaaatagggtgtttttccctttaaaaaaaaaatatatttttttttttttttttagggggggggattaatatataacaccccccctccggggggaaaaaaaaaaaaaaaaaaaaacgtttggcctccctcccgggtgtaattacaccatctaaacctcccaccctttttttttttttttcttccctccgtggggggcgcactaaaaaaaaatatgttttttttacataaaattcttctgtgggcaattaaggggcgcccaccaaacacttttttgttctgggggggggggaaacaaaaaaaaaccccccccct

SEQ ID NO: 24717 - DNA, 156 bp, Zea mays
  Clone ID: cC-zmle189020f10a1
ttttagtttatatatagtatcaaatcatatcatcgtggagcaattaatatatggttacagcagatgcaatcggatcaaccaacatgcaggtagacacacgtacgtacatgagcacaaagactgacgccaaacatgcagagagagatagcaaactga

SEQ ID NO: 24718 - DNA, 214 bp, Zea mays
  Clone ID: cC-zmle189020f11a1
agggacaggagtaaattgtatatatttgcctcggaccctgcccttacttaaaaaaaactttaaaaattggtcctatccaaggtcaaaaaaattttggttttgtagaacaaaacgtgactaaaattgtaataaaaagttttctttcctttttttaaccacataataaaaattttataaaataaaaatttatattatcttttcctcactcaaataa

SEQ ID NO: 24719 - DNA, 185 bp, Zea mays
  Clone ID: cC-zmle189020f12a1
atattagtatcaaatcatatcatctgcggaccagggtaatatatggttacagcagatgcaatcggatcaaccaacatgcaggtagacacacgtacgtacatgagcacaaagactgacgccaaacatgcagagagagatagcaaactgaagaactctgtttttttttttttacacacaccacacat

SEQ ID NO: 24720 - DNA, 327 bp, Zea mays
  Clone ID: cC-zmle189020g01a1
ggggggtgtgtgttttaaaattaaagagccgggcccgcctcagaagttggacacaaaaaattccgagggggaacaggaaaacgccgaaggaaccgcccaaaggagagatgactgactggaactaaaaaagggcgaaaggggcagacggggaccaaaaaaggaggcaaaaagacgaagaggcgggagtccaacggagaggggaacacgcaaaaaattggggacgagaacggggcggaaaaggggatgcgcaactggacaaggcacgcccgggaggaagacaagaaaaagggcgtgagagctgaaaacaagaaccggccaaagagggga

SEQ ID NO: 24721 - DNA, 440 bp, Zea mays
  Clone ID: cC-zmle189020g02a1
ttttgaataagtcgccagatactaacagtaacatgagtgcaatatttagtaatagcaagatatatgctctacacatacaaaccacaagtactagtaaaataagaccgaataagatatgctgcacgtatacaatacaaaccaccgagtatagctaggacactaatggcggaaaataagatatgtttaacgcatacaaaccaccgattatagctacaggacgcgtataaagtcgaccgtatcttatatgatctattatatatcgatggaacaatggatgcatcaatcggcgagacgaatgaggatcgaggagatattaatctcttgtgccgcagagaataatggtgctgagcttcttctcgatcggtttcttgtcgacctgcgccgacgcgttcggcttctcctcgatcggttccttcttgacctgctggttccggacgcgt

SEQ ID NO: 24722 - DNA, 269 bp, Zea mays
  Clone ID: cC-zmle189020g03a1
gggtgtgtgtttattaaaccgtgggtacccccccaacccccggaccggaaccggaaaagcgacaacgtttcccaaaagggaaccaaattaaagcatggcgaaacaaaggaaaaagcggtccaaagaaggaaaaaggtttccccgcacaaaaccacaaaaaaaacaacccggaaacaaaaaatgaaaaccccggggaaaaaaaaaaaagacccaactcaaaaaaaaggcaacgaacacacagcaaagtttaaacccgaaaaacccgtctt

SEQ ID NO: 24723 - DNA, 454 bp, Zea mays
  Clone ID: cC-zmle189020g03d1
aaaacaaacaaaataaaaaaaaatatacacaatataaaaatataaaaaaaaaaaaaaaaataaaaaaaaaaaaaaaaattaaaaaaaataaaacaaaaacaaaaaaaaaatacaaaaaaaaatacaaaaaatacatatatacacaacaaaaacaaaaaaaaaaaaaaaaaaactaaaaaaaaaaaaaaaaaaaaccaaaaaaaaaaacaacaaataaaaaaaaaaaacaaataataaaaaataaataaacaaaaaatcaaatcaaaaaaaaaaaacaataaaaacaaacaataaaaaaaacaacaataaactaaaaaaaaaaaaaaaataaaataattatacaataaataaaataaaataaaaaataaacaaaaaataaataaaacaaataataaaaaaaaaataaaataaaaaataaactatataaattaaataacaaaattacaaatataaa

SEQ ID NO: 24724 - DNA, 139 bp, Zea mays
  Clone ID: cC-zmle189020g04a1
agatcaaacaagccctgcggcccaaacatcagggcccagggcaatgcttcccctgttgtagcagaacagcccagttcacaaataccatgcacagagtgccacccttgcaaaaaaaccaacaacaaaaggtttggaataa

SEQ ID NO: 24725 - DNA, 427 bp, Zea mays
  Clone ID: cC-zmle189020g05a1
ttttttttacccagggacaagacaacagtacatgacatgtgtagattactgcgaagccaaatacccgtctcaccgagaccaccataaatagagcttacacaacatacccaacatgcaaatcatttttgaactgaccagatgcagaggcaggagaattttcgaggcgggctacacaagtgtgcaccgcgcacttgaatgcccaacaaaagattggtccccacaaaattaaaaaaaaagggcgggggggaaagagaaatttccccaaaaaaagatcccgggggttaaatttttttccccccacccggggggggacccccccatgggggggggggggtgcccccccaccaaaaaaatatttattggggggggcgcccccccaccaaaaaacaaactattcatttttttgggggggggggggggggggggg

SEQ ID NO: 24726 - DNA, 220 bp, Zea mays
  unsure at all n locations
  Clone ID: cC-zmle189020g06a1
actnanaacgttactggattttcatttaccacccagaaaggactctcttcggggcggtgtattttaaaaaatacatgtgcgttaagcgtgtgtgacagcatacatgtaagcgagcgaggtcttgttcctgttgtaggtgaggggtgtatgtcctggggtggcacatcacccctctctgacaccatgaccaccagttctaccaccaccatttgacaagaga

SEQ ID NO: 24727 - DNA, 94 bp, Zea mays
  Clone ID: cC-zmle189020g07a1
ggccaccctttttttttttttttttttttttttttttttatttttatttttttgggttgtgtttatttttaatatttaagggaccccggggcca

SEQ ID NO: 24728 - DNA, 280 bp, Zea mays
  Clone ID: cC-zmle189020g08a1
aagacaaaacccagctaatctattactatggtggctcatcgatccaacacctttttttcggcgtcgtcggcgtaatcatttttacacgcacgcacgcacacacaccattgttttattcatccggatccattgctttaattcaaaagttggggcctgcggcgaggatcttgtcagtcaggctggtgtcgtccccgatcttggagctggcgaacacctcgaagttttttttgaagagcccgccgagcctcaggagattctccttgtacgcggccttgtccgt

SEQ ID NO: 24729 - DNA, 399 bp, Zea mays
  unsure at all n locations
  Clone ID: cC-zmle189020g09a1
tttttaatttgaanggaggaggtacttgacaataaaaaagtatgaactgtcatcacacataaatgaggggaccaaataaatgtcattaggaactggatcagatgcagtagcaactactactgcaagctatgcattcagtagctgcatccgttctccttccctccccatgtcttgctgatagcatctgcttcttttaggagagattacaaagaacagataagagaatgcatacatcttataaatcaattaggacttgttcggttattcccaatacacatggattggatgggattggaaaaaattatgaagaagtttgacttgtttgggatttaaactcatccaatcccgctcaatccacatggattgagagctaaccgaaccagcccttaaatggaacaa

SEQ ID NO: 24730 - DNA, 317 bp, Zea mays
  unsure at all n locations
  Clone ID: cC-zmle189020g10a1
attgnccacacattacattacggggacgagtgtcattatataccaacacacatgacatgacatgacatgacagaatacacacagatgagtctttagactgtcttcagcgggtacccctaaatttcactgcctatatcccactcacgtgccacgtcagcgttctcttaccccctatatctccactctgtacaagcgtttccccctaaatccttgccctataccccactacaaccataaaatatcattttctatacctactttttacctcctatcaatttttaattactaataattggaaggggggccacgtgaacaat

SEQ ID NO: 24731 - DNA, 258 bp, Zea mays
  unsure at all n locations
  Clone ID: cC-zmle189020g11a1
ttttggtttatgaatnaacgttacattgacacctgtttgggtataatctacacacacacaaccaaccaagttgatgtcaacttacagatgctgcttacgcaattaatttacaaccgctttacagtgctttacattataaacgacatggacttcacaaattaccagggagcgcccaccgagtgctcttattgaggattcggcgggaccgcttgactggctctcaagttttcggcgcgtgtcatgctctcggatgtttgg

SEQ ID NO: 24732 - DNA, 402 bp, Zea mays
  Clone ID: cC-zmle189020g12a1
ttttaagttttccagtctagaagatagaacagtattacagcaaacgtgactatccattcattcatgtcacctgatcactagatgagcatctcagtctagaactagaacagctacacgactagcttccaagttggagctcattttttatacaaaagatataaaatccggcccctaatgtcagcttattctgaacaagaactagctcattacaacataagctcagtcacattatcaaaacagcactagtagctaataaccaatatctcaaggatggcaactagacccatatttcggtgtattttgagtgaaaccaatcaacttattggtgaacacatcaattacgatacctttttgccaaacatcctaaaattttttttttttcaaaggggcgtgttttttttt

SEQ ID NO: 24733 - DNA, 264 bp, Zea mays
  Clone ID: cC-zmle189020h01a1
ccatccaacccctctcttttaatttccaaaaaaccaccacccctaaacaaaaacataatgaaaacaaaacaaccctaaccgaaaccacaataaccaccccaaaacaaaaaccccacacaaccaccacaccaataaaacactacaaaaacatcaatataaaataaaccaacaaccaacaaccaaacataaataccacctcgcctgccaccccaaaaacaaaaccctaacaaaaaaacatataaccaggacgacaaaatataccca

SEQ ID NO: 24734 - DNA, 349 bp, Zea mays
  Clone ID: cC-zmle189020h02a1
ataatcgggaaggggtgatgtattgaagaacagagttttgaaccatggagcagtttggaagttttacatgactggaaaaaaaagggagatgggattgtagcttttatgagcactgctactagtaatgttcacatagcatggctctgtaataatactggtgatcaccacatccaccagcagcaggcaatccggttgccaacgaggaggcagcctcagacaagcacctgagctgcagctagcctagcaatcggaaccctgaaaggggagcaagaaacgtaatccagcccagcctttgcgaagaaggccacagacgaaggctcttcaccgtgttctccacaaatgcccacct

SEQ ID NO: 24735 - DNA, 384 bp, Zea mays
  Clone ID: cC-zmle189020h03a1
ttttatattgtatcaaatcatatcatcgtggacggattgatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggcctcgccggactccgccgcggcctcgacgaactcgggcgc

SEQ ID NO: 24736 - DNA, 130 bp, Zea mays
  Clone ID: cC-zmle189020h04a1
agtaacaatttattttggggggaaaacaaacactcttcatgtttgcacacgggagtccactggggtgcacaagaaagaaagaagaaacccaacctgcaattaaaaaccagggggccgaatttgtattaag

SEQ ID NO: 24737 - DNA, 593 bp, Zea mays; identical to SEQ ID NO: 24692
  unsure at all n locations
  Clone ID: cC-zmle189020h06a1

SEQ ID NO: 24738 - DNA, 256 bp, Zea mays
  Clone ID: cC-zmle189020h07a1
ttttttttattttttttattttttttttttaattgtttggttttatttttaatattctaatctaaaccaacccttaaaatagtacataaaataaaaaataaataccatatattacaaaataaataaaaaaaaaaaaacacacttataaatattgaggatataaaaaaaaaaaatttcgctcaaaaaaaaaaaaaataataataataaaaaaaaattttaaaaacaacactgtcccccaaaaaaacaatactctcat

SEQ ID NO: 24739 - DNA, 115 bp, Zea mays
  unsure at all n locations
  Clone ID: cC-zmle189020h08a1
tatttttttaaacaaanancaaaatatatttactcggtgcggtttttattttaaaaatcaaacccacccttaaaaaaataaatttttttgacaacacaaaaaaatattttatatt

SEQ ID NO: 24740 - DNA, 77 bp, Zea mays
  Clone ID: cC-zmle189020h09a1
attatatttttttttattttttcacatctttaattgggtgaggggttaaataacacgagggtaaacccccaaaccca

SEQ ID NO: 24741 - DNA, 413 bp, Zea mays
  Clone ID: cC-zmle189020h10a1
aatagaaatgcactcttcattttatttccatgccagcacagtagcgtagggattcagagttttgaggaactgaaatcaagtggcagaacttttcatcatcatcatcgtggtgctatactcctatgttacagtgggtcggcaaggcaaccagtcatggatcagatttgaagccgagctcggtacggttgcaggaagccgaaactagcagaggccctagctagttagggccccagcagctgaggtacatgacggtcctcatcccctcctccgcggcggccttgtccgcggcgggcggcgccagcttcctggcctgcgcgaaagctggagccgtggcctttggcgcgccggtggacggagcgcaacgcgtaattccagcggcacaggcccgcctgttccttgagcgcctccacggc

SEQ ID NO: 24742 - DNA, 208 bp, Zea mays
  Clone ID: cC-zmle189021a02a1
ggggcgggcgccagggacgaaccggtaattcccaaccggttcctttaggtaatctaatcttattgttatccgatgtcttttagagctagcaaaaataatgggcatagctgttctcctgagaaaaattgtataactctaacaaatccccaccacaccattagacggaaccataaagtactaacctggggtgtctaacgggggagcaaac

SEQ ID NO: 24743 - DNA, 228 bp, Zea mays
  Clone ID: cC-zmle189021a03a1
cagctggaaacaaaaaccaccacgggggggctttcatggtttatccttatgtacagcgccaactcatcatctctactagtttataccaagcgacgtgaatcaaaaaaaacatgtgcgtcttgcaaaataaagggaccacttacgtccaccatctttgatggggacgacagtgacctcctataggataaccttcgagcttaggtgccggtgactaacttgccggaaaaa

SEQ ID NO: 24744 - DNA, 350 bp, Zea mays
  Clone ID: cC-zmle189021a04a1
aatgtctacgcataacttcaactgatacatggcacaatttcaattgaatacagccaaatacagacgactaagaatcgacaaatctggcctaccgcaaggtaaaacttgtgaaaaacaggacacacacatacacaatctgtgccattatttcacctttgcaccagaccatcctcgccctattccacctgtgtgcacttatgatgacagaaacagcgatgcaatacataagtcagtagggtatatattagcgataacaccctctacagtaccatcaatacggttggggagagggatggaagtcacaacacacacacacaaacccacacgctacaacatgcatgatatggcac

SEQ ID NO: 24745 - DNA, 353 bp, Zea mays
  Clone ID: cC-zmle189021a05a1
ttttattataatttgagacggaggaagtaacaattaatctgtggtgtcaaacagccactcttcgtgtttgcacacgggagtccactggagtacacaagaaagaaagaagaaacccaaactgaaattaaaaaccaacagcccgaatttgcattaatagttacatacacgattcctcctcctctctcaaaagttctccatgacggtccgacgcctctaacagttaaaacgaatcactcgagctgcgcgtaccaaaccccctggatcttgacatccttgggcgccttagccccgaggtcggtgtccgacggctgcacgctctcgaatacgccaatgacctcgccggtgtccgggtt

SEQ ID NO: 24746 - DNA, 239 bp, Zea mays
  Clone ID: cC-zmle189021a06a1
ggttgggactaaaagaagccaaatttgtatcgctgccaattccacaaacagaatttgcagacttttaatcaccagactgggaacaaacaatggaccgactgtctcaagatgaaaacaaaacagggttttgaagtaggtcgtgattgtcgaccatgttgtgtccgaggaaggtcccgataatattattcacagcagtcatgcgctctttttccttttctcctcttcaatcttagccttaa

SEQ ID NO: 24747 - DNA, 55 bp, Zea mays
  Clone ID: cC-zmle189021a07a1
ttttttttttttttttttttttttttttttttttttttgggttgggattttttat

SEQ ID NO: 24748 - DNA, 163 bp, Zea mays
  Clone ID: cC-zmle189021a08a1
aaaaataaaaacccaaacccacacacaaaaacaaaaaaaaaaaaaaacaaacaaacataaaacaaaacaaacataactacaaacccaaagaaacacacagtaaccccaaacccagtacctgaacgcaccccaactccccccatcaccaaccaaacacaacccc

SEQ ID NO: 24749 - DNA, 240 bp, Zea mays
  Clone ID: cC-zmle189021a09a1
tttttttttttttttttttttttttattttttttttttgggtggtatatattatatttaactcttcttaaccaacaaaacaaattaaattttatcatatccattataataaacccacacaaaaaaaatcttgtaaattgacaaaaactcaaccacctaataaaaccagaaaaaacacaccccacccctgagcccgacacaacattccattaagtggaaaaaaaaaaaatcttaacataat

SEQ ID NO: 24750 - DNA, 473 bp, Zea mays
  Clone ID: cC-zmle189021a10a1
ttttttttttttttttttttttttttttttttttttttgggttggttttttttttttttttctttactttcctaacaaacataacatttaaaaaaaaaaaaaaaacaaaaacaatttaattggggaaaaaaaaaaaaaaaaacacccctatttggcgaaaaaaaaaaaaaaacaaaaaaaaaaggggaaaaaaaaaaccaaaaagagggggggggggtccccgaagaaaaaaaatccctcccaaaaaaaaaaagggcccccaaaaacccccgggagaggtgtaatgggacaataaatttttccccccacccccccggggggggggggggaacccagaaaaaataccgaccgcaccgggagactcacaaattttcccaagggggaaaaaaaaaacaccggagcaaaaaaaggaacaactgggcccggggaaaaaaataataacccaaccaaatccccaaaaaaacaacggcggg

SEQ ID NO: 24751 - DNA, 514 bp, Zea mays
  Clone ID: cC-zmle189021a11a1
tttttatttataagtaacattaatcacaaacacacgaaagagaagcttatgaactgcccagctctcatcatttctcacgctagcactaaaagcggcagccatgcggtgggcagggaaataaataaaacaatctatagacggagatccagccagtatccgtccctcttggctcatcgctcatccaactgggccggggtgggctgtgagcaatatttacatacagaagcacatgatcctacgcgagagaatggcagggtgggctagacgaagcaaattactcgcaggcggtggaggagaactgagagaaggatcgtcatctcggggagaagatggtggccagcccctggtccaccgtcagctggatgggcgggccgtacgccatcaggtgccccggctcgtcgtcgccggcgcgggaatcggactcgtcgcccctcgcgatcacctccccgtccgagtcgatgatacccgcctcggtgctgctgtccacgcgcaggcccggctcgatcccggatcg

SEQ ID NO: 24752 - DNA, 395 bp, Zea mays
  Clone ID: cC-zmle189021a12a1
gtggtgcatcttgagcgagaaaatcgcaggctcctgaatataggcggtgcaaccagcccaaagcacccattaaaacttttacacgtcgggttcaacacatgggtttcaagttctgaagcaaaaagctaaagcgcataaatcaggccttttaaggaaggacccatttttttgatgtaggaagtcctccacagcgagccagtggccttttcaacggcccttgatgaaaccaatggccttggcggtcctggggaagcactggctgtaccacatgagcccgtcctttctgatcacaccgtgggggttctcccaaacccggcaaacccgggagccagggcccgaggttttagggtgccagagcgctcctgggtcaacccgggaatttcggaccggaacct

SEQ ID NO: 24753 - DNA, 181 bp, Zea mays
  Clone ID: cC-zmle189021b02a1
aatcgggagaaggttatctaagaccatacatgaccacccaacaacattttagttacatcacataatgtaggagagcgagcatgactctacctaaaattatctagagctaagacacacttatccttctacaagaatagaaaagcatacacatgtaaagaatttcaaagcttattttttcccg

SEQ ID NO: 24754 - DNA, 315 bp, Zea mays
  Clone ID: cC-zmle189021b04a1
tttttaactacagtatactagcagttaatatacgaatataggtagggcttttattcacatacccagcatgtccctcccatgttcgaatataaaagctctaacaagcaaacaacactcagctacctactcgcaggcaggagtttcaaaacaacgggatcgcaaagagaatcaactcaatacttgtagcccttgacgtgaaggctttctgtagtcagctgcagcatcacccttgtacggagccgaggttatccctcgtaattgaccttgcaccctggcaagtaatccctatctatcccttctccacttattccacct

SEQ ID NO: 24755 - DNA, 322 bp, Zea mays
  Clone ID: cC-zmle189021b05a1
atagctgaatggcatgcatgcatcattagatatagtaacagggatggatcgttacacgctgcaaaagcatgcgcttagtcgttatttgcagacgataataagtagatcgatggagtagtgatcgagcaacacacacgtgacgacgtttgcttttatttacttacacccacccacgtgtacggggctaggggccgtatatatatcgagttctgcatgcatatctcgatcgatgggatgatcagtcgtttcaatcgcaataataggagtagccgtgcccgtgcccgtgcccgtgcggcaccctgtgctcctggtggctgctttc

SEQ ID NO: 24756 - DNA, 230 bp, Zea mays
  Clone ID: cC-zmle189021b06a1
cattcttcccttcaattatatttttaaggtcacaaaccactttatattaaaacattctctaatatatcccctaactctatttcccagaggagagaaaaacaaccgcttttccccctttaaaaaaaaccctaaaataattttgtaccccagaaaagaactttttataaaaaaacacccccctcttttcggccccccctatcattccacaaaaaacaccacctgggggggga

SEQ ID NO: 24757 - DNA, 353 bp, Zea mays
  unsure at all n locations
  Clone ID: cC-zmle189021b08a1
tttttntttactgtaatggagctctccttagtctttggggtcatgttcagtcgaaggaacacacaagcgcgctcagccaggcctggcctagccaagctctctacgtagtgcgtgcattccatcccattgaagaaataaaattacatcatcatgcgacgctgaaggaggaggcggccttcttgactcccttcctggcgcccttgaaccacctcttgtcgccggcctgcgccttgcagatgtagagcttgccgtcggagacggtggccgcgatgagctggtgcttgccgcccttgtcgccgtccgtccgtctggtgagcacggacactgtgtaatactgtttgccgacgatcacg

SEQ ID NO: 24758 - DNA, 313 bp, Zea mays
  Clone ID: cC-zmle189021b09a1
ccgagcgagagaataacaaacattggtacccaaaattgtttgctttcacaacgttacaacatatttatatcatatttgcatggacaggaacaatgcctttccagcagcaccagcaacaagggtggttagcagcagggactataaacaacagagtaccatccgggttgatagattttttattactgcaaaattgacccccgcagcactaccggtagttgcggtaaacgggagtgtacatgcagttttttgcatatttcaccaggtccttggggggaggcagacgggttcccaaaccgagctcgtaggtttttgc

SEQ ID NO: 24759 - DNA, 315 bp, Zea mays
  Clone ID: cC-zmle189021b10a1
gggggggacggtttttgttaaaaaggactgaacaagttcccacattagcgatccgcttcgttgtgtatttacagatttataactggctgttgaggactggagggtacatgccagcgcctgaataataagcattcaggtttttgggtgccttaacagggcgcttagccgcttgacccaaattggcaaaaatttagagctgggcaaaattgggcacgagtttattggtctgtagtagcccatcagaaccatggccaaattagcttggttcttggcaccacattccccaataatatcgatcaaattttttggcccttt

SEQ ID NO: 24760 - DNA, 166 bp, Zea mays
  Clone ID: cC-zmle189021b11a1
atattaaattctttattatttttgttctttttttattaacatatcccaatataacccctcaatattaaatataatattaaataaaaaaaaaattataaatatttaattaaaaaacaactctacaacaaatcatacaaaataaaaatttaccaaaaaaataataaaa

SEQ ID NO: 24761 - DNA, 387 bp, Zea mays
  Clone ID: cC-zmle189021b12a1
ttatttttttttttaaattcaattattattttacatagggggtggatttttttaactaatcccttacattccccaccaatttaatatatcatcataaattaaaaaaaatcttttattttaccacccataaaagaactcccacaaacttatttaaaaaaaaggttaaataaaaaaaacattttaataacaccacaaaaatataagggaaaaaatataaaaaattttcaccaaataaaaaattctcacccccccaaaaaaaaaaaactccccccaaataaaatcccccaaaaaatcctccccccaaaaaaaaataattggtggaagagaaatatcctctaaaaaaccaaaaacaaattttccttttttcaacaaataatacaacccatt

SEQ ID NO: 24762 - DNA, 123 bp, Zea mays
  Clone ID: cC-zmle189021c01a1
gtcgtttgcttgggcggacgcgtgggcggacgcgtgggcggacgcgtgggcggacgcgtgggcggacgcgtgggacggacgcgtggtgcggacgcgtgggcggacgcgagggcggacacgtgg

SEQ ID NO: 24763 - DNA, 120 bp, Zea mays
  Clone ID: cC-zmle189021c03a1
gtatgcttcaatctaacccacattcattcggatgcactgaatataacgacgaacacaaccggccatactcgaccccaatgacgacgcaacacacccagccagacggcctttggaaattcc

SEQ ID NO: 24764 - DNA, 438 bp, Zea mays
  unsure at all n locations
  Clone ID: cC-zmle189021c04a1
tttttnttttttttttttgggaataatctataagatttggcagggctttacagggatcgaccatttctggaacaaaatatatatatgcgcagtcctagattatatatggtatcatcatcgtcatcgacatcgagcacgcatgcatgcatccatgcacgagctgactatccccgatcgaccggcggcgtaacaggcgattgattttgcctcatctacaagcgcgacgggatggcgctgagcttgtcggactcggtgatgatgtgcttgcgggtgatttcggcgagggaggtgcagccgctgagcgccatggtgagctcgaactcgtcccgcagcatgcgcaggacgttggacacgccggtcttgcccgccgtcgcagggagaacaccaccggtctcccgacgaatacgccggcggtgccgagcgcgagcgccttgaaaa

SEQ ID NO: 24765 - DNA, 249 bp, Zea mays
  Clone ID: cC-zmle189021c05a1
atgatgaaactatcggattgcgggcattgctatcatctagtgaccgagcatcggcacactctcccagaggggatcaatgcgctcaggcgcgtatatatgaagagacaggcgtaatgaatcgtagtcattaagccatcgtatgaatgtcgttaagaaaagccctgcgactggaattgtacaccgaaagtgtgttcaatccatcgcctagtaaatagcaatatatccacggacgcgtgggcggacccgtgg

SEQ ID NO: 24766 - DNA, 477 bp, Zea mays
  Clone ID: cC-zmle189021c06a1
aaccaaagggatccggatttgcctttttttttttttaaccaaaaaaccccccacatataaatagcttttttttctttttttttggaaaacaagcccaaaatcaccttttagcaaaaaaggccttaaaatgaaagggggggaaataaagggcctttcacaacccccgtaatttttggaaaattgggcaaaaaaataccctgggttcatttacccaaagggaaaggggggttttaccttctatttggggcggagctaaattctccacgaggggattttccccccccccggaaaaaaaaagcttccccgaggccggggaaacaaaaagtctttgtttccccggggaggggacttttgggaatccaagttgggggaaagggagcaccttcgcccagtttttttgggacacggggggggggaaaaggggcagaaaaacccccggaccccctgggtttttttccccggggcctttttcggaaa

SEQ ID NO: 24767 - DNA, 428 bp, Zea mays
  Clone ID: cC-zmle189021c07a1
gagaaatagcaccggccaccgggctccatacttccattatattcttgcaaaatactctagcaaaacattggacatcactgctttcaaaaaacagtaatacagcacctactgaaaagccaattcaagtacctacttcagttagaaatgattcaaaatatctgctattcagcaccacatggttaactcgctcttcagaactaaaatatattctacaccagctctttgcacttgaatgacacacggtagatccaccagctgcccagcattccaatgagatgcagcaccctcccatctactaattcaatggttccaattgaaaaaaacttgtaatcttcagtaataatatttcttgtacgcatgtactcctgaagaaacaaatatattgaatagcggcttggacttgagcagttgaggagaagcaaaatttt

SEQ ID NO: 24768 - DNA, 239 bp, Zea mays
  Clone ID: cC-zmle189021c08a1
atctgtacatattaatctttggatgggttttttttatctatttccacatataaccatccaatttttaatttatataaatatacttattttacactactctatctctgaaccaacttacataaaaataagactggaacacctaattataaaaaactcaagcaaataaactattccactcaccctatattaaaaaaaaaaacaaaaaaaacaattcatttaaaaaaaaaaaacccctcttg

SEQ ID NO: 24769 - DNA, 372 bp, Zea mays
  Clone ID: cC-zmle189021c09a1
gaaacagcaaaatggatttggatggcatttcaacatgcacaaccttaggtaaaagcttgagatggagaaactaaaagtttccaacagcgaacacaaagagtggctggggctggcctaggaggggaggaagaagagtgccatcacacgaaaaccatgacctcacaggattggtgcagtaacatttcactatttagagcctatgatcaggcttttgtctcctgagctacttcttcaaaagtctttccaggaacaagctctggaacatcgtcatcgttgtcttccttgacctgtgctgccgcaccggcagcagccacctgcttttgcatcttcttgggaatcctcttaaggtgctccatgttgtcagggccaagc

SEQ ID NO: 24770 - DNA, 208 bp, Zea mays
  Clone ID: cC-zmle189021c10a1
taaattttttttttttaacgagaagcgacactccttaaccggaaggagctttcaaaacatcccgacatcatgatccattaagattcaatgcccaatatgggtatacatacctacatttatacatatgtcccacaaaatcctctactcaagaaattgttcaagcacgattccatgtccctcatcaatatgactttccaatgtaaatgat

SEQ ID NO: 24771 - DNA, 161 bp, Zea mays
  Clone ID: cC-zmle189021c12a1
gaaaaagcacactgaaatgtttctaggccgggttaccatcaggatgtacgcttaccatagacaccaagtttactgtgggaccacctaccttacttataaaaaaatctttaagatacacacctcggcatttgaggccaaaaaactttagttggtcatagtcc

SEQ ID NO: 24772 - DNA, 149 bp, Zea mays
  Clone ID: cC-zmle189021d02a1
ggcacacaagtacactttttaggagaggtcgcggaggggttatgcttactactcacacggctagcatacaaaattgaggaaaaaggattattggaaagctttcccgaattgcggaatcacttgagaccattgccgaggcccgcaggcat

SEQ ID NO: 24773 - DNA, 401 bp, Zea mays
  Clone ID: cC-zmle189021d04a1
agcaaaagggatgaactgaaacatatacccaaacttactactacacattatcaacctgttctaggcttggctggtagtgactgccatcacagcattaggcatttaggctatatgtgttctactacaactcagtatctatcaccataggcttcctatagatagttccagtgaccagccaaacatatttaaaccacttagagggacttcgaaggttacaagaaacattctccatcaggtcaacattttctgaagtcaacactagtgccatgccgatgagacgaacaggggcctgttcttccagccgagggagagcacgccgcccctttcggagagcttgttgtccggcgagtagctttgcaacagcgtcttgttggtggggttcaccaacgcgcttagcgggg

SEQ ID NO: 24774 - DNA, 77 bp, Zea mays
  Clone ID: cC-zmle189021d05a1
acaggatcagtaaaccttgcaagggtaatgacaaatgaaaacggcatcagctgacaccttgataccggacgcgtggg

SEQ ID NO: 24775 - DNA, 122 bp, Zea mays
  Clone ID: cC-zmle189021d06a1
gagggggcataaaaaatttctttcccttgggaccctccttgggaggggaatctcattttgttttacagctgggggatatttaatctaatcaaatgccccaaaagtgccctacccttgggttt

SEQ ID NO: 24776 - DNA, 90 bp, Zea mays
  Clone ID: cC-zmle189021d07a1
atttttctctttttgaaaggaacagccaattaattaaggggggggttttgtatgaacagtaccctaaaaaaccaataaaattaataaaaa

SEQ ID NO: 24777 - DNA, 128 bp, Zea mays
  Clone ID: cC-zmle189021d08a1
aacccgcgggaaacaaaaacccccctttttggccaaacatgggttattttagggggcaacgcccacctattattttggcttggctatgcaatggaacgggaaaaaaaaaacacacttgctttttgcag

SEQ ID NO: 24778 - DNA, 383 bp, Zea mays
  Clone ID: cC-zmle189021d10a1
gggccggtatattcggacctggccgaaacgggtgaatttcaccgaaagggagtcatttcggggtgaatcccaaagccctgtggagggtgaggagttacaaagtgctattacaatgcaacgcttcacttccactggttggcgcaaatgtcagcgaggtctacgaccctctgcgagtagccccacttgttgtcgtaccaggagatgaccttgaccatgtcgtcgcccatgaccatggtgagggaggcgtctatggtggaggagacgtcggaacacctgaagtttacggacacaagcggaacgtctaaaaccttgaggatgcccttgagctttttgcccgggggttctgggaaccccttggtaccctctttggaggggtttttttt

SEQ ID NO: 24779 - DNA, 200 bp, Zea mays
  Clone ID: cC-zmle189021d12a1
ttttaaatttaacatctgaccatcacaaggtccccctttgtttattgcaacatgataaacattcaatataccatggaacaatcagggagtgggcatcgctaatctacacacgctgttgagtaacaacacacatgggtacaacaacggtttgctgaaggccttcagctgcagatatatataaacccccatacggggataac

SEQ ID NO: 24780 - DNA, 346 bp, Zea mays
  Clone ID: cC-zmle189021e02a1
ttttgagtataacataatgttatgtacatattaggcaaatgttgtctattaaaaagcgtatacagctggtgataacgttgctacatccaaatagcgtgtagcatgcctagcaagccaaacatattaccttacagcaagcatcccattgccgcttcacacatctttgttgccttcgatacataaacagcacaaatggattactagcagggattatagctctacaatatatggaatcacgattatcaccgttggccagagtctacttctttctaggcgtggactgcggacacggtagagaccattggaatcgaccccgcacttgttgcgaacgttgtaaccccctgca

SEQ ID NO: 24781 - DNA, 402 bp, Zea mays
  Clone ID: cC-zmle189021e04a1
attatattttataacacataaataaaaatatataaaggggtgggtttatattaaaacacccacccacccacacccataaatatataaaccaaaaacaaaaatcatacaaattattacaaaaaataaaataaaataaaaaataaaaacaaaataattctaatcaataaattaaaaaaatatcaaatactaaaaaattacaaaaaaataaataacataaaaataaattaatacattaattcacaaaaaaaaaaacatttaaaaaaaaattcttataacaactcaaaaatctattaaaaaaaaaaaaaaacacaaattttatataaataaaaaaaaactaaatacaacttaaattaaaacttaatattaaaaacaacccaatataaaacatttttattaactaaa

SEQ ID NO: 24782 - DNA, 339 bp, Zea mays
  Clone ID: cC-zmle189021e05a1
ggagagaaaaaaataacgatgaccggtttgcattataatttattaggagactgcacaccggtgccaaaatgtgccacggcccacgagcaacaaacatgttatagtatttaagcacaagatgctactggagcttaagtttcacaactggcgccaataaatgctgatgaagtgtgctgacatcccaaatgcgggtgcctgaattctttccgcacggcattcacgtttgcagaaaacaccgtaatccacgcgcaacattagttggggattaaccaaaattgatttcctgggctagagagagcgttgctcccataacaagggaaacactgtagtgccagcctg

SEQ ID NO: 24783 - DNA, 418 bp, Zea mays
  Clone ID: cC-zmle189021e06a1
tttttcataatcagaatgaaaaggtttgttctccctctcgataatttacacgcgtgggcattgcacattcttcagaccctcacatacagctttttatcccggtaaaatcaaagacggcatgcagcagcgcatgacttggcattgctcggcggcgtggcgtccgtccttacaggctaggcgtcctctcggcggcgccggagatgacggtgagcaggttgttgccgaaggggtcgctgaggtgcttggcgaggttctccacggggccttcgccggtgacgtaagcctggatgaagaaggcgaacatggagaacatggccagccggccgttcttgatctccttcaccttgaggatggcggcctgttcggtgtcgctgcggaccgcgtggtcgacccgggaatttccgacccggaccctgca

SEQ ID NO: 24784 - DNA, 330 bp, Zea mays
  Clone ID: cC-zmle189021e08a1
aatagaacagcacacagtatgttggggagggagcctgatctacacatacagccgcatgctgtatatacatacacacacgggaaaaaacacacacacatgccccacccgttcattccttgtgatggaacaaaaaaattgtagatgcggcataaaacacacatgttataagttccatactacaatgggcaaaactggaggggcgcagagaataaagaaaaaggcgcataaacttgcaacatgttggtcgagcaaaccaagctattctaaagctgcttattaagatatatgttcatacgcatcgccttgcttctgagtgtgcccacgcgtcct

SEQ ID NO: 24785 - DNA, 430 bp, Zea mays
  Clone ID: cC-zmle189021e10a1
tttttggtttcaaccgcagaggtcaaagatttaagaggcgggaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagcca

SEQ ID NO: 24786 - DNA, 405 bp, Zea mays
  Clone ID: cC-zmle189021e12a1
ttttgatttagcaaaacaaggttactggacaaatgtgcgtaactcaacattggaaaaatagaagcgcgcacacacagaaatagttgtgatcgagagagagagagacgatggcagggcaactcgacgcttacacgaacagtgctcaaatgaaacaaaagcagtacgtgtacgcgcgtactcaaattacacacaacgacgacccacagagatagagatggatgggcatgaatgattatgcgccggtgagcttctcctccttgtgcgtcttgatgacgacgttagaggtggggtaggcgtggcaggtgagcacccagccggtggcgatctgtccgttgtcgaggtagctttggtcggactggtccacggagccggagacgaccttgccggtgccagaggagcaggacc

SEQ ID NO: 24787 - DNA, 255 bp, Zea mays
  Clone ID: cC-zmle189021f01a1
ttttcacataatttaaatgtttttttatctagaacgttgtagccaatgacagacaaggccactgccaccaaaatgccttcatagagattatacactgataaccaatggctcaatgcttgatctaaaatgagtgggggctttagtaacagaataagcatataagaatttcaatcagcgacattcaccctaaagatgaacaccttccgttccttaactggatactctgtacttcttgacagagttaagtagaacttt

SEQ ID NO: 24788 - DNA, 251 bp, Zea mays
  Clone ID: cC-zmle189021f02a1
ctacattactgtttttttgtttacccagcaagcccgggcaaacccagaaattatttaccgtcatggcctacttcccagataaacagcgggccgtaaaggacaaaaatactcgacaagcgcagacaccagctcctgatggccaagcgaacacatgagcggggatgactgaataatggggcacaaacccacccgatccataccaaaaaaaaacgacttcggaaggcggccaaaggcagtggccctctgctttc

SEQ ID NO: 24789 - DNA, 390 bp, Zea mays
  Clone ID: cC-zmle189021f03a1
ttttctttttttttttttggcaaggcaaaaaggtgtccggttaaatttcgttatgtatacagaaggtaaggtatgcatcacacaacacatgacatgggcgacagtagctgcattggtacgtccgttcctcgggtgatatcttaatttgcaaagaataaacggcctctctcgccggtggatctaaagctttccacgagagctagcgcttattccggcgctccaggaatctttttcttgagggcctgaatgaagacgaccagctctttgctgctttccttgaagaggaggcagggctacaccaaccagccggtgtagccgacgccaacgagctccaagatcttggggagccagcggacggggttgattgcgccgacaacaagcggacgttaa

SEQ ID NO: 24790 - DNA, 342 bp, Zea mays
  Clone ID: cC-zmle189021f04a1
cacccacaaaaaaaaactttccaaaccaaaaatacccccccagaggtttttaccccattccctaacaattggaaaaaaaaaatttttttttcaccaaacccaggaaaaactttcccccaaaaaaaaagggtcccccccccccccggggtttttattcacaccctttttttggggccaaaaaaaaaaaaaacccccctatcccccccaaaatgccctttcattgaaaaccctttctcttcccccggtaacatggccccccccacccccattggggcccaaaccgggggtaaacttccccaaaaatattccccccttccccaattcgaaaaaaaaaaaaggacc

SEQ ID NO: 24791 - DNA, 234 bp, Zea mays
  Clone ID: cC-zmle189021f06a1
gcccccggagctttaagcagattctggaaaaatttgtcccaaataccctggggacaaacaacttttctactttggccaacatgaaaaacgaaataaaatgtttttacaaatttctgacagcttgtttttgtaccaacaaaaaagggggggcgctccaaaattagggcctaaaactagaaaaccacctttttaactttttcgccttttttggggcagccgaaaacggggcatttc

SEQ ID NO: 24792 - DNA, 406 bp, Zea mays
  Clone ID: cC-zmle189021f07a1
ggggaaaaacaaaaaccctttagagctgttcagttcgtagcaaacaaaaaggttcagacctccgggccatattttttttccttaaggccttggtggggtaaccccctcccccctgaatggggtgagatgggaaaaaatttaaaaagaggtggccttattggggatttaaacccccccaaaccccctcaaatcatgggggttgggagcataccgaaccaggcccaaaggggaaaggcgggtttttcggacccccgggcttaacccaaaataaaaaagggtttttgaactaaaactgggaataaactaatccggcccgtccctccaaaaaaagggaaaattttgggggccaattgtttctttcccaaaaaaagcaccccccccccctctttaaaacaaaatatccagt

SEQ ID NO: 24793 - DNA, 434 bp, Zea mays
  Clone ID: cC-zmle189021f08a1
accaaagcctacacaagcaggaacactcactgccagtgccggtgggtctttaaagcacacggaccttgaccacgcgatccaccttgaaacaaacttggtaaaattaaagcaaaccagaagcacacacacgccaacgcaacgcttttgatcgcgcgcccaaggcccggccggccagaacgtacgacggacacgcacacgctgcgaccttaggagctggtcttgtgctcgccggcggcgtccttgcggtcttcttcacccgagctcttgtggtagccgggtatcttgtccatgatcttgcccagcaagcccttcttgccatccgggctgctgacgtcgacctcagcgtggggcgccggcggcggtggcccgtggaccgccggcgcggcggcggcggcaacaacgttttccgggttttgtggccaccgggtagcttt

SEQ ID NO: 24794 - DNA, 336 bp, Zea mays
  Clone ID: cC-zmle189021f09a1
aaaaataacaatcttcgtgtctcaaaacactaacgcttactccctccaacacaaaagaacaatatgtccatacatagttatctagatagaacaacaaaacaacctataaggctgtaatctagatagctacatgttgttgtttccaatactaatgtctgatgcataattcgttagcgacgttcatcccgtgcctcatcaacgaaacaagcaaaggctagattgttggcactggcatagtacccagaacgtgcaccctaaggactgatttggtgaccggggatcccgaggggaagaaatcctcttgctattcaaaattgaattgcacggacgcgtggg

SEQ ID NO: 24795 - DNA, 518 bp, Zea mays
  Clone ID: cC-zmle189021f11a1
ttttaactgtcacatatcagagacgagattatgtatgtcagtatattacaaatcataccaactgacccactaaaagaagcatcaacgtatccttcaagtgaaacagaaggcaagtacaacctgatcacaatttgcaatgccaggtgcgcctgtcttggtttaacgtttaaaaatacatgaatcactatgggtatccccagatatgctctctgcttgatcacatctccaggtgagtgcagtaagaatttgatcagaaacagtagtgctgaaattgctacgctaagtagacagtgcgtcgtgaattaacttgtttgcaacctcctttgacagccccatgacactgtcactagaaccaaccactgcttcgacaaacggcagcgtcaatggatgttcaagcagcaaaccacctgcgaccctaaaactactccctcatcgatcaagctcttgatgacctcatctggtataatcgggaaataaaccttttaagaattgccgggcttcttcctggggggtgggtt

SEQ ID NO: 24796 - DNA, 459 bp, Zea mays
  Clone ID: cC-zmle189021f12a1
acatagggcaggatcctttcaattcatgagaagataggtcaacaaccgttacattacgacagccaccaccatgagcaaccggggctcttgatcggggcagaacgacgacgacagactacaaaccaatcactggggttcttcaatgtttcgacaagcctgacgaaccagaaacacaaggagtgggggtgtttttttttcacgctttcttattgtgcccctatcgggcacgacgagcatccttatgcacactagtcggctgtccagctctgctccacgatctcacggactttgcggttgtactcccgcttgttctcgctgaacagtcttgctgcttctgagtttgcaggggagtttgggtttggatcacacagcagggactggatagaagttaaaattgcagcaacatcatatataggactccactggttctgtaggatattcaaacagatgcttccatca

SEQ ID NO: 24797 - DNA, 494 bp, Zea mays
  Clone ID: cC-zmle189021g01a1
ataaacagggggagcctgtatttatattatgagtcttgccaacatgacaaagaatggatcctccccgccgcctgaaaaaaatcctaaaaatctgctttctgctagggggtgtttgatctaccccgaactggggggggtcgtcgtcacctaggaactggactcttcccaacagggggccaaaattaacagtgtattgtttatagttgagagctgacggacaagcaattttggattgagcgatcgcccgcgcccagttccaaaaaaacaagaagattgaccttatttgcggggggggcgggggatgctttttattttcccctcctggagggaaaccgggggccccccaattctcttgttttgggggggatttctctccccgaaatattttttttttttttcgggggaaagggggggccctttttttttctttttcggggcccttggagaacccctttcctttaggggggaaaaatcgggggttttttttggggggg

SEQ ID NO: 24798 - DNA, 134 bp, Zea mays
  Clone ID: cC-zmle189021g02a1
gacagaaaagaagaaaggggaaatatcactagcccccgatgagaaagaagacctaatgaactaaacgcgccgggatgcccggcgaggattgggattggatggatgttaacagaaaccaatgtatgtgatggggg

SEQ ID NO: 24799 - DNA, 260 bp, Zea mays
  Clone ID: cC-zmle189021g03a1
ttttgcgaacaaaaaccttgctcattcttctctcggctcgtttcatagcgggagcaaccaaagcgaacaacagggtaccaacacctaattcaaaggtagaacggacactaacacggtgacagaagcgaacggtaacacgatactatagatagataagataactcggccgaagccaggatgggcccacacattagttcctccagccgccggcgccaccgccgtcgtagccgtcaccgacacccttgtgccgaccgctgtaa

SEQ ID NO: 24800 - DNA, 467 bp, Zea mays
  Clone ID: cC-zmle189021g04a1
ccatgcttttttttttttacaacgagaaacgcgctttgatctattgctgtgagagaacggatggagacatatacaggcactgctggaggtgtacgattgctcatatgcacatggatcagaagaacatgatgcgaccgattgtacagacaggcccatcttgatgtggacagcaagtgattgcacttacgggcacagtgcgaactagactctgcactgaggtgacagcgatcggtacttggacatgaagaatgaagaatgttcgactcacaagaccatgtaagctgggaccatacatggaacatgatcgaacaagtcatgggcgctcaaaaacgggcttaaaacttggaggagactcggctagttattgtgtcagaatctgatttagggctatccatccgtgcagcgagcttctctatattacatcgatgtacctattattgttggacgcttgccgctccacacttttt

SEQ ID NO: 24801 - DNA, 487 bp, Zea mays
  unsure at all n locations
  Clone ID: cC-zmle189021g05a1
ttttgtcatgaacttgggatataatatgaacaggaaacggtacatttgccggctccatatgaacaaacacaagtccgaaattacgtggccatcgttaacccatctattagcttccatctaggctagcttggcgaggacgtcgccgagcgcatctttggttgctgcgaagtatttctcggcctccggggtgctcttgatctttgcggcatggtcaagatcgtcgatggtgctgaagagcttgccggtgagctccttgaggctctgcttctcctccttgggcttggaagcgatgacggtcttgaggtcgtagcgcaggtaggaggcccggaggcggaggtcgttctggacgtacggccacgccttcttgtcgatgagtggcttgaggttgatgatgtcctgcgccgacgtcttcaccctcgccaccgncttcgncggcggcagcggctgcaggtagaaccgctccttaaagggaggtcgaagtccctcg

SEQ ID NO: 24802 - DNA, 381 bp, Zea mays
  Clone ID: cC-zmle189021g07a1
ccttacacgaaaaaagaattatattgttgaaataaagaacatgcggacacattctcagcgctgggcaaactgtccattcaactaataggtccctccgggtatactcagcttacttgaacaaatcatatgggtcttcgacatgacgaacactacggttccaaacatttaaaggcgactatcagggaccacaacctggggctacaaaaccttaaaccaacatggagcagaagatgcttatccgaggaaagtcatgatcaccaggtggcgcaccagattgcataggacgaaatcagcgaaggccctttctgggggaagggccttgaattctttggtgtcttactagatgtagagcgcgatctacaactagtcggacccctgggc

SEQ ID NO: 24803 - DNA, 251 bp, Zea mays
  Clone ID: cC-zmle189021g09a1
aaaaggggaacgaatcttttggaacccaccaaaggaattaaattattctagaggcttctggaaaaccggaccgggacctgggggggaaccaacttttcctattggggggcggattaaagttgggggaaaatatgggaaaaggtgtttcctgggggaaattgttattcgtttaaaattccacacaaaaatcgagccggaaggttaaagggtaaagccgggggggccataggggggagctaactcaaaataat

SEQ ID NO: 24804 - DNA, 355 bp, Zea mays
  Clone ID: cC-zmle189021g10a1
ttttcataaatacgcatctcgctatatatggttgggaaaccagcatacacaatcacagaggacacatgcctctcaagtcatcatatttattcgccagtgcctgggatggccgagcaacatgatgccggaacccatctcaatccgacggcatcacaaagaacttggtgcacacaattccaggggcattcagcatgcctcactggctgaaaccgtttcctctgcaattacgtccggtcgctgacgtttggggccacgccatggccggccccggatgtcagcgacccatctgcagctttgtccatggacgtacctgcagaggatctggccaggcactggctacaccgccttgattggg

SEQ ID NO: 24805 - DNA, 195 bp, Zea mays
  Clone ID: cC-zmle189021g12a1
ggggggattaaaaacaccccaccattttgattttatttttaaaaactaaacaggtatttacaaattttacgggggtttatagcttttagtatattagggtggggaaggaggtattttttacatccaacttatgcccaatccctaattaaaacttgcccctaatgaaaccccccaagccatttgtttttaaaaatt

SEQ ID NO: 24806 - DNA, 210 bp, Zea mays
  Clone ID: cC-zmle189021h02a1
tttttgttttaaaaagtatttattattcagcattgactataaaatcaagccagctaaatagcatgttccggaaacttgcaacaacacttcaaatcatctgtagcaaggactatgccactatggcaccagagctttattcatcggattctgtgcggacagtgggcttctcctgtttgccatccgtccacttggagatggagaaatggacct

SEQ ID NO: 24807 - DNA, 200 bp, Zea mays
  Clone ID: cC-zmle189021h03a1
tttttactttcagaacaaggaggcgctaataagttaggtgggacgaattcataaattatgtgcaaatcacctgattttagctcgggctccagtggtgggacatttgtacttcatgggacctgggacacttcgtgcaaaagaggctctggatggttaaaaggagacatttggtcctacgtttcgcaaggacgcgaccacta

SEQ ID NO: 24808 - DNA, 407 bp, Zea mays
  Clone ID: cC-zmle189021h04a1
agcttggccttgcagctaaaaacctactcgctatgagtggggcgcctccagaattctgggaaccggttccagaattacataacaacgccgtgactctactgtgctttgtctgccactagatctgcgtgtgtaccttaaccaccatgtacggatcgtagaaacggtcgtctggctgaacggaacgaatcggtggatgtacgggatcacaatgcggcacatgctacccctattactatgacaaatgctggacaccacgggagcatgatacatgaagtgcaacacctgacactacatgaatggtttaactatgcttcggtgccactagatcagctatatgatcaaaaaaaaacccattgctatctacagattggtactaaggaggcttagtgtcatgttatttgtctcta

SEQ ID NO: 24809 - DNA, 504 bp, Zea mays
  Clone ID: cC-zmle189021h05a1
ttttggtgaaacgagattcaaatcggctggcatgattgatgaaacaaatacacaccccaggattacactacacgactcccaacaggaaatggaaagcggaagcctgtaccagttcggtgactgcatacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgcggcgccgggccacttggccgccaccaggtgcgccagatcaaccacgcgttggctgtaccctcactcgttgtcgtaccaggcgacgaccttgaccatgtcgtcgcccatgaccatgctgagcgacgcgtcgatggtgcaagacacgtcggagcacctgaagtcgacggacacgagcggcacg

SEQ ID NO: 24810 - DNA, 265 bp, Zea mays
  Clone ID: cC-zmle189021h06a1
ggggcaaaccggaaaaatcatggtcatggaccccctgggaagctttgatggtggaacaagggaaaccgaaggggtgacaaagggggaaaaaaaataaaacctaaattcatgtttccaaaaaaaaatgagggggggggggtttgcccattaaaaaaacccggttggtacattacatacataaacctggtttgagggggggtctttatatcagggtttcaggagtatatttgccaggctatattctccattttttgggggcccgggg

SEQ ID NO: 24811 - DNA, 505 bp, Zea mays
  Clone ID: cC-zmle189021h07a1
tttttcattaatttattgtttagtattgagcatagctcagtacaataacaccacatattttagaagccacacacattatttagataggtttccactcatatacaatacaagggacttgatctgagaacctggcgatcgatctgcaacataccgtatgtgtctataggtcggatacccagcatatgatgagtggaaggctatacatgtacgaactttagggaatgcaaccagctggagctaaggatgagggttgcctgagctcattatgtgaccatatcactgatagaaaacccacggtttgaatcagtaccggcgtccatcagctttcttccacgatgtatgcccttggttccttcatttcttccatacgaatttgccagcaaggtggtttcttcggccatcgttccaggaaagcttccatgatcaaagtatgcaactatgcacatcatgttcaacaaaatgagcagtgccaccgttccaggcttcatcctagttagctgattag

SEQ ID NO: 24812 - DNA, 491 bp, Zea mays
  Clone ID: cC-zmle189021h08a1
tttttgtcaaaagaagggccatacaaagttcacccgttaaaaaatacaggtacaagccagtaaactctagaaatatagccgttgatatttatacccacggcaaacaactccggtgaacatagagatatcagatatgtacatcgctactgttaactgagaagtgaggattaattcaagtacgaaaggtccacagattaatgaagcaaggccggaactgccaccatcagatcccagcatttggattgttgccagcaaggatcagagatatctccaaacctctgctgaacgcctggttgaacagaagtcgcgtctggaaagtggatatgaatggaaaccacgagcaaatggctatgggtatgaaaatgaccatccccattccagcatcatagaggcgagctagggcacgaacaagtttccacaaacccaatttctttacgacaggtttccatgccatggcaatcgaaaatgattcccacccagtttgcacaaat

SEQ ID NO: 24813 - DNA, 388 bp, Zea mays
  Clone ID: cC-zmle189021h09a1
ccgcagcgatcacctcgttcatgtcctcgtcggaccggtcgtcgcccacgcacagaacgaagtccggcaggtcgtcgtcgtcgtcgccccgctgctcctgcgtcgtcgacaggatccgcttcgccaccaggcccttgcttacgccctgtggcttcacctcgacgaggttgggtccagctttcactgagaccggctcgtttgcaagcacgctctccagatggtcgtggagctccttggcctggcaggatccgaaatctggatcggcgtcctcgtagcaccacacgatggcagtctccttctcctcaatagtcgacccgtccgtagtctcggtataggtcttcatcacaggctctgcgatctgcttccagctgcagtctatcaccggaac

SEQ ID NO: 24814 - DNA, 257 bp, Zea mays
  Clone ID: cC-zmle189021h11a1
ttttaaggttcaaatcaaataataataatgggtaaacgccgagacatgataatctggaacaattccatatcagacaataacttggaagacagccccttccactgggcacaggcgcaaagctgataatttgttattatctccttgcaagttcaacatcaggcctgcacatttcgcagccaacacaacagtttatctgactgctagttcatcaggtttagactagtaaccacccctcatagcagggacaagatggagga

SEQ ID NO: 24815 - DNA, 157 bp, Zea mays
  Clone ID: cC-zmle189021h12a1
attacgaagaagttttattcaggtcacgagcttattgtcgtaattcgcacaggatctgagtgcgtgcacttacgatatccaatttcgattgaccctgaacaaccagtcaaccacagacatacataaggtactcaggctatcacaaacggtcgtgtat

SEQ ID NO: 24816 - DNA, 559 bp, Zea mays
  Clone ID: cC-zmle189022a01d1
cacgcgtacgtaagctcggaatccggctcgagattaaaggttatctctaaggtcctaaacaatccttctttcaaaaacataccgagaaaggtgtggaaatgacgacaccatcattggtagagtctctagttcttcaactccatgagatctcagctgtcaaatttggcaacttcaagctcaaatctggcatcttctcaccaatctacatagacctccgcctcatcatatcttacccttctctcctccaacagatctttcaaacccttatttcttcagtctcttccacttcctttgacctcgtatgcggtgtcccttacactgccttacccattgctacatgtgtctctcttgctcaaaacattcccatggtcatgcgccgcaaagaaatcaaagattatgggcctgctaaagctattgaaggcgatttcaagcctggccaaagttgcttaatcattgaggatttggttaccagtggcccgtcaggtttggaaactgcggcgcctttgcgtgctgggggaataaagatcagtgatgctgttgggttgatcgaaagagagca

SEQ ID NO: 24817 - DNA, 474 bp, Zea mays
  unsure at all n locations
  Clone ID: cC-zmle189022a03d1
cttgaacttctatctttgataaggcaccttttggagtgttagctaatccttccttccttcttgttttgatatcagcaatgcatcactttccttctaaaaaatgtttactccatcaatcccttagggacatgcaatgaaccatgaattttccctacagacttcggcttcagcacgatgttcttcgccattgcttcttccctttcttttgatgcaacttgaatggactccaactcttcctgcgtttggaggtctcacagaagagaccagatgccagagcctgctcaagccacaggtcaaacgcctcttcgtcttcatccatcatttctgcatcaaaatcccacgggaatctactcgagttgcaacgttggcttttctccaagccaaccatgtttacatggaaactnggtcgatgggtatttggcctgcaagccattccctgacatatcgcccattctgacacatcaaaaattttgc

SEQ ID NO: 24818 - DNA, 515 bp, Zea mays
  Clone ID: cC-zmle189022a04d1
ttttgaaacacaaattttagtatttaataaagcaaaatgcacacatcccccaaacaaaacaagccttattcaacccaaattggtttcatatcacagaaaccaacaggatgccgccttcctccttactggtcccacccactcgaacaaaagttctacagaaataaaaatggctacaattcttctaccacaaatctgaaaagtctaacaccaaaaatcaaaaaaaggaaaattaaacaatcaaatccgattgataaaaccgatttttgtctttccctcactcacttttcagttgatcatctcaatcacttagtacctgtagtgagcaggcttgtatggaccctcaacaggcacactgatgtaatcagcctgggacttgctaagctgggtcagcttagctccaagtttgcccaggtgaagtgcagccaccttctcatcaaggtgcttgggcaaaacgtaaaccttcttctcgtacttgccggtactcttctccttccacaactcaagctgagcaatga

SEQ ID NO: 24819 - DNA, 300 bp, Zea mays
  Clone ID: cC-zmle189022a05d1
cttagcaacaaaacaagtgaaatattttgcaatacctgagtgtcaaatttcaatgccaatcaaacttttacttgataaaggaaagaatataacacaacaaaaatggaaaagaatacacagatttgacaaaacacactttttttttctccttttgttttgagtaaaattatcccttctttggctttccacactcactggagacggattcagatcagatgattggctcagcttcttcaatcattcttgaattaaaatcagcaacactgatttctcaagtatacagacaccaaaaatacacag

SEQ ID NO: 24820 - DNA, 320 bp, Zea mays
  Clone ID: cC-zmle189022a06d1
atatcttaaacagggtttaacacctatcaattggtattaccggattactattaacaagcatgggcacaagcaacccctacagggaacagtattggttctttgcttatgtaagggagagggagcatttgtttgacaaaattttttatgtttcactcttctaaatcctatcggcatatacaatccaaacaaatcatgtactgggactaatacttaaaaattctagagaatgctctgttgcttcgacagagttgaccctaccaagtaaaaattctattccatcaacccatttttgcttgtggagtttgttctggcacttaaat

SEQ ID NO: 24821 - DNA, 394 bp, Zea mays
  Clone ID: cC-zmle189022a07d1
aaaggaaaaaaaggggaattttttttaaatgagaaaaaacccccttttgtgcttttgtgggagacctttaatttttcaaagcccaggggaattgggaataggggttacaaccaatttaacttggaagtccttttgaaggggctggaatcccaaattttttccaaaacccctttttttataccccccaaaagggacgcccctcccttcgggtaaatagcggggggtccaaacaatgcccgcccaaaggggccttgacataggggttggagaatccaaatttttgggcacaattcctggtggtgggccctacttgggggggggagcacttttaaatggcccccccctgggcttaaatttcaacagcggttgtcccgggccaaaaatttcatttggg

SEQ ID NO: 24822 - DNA, 520 bp, Zea mays
  Clone ID: cC-zmle189022a08d1
aaaaggggaactaaatgcaataacaggatccaaattaaaacacaacgaattagggtttatgggccaacaaaggcaccaaactatttaaatttttgagaatggcagcagcattttttttttccccagattattgttgaataaagtttttttggcgaagtttttaaagccatagaagggataaacaagggcctttttttaaagggggttgacttttttttttggggggggtttaaaaaacccccaaatttttgctcaataaaggggaaagggggttttttttggactctttcccccctttttttgggggcgcaaaaaaaaaaaaccttgtggtgggggaaaaatttttgcccccaaaatatacccccccccctctttttttttttttataaggggtggtttccttaaaaattttttttggggaaagaaaggtcttttttccaaaaaaaaaaggcccccccggggggggagaccccttttttcacacaattttttttttttaaaacacacatatttttttttt

SEQ ID NO: 24823 - DNA, 439 bp, Zea mays
  Clone ID: cC-zmle189022a09d1
cctttctttcttttttttttttttttttttttttttttttttttttttttttttttttgttttttttttttaaaaaagggaaggggccccttttggttttgcacaataatcaggggagcctcaccccttggctttttgcagaatttcccttacccaaacactaagagcccaattccctttttgccccaccccttaaagaatcaaaacttggggggccccctaaaaagggtgaacttttgtttccccccaatttgcccaaaaattccttgcccaaggatttttaatctttaaccccccctgattaatgaaatagcaaaacgtcccctaaccctttatttttagcgccaactgctttcacattagtggttccaaggggcaaagtccctgaaggggaaatcaacgttttgggaccttttctttttctggggctatgcccccc

SEQ ID NO: 24824 - DNA, 442 bp, Zea mays
  Clone ID: cC-zmle189022a10d1
cggactcaaaatctttgattagactgaaaatagaggtttaagcatactattaaacatgggggaaggatgattatactcactttagtatgaaagggcaacaaggctttattagagattctatatcgcatacaatatcttacgctcattgtttagttgctcaaaatctgacataacagactctgaaaaagaccttgacctgctttccattgaagatttccgaatgctccttaagtttgaggcctcaatgcgatgcctaatgacccgagaactcatggggcccaaagttgaggccattatagatgtccctatgattgtgactccaattgcaagccacttttggtgcttccccaccactacaaatgacagtgctctgaaggccacagagataagctcacaagccaaccacattagtttgttaatgatggccatcatctggttcttt

SEQ ID NO: 24825 - DNA, 373 bp, Zea mays
  Clone ID: cC-zmle189022a11d1
ttgacgagctgactagctgagctagccggccttcgtcctttttttatactaactcatctttttttattaacgacaaattcaaatggattcaggtcacttctaatacaagactcacgctttcacaactgattaaggattctggttccgtgaattacccattcatttaatacctgtaacagtactaaagcacccatacggtccttaggtagagattctgtggtgaatttcaatgaaagtcaaccccttcttactagaacgatagagcaaagtgttacgcgccttattcagaccattggggtgttttactgactcaaatgtggtctactatataggcgggactggaacgttttagagcggccaaacaaacctgtta

SEQ ID NO: 24826 - DNA, 407 bp, Zea mays
  Clone ID: cC-zmle189022a12d1
ttttatatacaaagatcattttttgagctttgacatcaagttttcatatttctacataaagatcttgacataaaatctaacatggctaatctgcactcttctggaatactaccaccacctaccatgatgatgaacttgacataatatataaaggatcgctttcatactccaagcgacttattggcttcctaaattatatcgatgaggattgtctcagaagctgagaatacaagcccttaataaatcacagagccacatttatatgtaatgagcccttctgttcctgtaagcactcctacattactaagcttcaccatggattcggccaaaccattgtctaaggaaaattggttgctgctgccataatacaccgtaggagcagcccctctagccttaattagtgcttg

SEQ ID NO: 24827 - DNA, 444 bp, Zea mays
  unsure at all n locations
  Clone ID: cC-zmle189022b01d1
attcggctcgaggaaagttctctctctttgactcacaaccctattgcgtgctttgcaatcgaccccgcttatggccaacagtaacctccctcgaagaatcatcaaggaaacgcagcgtttgctcagtgagccagcgcctggaattagtgcgtccccttcggaggacaatatgcggtatttcaatgtgatgatccttggcccgactcagtcgccatatgaagggggagttttcaagttggaattatctttgccagaagaatatccaatggctgctccaaaggttaggtttctgacaaaaatatatcatccgaacattgataagcttggcaggatatgtcttgacattctgaaagataagtggagtccttgccttgggattcgcactgtacttntgagtattcaagctcttctaagtgcacctaacccagatgatccactttctga

SEQ ID NO: 24828 - DNA, 525 bp, Zea mays
  unsure at all n locations
  Clone ID: cC-zmle189022b02d1
agaaacaaagcgtatatcataaaataaggtaagacatcaattcatgttgacacgaaattgaccaaaaatacggcttactcaacttcaaaaagtatccaaaattttggacctagaaaataaacagcacatgtaaataaaatgattgactgaacgcaaaataagagagttttagttgtgcaacgatgacatggaatctgcaatgaactttcactcatcatcttcatcattatcagcagcagagttgatagccgccacacgagcaatcaacttagccttcctctcctcataagtgagtttcttcagattgtacctcttgtgttccttcgggggctgcttctcagatttcttgagagaaggatcagcacggatggcagcatgaaccttcttgtacagtgcctcaataccatcagcttctattccacgcttgatgtattcctgaagtgtgactgatatttctcaggttcatcttnccgcagatcttcatataggcagcaacatgtccaccaaaaacatatttgcgatgca

SEQ ID NO: 24829 - DNA, 555 bp, Zea mays
  Clone ID: cC-zmle189022b03d1
ttttagaacacacgtgaaattggtattctgcttgatgagacgtaactcctgtttctcaacttagaaattggacaaaactttgaaaagcttagctccttagagcagcaaactatttatttctttttagttttattttattttgttgcacaacggtgcttcatattttacacataaatatttaagtaccatatcttacaagggacctatcgctccaaaattcttgaacaaccaaaagtgactgaactcgagcgagctttgatatggaaaggcatgtaacaaacaacctgcgtatgcactcaacttagagcacaccttggtacataggacaacttgatcaagtggttgtggaattgtccattatgtgataactgtaggcttctccctccctgtgaagtctttgagctttgacatggatattgccaaatctattaatggttttaaggcaatttgagcatcaacatcatgtttagagacatctggttcaaactgttcaatgtacactctaacagttgcccctgcagaacccagtacctgataacgatatataatccttga

SEQ ID NO: 24830 - DNA, 567 bp, Zea mays
  Clone ID: cC-zmle189022b04d1
agctcactacttcgcgcggctcgtcctttttttttttttcaaaacttagcttttgctaatttttctaatctgcatatgggaaggaatatattgatcctaaaacaaatacagcaacaaaatatatccttgaccaaaacctttaattataagatcaagctaacaagtatatctacagaagagaaaatcagagatcccaccaaggaatcatcgtcctcttgaaattgctttttccatctcaccgtgtgatgaaggaaataactctatgtagcgactgccaagtgtcatcctatcctttatcattgctgcttttgaatcttcagcactttcgaattctgcataagcctccccagaaggtcttccctctgaattcattataaaatgaatagaatcctctggcagcccaaaatccttgaagaatccattatgtcacccttactttgcagaaaaaggcaatccccttagtcgcaacaccccggggtgccaagctggatctttccttcatcatatgaattagcccgggaagcccttcgacgaggtgaaccacctcgagcttttgaaaccttattt

SEQ ID NO: 24831 - DNA, 434 bp, Zea mays
  Clone ID: cC-zmle189022b05d1
ttttggaactaaatacaatattatacttcctaagtccatggtcacgtcgtttgagagtacaaggaatggaattagacaattagtagtgtatgatgtagtattacacaaaccccaaaagttgatagcacaatacactaaccaatgatttatatgtacaagttcttggcttgccctgcattcatcccaccaactgtacaaataatatttgaaagcaagatgaaatcatacacttagcacacaaaataaagctccttcaatccgatttactttttgaggttgatttatcttcttttccaggctgcactagaaatttgaatgtccacactgctaaaatagttgcttctatgggagcaagccaatatacaaggaagtgctcctttgttatgtgatcgcctcgagcatatgcccatcccattacagatgcagggttcatg

SEQ ID NO: 24832 - DNA, 483 bp, Zea mays
  Clone ID: cC-zmle189022b06d1
tttttgcaataaaacttgcttcgaaatctccatacttgttataatacaagcagccagcatacagtgtagagatccctataaatagatcatgaaattcaatgcacatcatcttcaaactatattgatatctaattaagttttcctatagcctcaaactttcagcctcatagataattacaatcatgtctccccccatctttaaagtactcacactgatcatatctgtttttgccatcttgcaaatatcaacagctggtgacccagatattctcactgacttcatagtcccacccaacaccatacctaatggcaacttcttcaccttcactggcttccgtgccattttttcacccaacaacattgtctcagctttcaaagtgttgaaggcaaccaaggtagaatttccagccctcgaggacaaagtgtctcatatgcaatccttgagttcccaggtggcagcatcaacccaccacacacacaccc

SEQ ID NO: 24833 - DNA, 505 bp, Zea mays
  Clone ID: cC-zmle189022b07d1
ttttagaagatgagattacttttaattaaaataaaacagccaccataaaaaatgattacaagtcgcgcaaagggacacacactgccactaccagccatcaacaccctgtacctcacattcatctctctcaggaacccaatgcattgatgaccacacgatacttttgatgcagacagataacactaatagtaatataatacacataacagagaaagttactaccgcactgaataaccctaattaaagtaaaatcctcaggaatgatcaacgcagaaacatgtttgcggtggccataatcggttgtatcggatgaggaatctgccagggcttgaggagaggatctggaatctcgggaatctcaacggataacccttcgacctcttcagcgatctaaggatggagttcaagaagcgcaatcgatcggccagttccattgtctgtgctctcagaatgctgttcgccgcttcggtctcgacgcacgcttcttccttggcctctatgttct

SEQ ID NO: 24834 - DNA, 287 bp, Zea mays
  Clone ID: cC-zmle189022b08d1
tttttaatttcaaaattataaacctaattcaaatatttaacttcaaccaaacaaatttaaaacagaaatccctacacacttacaaaactcaaggctctttctgtattcagaaaactctaagtcactgaccacacacaactagagctctcagcatacaatgaaagaagaaagaaatttctaatttgaagccgtgagcaatgaaagatttatttctaatttggagctgaaaacgtgagttcaagttcaaaacgtgagcactggtatttatagccaacaaaccgccattg

SEQ ID NO: 24835 - DNA, 417 bp, Zea mays
  Clone ID: cC-zmle189022b09d1
tttttacaaaacacaacatttttaaattcatagcagttaagcactgcattagtacaagagtttacattacaatgtgcaactgagcatacgacaagcttaactagtgtgcatagaatcgcactttccaaaggcgagggttcagatttttcacctaaactacgcattagagtattgatttttaacatacccaacacaacatatatataaattaaggataaaaaaaaaaacacaacagtggtcatttcctgcaaacaattcccaacccatatgaaaacttggggcgatcaagggtgccatattctatcacttgttggggagtgggctctttctcagacgaactttcctgtgagaacacgcaagaaccacgctgaggagagagcaaagagcttgaactgtgcttgtgttgtacaccaacaa

SEQ ID NO: 24836 - DNA, 379 bp, Zea mays
  Clone ID: cC-zmle189022b10d1
caacgtaattttcacgttaagtagccaacgaaacaccgttaaaccaagaaggggcaaaggctattttcatagtttttgttaacctcgggcgggaccttctatagggcatttttttaatattctaaaagacccttaaaagaaagcaatgaaaatgaaaagaaaaagaaaaacaaagaaaaatggggggggcctttgcaagcctgcccttatttgtatacaacacgtgtgcagctatatgcatattcttcaacaaactcactgaagggaagtacttttccctttagctagccactggctcatgtttacctttgttcaagctttgtgcatgtttcccaagcaaacatacttgatctttaaatatttatccatcccatatttg

SEQ ID NO: 24837 - DNA, 494 bp, Zea mays
  Clone ID: cC-zmle189022b11d1
gaattatacatcaaaagtaccattcattctgaaagtaataaatagaaggggaaaatatgtttttagcaaacatttaaatagaagggaaaaatagatgaaacctgggtgattgaattatacaacaaaaaataccattcattgctgcccgttttgcccaaagactagcttccaccacatgaacaaactgcactgaatttacttacctgtcaagctagagttgccctcttgccttttgtatcccttgactgggcagcaaccgatctttttgaatccaggaactggtgatatatattgccgaggctgctcttctcttgttctgaaacagatggtctatccttggatgctgtgaacttcagaagagcatcagtaataactggtgctttttctggcctagaggcatccacactgtccagaacatcatgaaccgctgcaagctgcgcatctgagaggagagcttggagatcagctccactgaatacctcggtcatattagc

SEQ ID NO: 24838 - DNA, 435 bp, Zea mays
  Clone ID: cC-zmle189022b12d1
cggagtcaagttcaagtgaacttctcattgatataataataagcgatccatatgaaatcattattcttgcacatgcaataagccgaccgcatttcacattatccaaggaacacatctagatgtagcactcgacgcacactaatatagaggaaatggctggctagctagttttacttggggcaaccaggccattggacatgcgggggagaaagtgttttaagaaccggattcctctcgaagaaatgggcaggcctgagctcgaatgcactgctcaataatggcattatggggaagtcttcctgtgctggaacatgatgaattaccacaacgtgccacagcacaatgtcctggtggttaatgacactattctttttggtccaaacggcttaagtatcatttgcatggctgtgatcaacgcagagtccaccaccccac

SEQ ID NO: 24839 - DNA, 441 bp, Zea mays
  Clone ID: cC-zmle189022c01d1
cttcggattgaggctagaggctacaactaccacaaccgctcttatcattttaatacggctatcttagccgggcgggataagttgactctaattgcctggacatggttcactgcagagccttggacctatgcttaatggacgtgctggatcgatcgcctacttggcagaacacgagctcttccatggagccgccaatctccaatggcttgatggctgccctgaagcgggcccaggcccaccagcaccgtggctaccctgagcaacagcatcagccactcctcgcggtgaaagtggagctggaacagctaatcatattcattctcgacgaccgcagcgtgagcaaggtcatgagagaagccagtttctcaagccccgccgtaaaaggcaccatcgaacagtccctcaacgccggtccctccaccgataattccggattgggat

SEQ ID NO: 24840 - DNA, 220 bp, Zea mays
  Clone ID: cC-zmle189022c02d1
ggatgaaaccaggggggggaatgttgtatacacaaacaaagggagtatctatacaccaaaattacttacatcatatcatataaacaataatataacttttaaataataattcaagcacaaaaattacactttttaaatcattaaatattccccaataaatcaaaactggctagacttttaagctggttcaattttaagttcctgaaaacggccatttttt

SEQ ID NO: 24841 - DNA, 329 bp, Zea mays
  Clone ID: cC-zmle189022c03d1
ggaaccgaaaaaggaaaacattccaatgctaagtttaaaataacttcgaaaaatcaacgatcaaaatcggcccttggggattacccgctcccaaaatgaagtaaaacctcccattttaacttgtttttgctcccatataagatttagaaaaatgccccccttaataatgtaaaagcaacttaatctagttcattctttgggctgcttccttggcaaggagcttttccttggccctggtcttggcttgggacttcaaacccatgattccaccaccccacttttttctgtattcatcgcacttggcattgaagttggccttaatagcttta

SEQ ID NO: 24842 - DNA, 506 bp, Zea mays
  Clone ID: cC-zmle189022c04d1
ggccttcagacgtaattagcatattaggaaatatttcacgtgtcacatgaaaacagtctggaatcagaaactattgaagtttcattttataaacatactacagaagtggatattaaataaacatcctatcctagcgcgacgtccaaatataaacctggcctccacttgtagctcctgctagcatcccaacctcgtaagagtgtgtatcaaatctgcaaggaatggcagacatgtgctggctctctagagtcataactattttcctttcaactgatgagacaacatcaactcctcttttcatgtttccaacaaagagatatgagtcatcccaaccccattttgctctgaaagtagaaagccatctgccagtcagattgttatgattaataacagctgcatcctccaagttaactccactgtaaataccaattgtgttgtccaagcttgtagttgccaggctacatccagaaggagagaagtaagccgattgcacagatcttttgtgg

SEQ ID NO: 24843 - DNA, 482 bp, Zea mays
  Clone ID: cC-zmle189022c05d1
agataaaatcaaacaatttggaattttttaaaagatcagtctcaacaaaagtttggccaacttaaggggggaaaaaactcactactcggggatccataatgtcaaaacagaaaacactacaatatgtttataagatatggtaaccgaatagaaatccagcatttgcatccaattaacaaaattatgctttgaggcgtacaaagaacttctgcttctcctgtgtggtctggaagcgaccatgcccaaactttgaagaggtgtcgataaacttgagcttgatctcctccagagcaacacgagaagtctgcttaaggagggattggcgcaatgtaataacccttttcttgggaccaacgcagcatcccttgaccatgatataatcatccttaacaacaccatagtgagggaaaccacctattgcggtaatgtctttctcggtcctatcaaactcagtaagagcagagtgagattcatctccagct

SEQ ID NO: 24844 - DNA, 481 bp, Zea mays
  Clone ID: cC-zmle189022c06d1
tttttgtacgttaaatgcgtatcagcatagatatactagtagcattaaaactagtagtttaggacagagttaacaaactcgcacggatattggccatgcatgatattgaaatccagaatcacttgattacataaagcatgtgcatcccaattcccaaggcgtaaggcgtgcagctaaatgtacataccgcatgaaaatttgacaaattctatgaatgtaactagacaattagtagatggataaaaaaataaaagcacgcctaacaccaattacgcaggatatattgagctgaaggtagcacggggtattaaatgaacgacacaagtaactggtggaacgctcgcgagctttcattttgggtcccaccaagggtttctggatccaacattccacatgattaaccaccgtctaccaccaaaggaaaatactcgtcttgaaaaaagaaaaccctagcgattcctctcagcaggcaatggggcga

SEQ ID NO: 24845 - DNA, 303 bp, Zea mays
  Clone ID: cC-zmle189022c07d1
aaagaaggagataattaatggaagtcatgcttttgctacaacatgtgttgcaaagtgcaaatcaccttctgcgaatgttactaataagccaactatggatcaacaagttgctcttaataaggtggtttgggatgagagaagttgttaagcagctgctagctcactcaaattaatacagtatgtttcagcagtcgagttgagagcaacctttccaaggactaacttaactttctactttaccagctaataagccgaaggcacatcatgttgtgggggacccttctgaattctttccattatttt

SEQ ID NO: 24846 - DNA, 484 bp, Zea mays
  Clone ID: cC-zmle189022c08d1
tgaactgggtcccggatctgactgctcactggccggcctttttttttttttttttttctttttttttttttttgatttccatttattctttggttaatacttacattatttttgatatacattgaatatgcattaatcaatccatgattgcttaagtaacattgtatttagcaagaaaacacattcacatgtttaagcttcaaaacactaattgaactgttagagttatacctcatgcattgttttaatttatggacacgtgtggcatgaccaaccccctgtttactaaagatcaatcaacaaagtttttttctcaccgcgagacttggcgacgaaattatggcgactcatgggatacatgaccgctggtggaccggcaatacgaggccttgcctggaattttttgtgagtctcttatggccactcattggtagaaaatagtccaggggtagaacctccacatagctttttgggtgaaacataa

SEQ ID NO: 24847 - DNA, 498 bp, Zea mays
  Clone ID: cC-zmle189022c09d1
tttttattaaagctaaatatcattaaacacctttcaaagtcttaagacataactgtcctagctctgtgaatcagaactcaaattattggcaaggtctttatcataccaagactaatgttccaactatcaacttatatatcacaccaaaaaccgcgcatccaaatctcaatgctcaaactcgtgtggatctccaggttttttccacttgaaaactttagtagggttcaacgggggtacggaagttagctccggcgtacactgcttcagcaccaagctcctcctcaattctcaagagctggttatatttagcaagacgctcagacctgcatggagctccagtcttaatttgacccgtagccaaaccaacagaaaggtcagcaatgaaggtatcctcagtctctccacttctgtgactggccatgacaccccatccagcttttttggacatcctgacagcttcaatactctcagtcacagaaccaatttggttgaccttga

SEQ ID NO: 24848 - DNA, 407 bp, Zea mays
  Clone ID: cC-zmle189022c10d1
cacacaaaacaagcagagatggatttttaaaaaagccaagcctaacaacatgattgagagtcattatgtgcctgttcatgattagtacttaattagacatgcatctcattgttttgtttgaggaaattttataacaaaccataatgacccagattagctataattcaaccacttagcaatgcccatccggggctgctgcagcttaattatccttactttagtaactaagccaactgggcaccgcatttacaaaggatggggcaggtcatgaattgggcgactaggctagctcctgttcttggattttgccatggcttttggggcaagaccaagaccaagggcctcctttcctttcatgatgcgaaaacgcttgcatgattaaacaaacatttcccatgggacattac

SEQ ID NO: 24849 - DNA, 461 bp, Zea mays
  Clone ID: cC-zmle189022c11d1
ttttattaacaagtcaacacgttatatatcaacatacgctagaagcttgggggctttgcccaaggcctaaagggcccattagttttcaattatgcaaaaatcaattctaaaatgccgatgaacccaaaacattacttgctttaaatttttcaactttcctacataattttcaaacacaccatttcatgtcacactatgtgaagatccgtgccttggatagtctagttgaggcaatcttgttccattgagtgatagagacacctctcctctccacaaaaccgaagacaacatttacagcattgatatccaaatctacgaggaaacaactcgacctttttacaaatgaagaatctgcaagaagctttgaactagttctacactaatgttcttgggaaatggaaatgtgatctgccctcagatgagaatgttaccttgcagcatcctgagcacctgagacattc

SEQ ID NO: 24850 - DNA, 489 bp, Zea mays
  Clone ID: cC-zmle189022c12d1
gcaaataaaacatagttgcttgaagaagcaagggttgcaaatgataaaaaggaacccacatgagttgtagaacatattaatcttacctggctagacaataaagaataaagagaagagcttacatggaatctcaccttttgattcctgaagaaaataattaaacgggcagtcgttttagagggttacagaaaatgaaagactactgtctacagttttcacatgactagttattttaccactcatatcatcatagcttttacaaccaagaataattttttttttacaatgaagataacacaagcttctagctgatacatctttggccttacaaaatcgaactcaacaacctggccaaagtccaatccaccccccttcaccatccaatccgtacattctatatttatacagcctcagggtttgaccaccagatgcaacagtgtgaaatgctttgtttttctgatgtgaactctagcagcagttaagccaaac

SEQ ID NO: 24851 - DNA, 456 bp, Zea mays
  Clone ID: cC-zmle189022d01d1
attcggctcgagctctacttagcaaatcaaaatggcactttcttcttcatcttcaacatccatatttgctttagctttgttcactactcttttgcttataggaagttcttcagctcaactctctgagaacttctatgatagtaaatgtcccaaggttttctatgccgtaaaatccgttcttcaatctgctttggctaaagaacctcgccagggagcatctatcgttcgcctcttctttcatgactgctttgtcaatggttgtgatggatcagtgttacttgatggcccttcctcggagaagattgcacttcccaacaagaactctttgagaggttatgaagtcattgatgccatcaagtctaaggtggaggcactatgccctggagtggtgtcatgtgctgatatcgttaccattgctgctcgtgactcttgtgcaattcttggagggccaaattg

SEQ ID NO: 24852 - DNA, 499 bp, Zea mays
  Clone ID: cC-zmle189022d02d1
ttttgaactttttagtacttcagagttaaactttcatattcctatcttaatcaacacagaaatcttaatttgttcacccctgcttttcaaatgaaagcctattacattcacacaggtacactccatccttcaataccatgccagaaaagaagtcgatagccccaaaaaaaattaaataaatattacacaatttacactctcaactagctattataattaaggggggaaaaatgggttacagatattgaaggatgccatttcaaagcagcatcacctctgggcgtatcaacagcagttgaggacacaaatcgattcagtacccgttgcttacactttcttcccagaaaaaaattgtcattctatgaaaatttaaccttttctgatgccatggtagctgcaagcctcttccaatagcaaaatcacaatatgcatcatgccaacctaatactgcacctattggaatacagctgagcatccttgaatcacaaggactcacatg

SEQ ID NO: 24853 - DNA, 373 bp, Zea mays
  Clone ID: cC-zmle189022d03d1
ggggggggcccccccaagtttttttttaaaaaaaaaaaaacaaaggccccattttttttttccaaatttttttttaatttttaaaaaaaagggtaccattttttatttaaaaggggcccccccaaaaaaaccctcccctacaggggaacaggggacaaaaacccaaaagttgcttccaaacccccctgaaggaaaaaaaggaagcttttcccaaattcccccccccatgaaaccatttttaggggcccaccccctaaaaatgcctttggaattgaaaccaaaaaccccttccccagggttggcccccgcaatggaaccccccctccctttattgaaacgggggttgaaaaaaaaaaccacgggtttttgaaac

SEQ ID NO: 24854 - DNA, 453 bp, Zea mays
  Clone ID: cC-zmle189022d04d1
acagaaacagacagctatcttagtcactataatcaaaatttgagttctacaaagtaaattccacaggtgtggttcataagacaatgctgtccacagtcaaaaccgaacccaaaacactcattccaaaagaaaagagattaagatctgttaatcattgatgtcagacattacaaggaactgtatgaacacgtgcttaaaatttaatgcttgattcaactatgcaaccactatatttttaatctttggtggcagtaaattccatagtgcctgaaacccctttggttggagacgcagagttgttactagaaattgcaatgacttcatgatctaccgtttggactttgatttagtcaaagtttccagaagtctgtacatccaacggtcaagcattcctgtcacagcaaaggttccacctagcacagcacaaagtcgagtaataaaatgaagaaaact

SEQ ID NO: 24855 - DNA, 364 bp, Zea mays
  unsure at all n locations
  Clone ID: cC-zmle189022d05d1
gttggtggtcgggttttcaattttgattaaatgaacaatattgaaggggcttaattaatttcatgcacataataataatctcaagctgtgactgatgtctccacagctagctttccagggtatgcagcttctgattttatatcagcctcccatagttcaggcacagcctccctaaggttgtgaatgctttccaaagcataatctgcacctttacatctttgtgatgtaccaaccagcacagtgtgaagccccacacgttttccagcttgtatgttgcgggtactgtcctcgaagaacaaagttctctgtgggttaagattggctatattgagggccagttccntggcattttctgatggcttgc

SEQ ID NO: 24856 - DNA, 319 bp, Zea mays
  Clone ID: cC-zmle189022d06d1
aaagaagtagataattaatgtaagtcatgcttttgctacaacatgtgttgcaaagtgcaaatcaccttctgcgaatgttactaataagccaactatggatcagcaagttgctcttaataagggggtttgggatgagagaagtagttaagcagctgctagctcactcaaattaatacagtatgtttcagcagtcgagttgagagcaacctctccaaggactaactcaactttctactttaccagctaataagccgaaggcacatcatgtagggggtgacccttctgatttctttccattattttgcgtgcaagggatact

SEQ ID NO: 24857 - DNA, 289 bp, Zea mays
  Clone ID: cC-zmle189022d07d1
tttttctgtggtccaaatgttttctttggtgacttgtaatttaactagcaccaaccatcacgtgtcatttgttaaaataacagcttaataccattgatttcaaaatgaagggcacagttcacgatgcgagaagtttgagcagttattaagctcggcatattagctattctaagttctagcatacatatatatagctgagccttgcacataatatcatatgtcacatacttggcagaatcatgtcagcctaactagtcagacatgcagcgcagcatccatggggggatga

SEQ ID NO: 24858 - DNA, 424 bp, Zea mays
  Clone ID: cC-zmle189022d08d1
agggccgaaagaacactatcattatcgctgaacaatgttatttaacaaaagtttcaaccacaaataaaaacaacaacccaactttccaatcatagtcacgtccagcaaaatacattcaaaagctatctaaaatctggggaacccacattggcattaaaaaccatgaccatacaattttttagagaaatattatgggcaccatgccttttcaacaatcccctaaacgttgcttaggcatcagcaaacccaagctcggaaagcttttggtgagcctcagcgtaatcagcaaagaaggcatcttcgtccgctgcatatttatcaacgagagggcggaatacagggtcagacaaaagagccttgtcagaaggtagctgaaggagacctttcttcttaccactcaacaactccgtgaagtatgagttgt

SEQ ID NO: 24859 - DNA, 456 bp, Zea mays
  Clone ID: cC-zmle189022d09d1
ttttaaagaaaattctaattaacacgttacaaaacctagacacaattctgccataaaaggaatttccagtatttacaactttcaatttaatgctcaaattacagacaagtttttgaagtaaataaatagtttgataaaaactattattgattggcaacacagaataatgcaagatcccccgctctgctgaacaaccggtttcccttgtggcattagcatgtgcaaaagccgggagaaaagtaacatttctgctaaaatctcactgagttttagcaagggaaactgaaaaatgcaagaataccacgtatagcttggtccaatacgcctctacaatcaaggaaatggaaactacccaatactcaaacaaaatcttagagttgatcatggcttcagctatagagtggttgcaaagagtttttgaccagggctgctggtcattttgtcagggatgcagca

SEQ ID NO: 24860 - DNA, 513 bp, Zea mays
  Clone ID: cC-zmle189022d10d1
aagagaaaaacaagtatttccatgttatttgcataaagactaaagagaattcaaccaggaaaaatcagaaaggaagggaccagtatattgaattgtgacagaagccaaatagcaaccaccacgtgaatcaactcaaatgtactacaacttggaaatcactaacttattggaaaagctttgattacgcactgcagcttcaataagacttctcgcatcaatccctttctcgtgaaaatatgttttaacaccaaaaataatgttgcaactaaactgaattttaaatttgagcagaagtaacccttcatttgtaagcagctttcactgctttctgagcagcatcatctaaatcttcaggcgttatcaacgccataccactttccttcaaaattctttttccatgatcaacattggtgccttccagacgaactactacgggtacttttagtgcaacctcttttgcagcattcactattccacttgctataacatcacacttcattatacccccaaaaa

SEQ ID NO: 24861 - DNA, 457 bp, Zea mays
  Clone ID: cC-zmle189022d11d1
ttttgaattgaaaaaaaaaagctgttattgattcctgacagaatatttcatgaatcatcctgcatattccagattgacaagccgaaaattatgtacagttacgaaaaaaactggcaggaagcacagcagcagagctatcatctcaagccaactctgctgatgatgagcatgtgtaagtccacaccatggaatatgaagcattttgcattttagcgccttcattgctgcttttgcaaacacttgagcagcctcagcctcagcttctgcagcctcagcctccctagctgctgcctcagcctgtgcaattgcagcctctgcctctgcaactgcttttgcagctgcagcagctgcctcttgagctgtcaagcccttcactttcgaaatctctgcatgaatttgggattatgaaaggatggtgacatcatcattcttatgtacttctgaaggatctttgggc

SEQ ID NO: 24862 - DNA, 435 bp, Zea mays
  Clone ID: cC-zmle189022d12d1
ggagcaaaacaccgcaatgattaaatttaaatcctcaaatccacgtcaaaaaatgtcaataatacaaccccaaaaacatattttgtagcatacacaaaaaccattaactaagtaacatggtccacagacgcacaattcctactcaaattgatcatcatcgtcgtcaggaaggggctgactagcagctgcaagaagctcagcctcgtgctgttgttgcgcagctaaatcaatttgaacttctgggggagccaatgcaggagattctacaaagtgcaagttagtatcgcctgcaagtttcctggccaagtacaaaaatggcttttcaaaattggagttgctcttagcagatatctcgtagtactgcaaattcttcttcctgtggaaagtaacctgctttgccttcacttgcctgttcttgacatcaaccttgttacc

SEQ ID NO: 24863 - DNA, 406 bp, Zea mays
  Clone ID: cC-zmle189022e01d1
attcggctcgagttggacaattcattcatataattaattttctctcttcttcttctttctccttggtcgtattcacattagatcagactatggatcgcccaacactatcatgattatttacattcctactaacacttcatctatcattatcaggggtgatcacaacaacattcactctagttaacaaacgtgactacaccgagtggccgggaattctttccaatgcgggtgttcctcctttttcaaccaccgacttggttctgcaaaccggcgccttcaccacaatcgccgcacccgtgtattggggtggccgtttctggggcagaacactctgctccgaagactccaccggcgaattcttctgcgtcaccggcgactgtggctccggaaagctcgagtgcttctg

SEQ ID NO: 24864 - DNA, 515 bp, Zea mays
  unsure at all n locations
  Clone ID: cC-zmle189022e02d1
tttttaaacataattttgggcattgattcccattcataccaaggtaaagactaacagaatttgaatacatgaatatgcattaatcaatccatgattgcttaagtaacattttatttagcaagtaaacacattcacatgtttaaacttcaaaacactaattgaactgtaagagttttacctcaagcattatcatcatttatggaaacatatggcatgaccaagcaccaattaactcaaaatcaatcaacaaaaattattactcagcgcgagacttgacaatgaaattttggcgacttatgggattcatgaccactggtggaccggcagtacgaggccatgcctgcaattttttgtcagtctcttctgcccactcattgtttgtaatagttccaggggtagaacctccaaatagcttttttgtctgaaacataataatcacaaacccatgccactncaaatgatccaagaatagcagaaatgatatacttgcctgacatgattacagactacactga

SEQ ID NO: 24865 - DNA, 492 bp, Zea mays
  Clone ID: cC-zmle189022e03d1
aatctcaataatgaggtaaggatacctgttagtcacactttaaacaaacatgtgatttagatttacaaaacaggatgctgctcatgtggaacatgagagaatccgaatctaataatcaataacctgtaagaaggaacctagagaacctttaaattacagtatagtaaaccactacttacttactatgtaactatgaatagtaataatacaagtactttgtcaccttaagatcactaaagaaagaaaagcttttgggaaaactaaattcacaagacctacggactacggtgtgggtgagttcagaaaagaacccaaagagaaaactaagtggttaatcggtggagccctgatctccatagccataagggtttttgctagcccaattccattgatcacggcacatctcatcaatgccatattttgccttccatttaagctctctttccgctttctttgttgatgcataaacaatttcagcatcaccaggtctac

SEQ ID NO: 24866 - DNA, 427 bp, Zea mays
  Clone ID: cC-zmle189022e04d1
ggggccaactcgtcaaagcaagaattttcgaaaaaacagaaacaaaacttttgcaaggtgactaaatatcaatcaattaaattacaatttttggacaatcatacacagaactccaacggatatgtaaggggcaactaaaaaaaaagcttgcgctacaaaagctatcaatcaatcttttttgaagaaagaaacttcctggggagatcagatttcaatttgcatccaagagaatgtgttttgatgaataagccaccaatctcttcctccttctgttcggatacgtagaaagctataaacgcaaaggtaacccctatagtatacaagctctgcagtgaaaaggctccaaggaagctgagaatgaacagagagagaacagccttgaagaacagcacccaatcattcccatctgcagggatttcaaaacatt

SEQ ID NO: 24867 - DNA, 285 bp, Zea mays
  Clone ID: cC-zmle189022e05d1
aaaaaccaaggcccaaaaatagatttttttcattaaccctaccatttatttccaccagaaacctaaccaacagtaatttccaaccctttttacgaggaaaaactaaaaacttttaaactaataaccttctatggcaacccctgaatattagtttaaggaaaggggccatgataagacaaaaaaaaactctttaggagctttgggacaatcacaagagtgagaaccttttttagcccctagcaccaggttccttcctttccaatttttgcgaaaagaacttggtag

SEQ ID NO: 24868 - DNA, 468 bp, Zea mays
  Clone ID: cC-zmle189022e06d1
tttttacctggaaactacatttattagagtatcatactctgattctcaacggtagacttcactagttttaaaatcttatcaattgtaacggtagcaattcataaactgccatacattgaaacatccaagaatcaattgaatggagcaatacgtgtcttccatactttgggcttgaaaatatgagaatgatgatgctttacagctttgaaatagcatatgtaggcagattattaaaccttttaggaagttccaaatctttccatcctttatcatcaagtttagagaagtaacgattaacatcgctatcactaagaagctccaatttggaaggttcccactttgggtttctgtctttatctatcagtatagccctacaaccctcgaagaaatccttgctgtagtgtccttttagaatatgacaaacaactctataattagaaacaaggcattgtccaacaccttggagcc

SEQ ID NO: 24869 - DNA, 384 bp, Zea mays
  Clone ID: cC-zmle189022e07d1
aaaaataaaatttaaaatatttcccatgatttgtttgagtccagagatgacagaagagaataacttaaaaaagaaaaatgacccactaaagggaagaacaccacagaggaaagggcaaacggctccccctgtcatgaaagagactttaatctacacttatccacaatcttgaagacataatcgagagggtcaaagaaacgttgcaaatacaaagccaaaagcatttcccattattaaacttgccatatcaacctccatctctccaattatcttctttccactagagccatcttcatgagaggaagacatttcaattttggggggtacttctggaaggacccaggggcttgggttgcccctgttttaaaaataaacggggggaaa

SEQ ID NO: 24870 - DNA, 218 bp, Zea mays
  Clone ID: cC-zmle189022e08d1
aatacaaaaaagacagtctattttttatgcaagttttacccaacatttggtgatttctagctttaaaccgtgttacacatggaataaagacccaaaaatgaatgacagaaatacaacatttgcattttacacttgacctttcatgaacacatgagcctcgatgactcacttttgctattaccaacatttgaaaactattgtagtattatgcaaccact

SEQ ID NO: 24871 - DNA, 417 bp, Zea mays
  Clone ID: cC-zmle189022e09d1
aaaaaagaaccgagcccagcctactatataaaggcttgggggctcagataagggtcattttatgtgaatggggagaacacatgcataaggggcagacctgggtcatggcatccgctaaactaagcatactatgtgaggtcactgtacaaagggtctcagcgaggctctgaagaccgttcacccggctttgctattcaggttacagtagcttcttaggtcccgatccatttgtgcactaaacatctgattctccaccagccttcaaccttcttacgatcttgaattgcccctggctgaccttatctgaaggaccaccaccatcttcatgtactctcaaacgccgacacataaaacccattcccttggacagagcattccacttctgactatggtgagaagaaaaattaatgaatggta

SEQ ID NO: 24872 - DNA, 527 bp, Zea mays
  Clone ID: cC-zmle189022e10d1
tttttacgccataaagagagtatcatagtcaactatgactcattgcttgcaacagaagagagaaaaaaatgaccgggacatgaaacgggatttttataccacatcattcttaagccccttttaatttagagttccacatttatgactgcatgtggtggaagaaagtaagacagctgctcaactcaacaatatatagatgcatacttaaaaatgctcttattatgtcatagaccaaagaaatttacaaactgaatagtaatactgcctaagttgcgtggctgacaaagatttgtctaataaaggtctgcatacttagtctgccatttcagaaagatgaattgaactccatctctgtcacaattatacagaagccggaaatttttgttctggtaacggagaacctttagacagtggtagtattgggggcactgcataaaaagaacacagattaaagtaatagattgttcaaatgctttggtccactgttccaccttctttcatcttctttcgcattttgtattgcaatg

SEQ ID NO: 24873 - DNA, 401 bp, Zea mays
  Clone ID: cC-zmle189022e11d1
aaaaaaaaaaatgggttaaaaggttaatttattttcatatgggtaattcaaaccccccaaaactttcctttttaggaaaaaaaggccccctaaacccttgggggggggtttaatcattttccataaaaaccctccccctccttcttttctacaaataaaactatttattttccccccctataaaacattctggaaaaacttctaaccccaaagggcgtttagttgaaggggttggggggaatggattagggggcccatttaacggggtttcctctccaggttctaacattgggatgacaaattttatagaggggcgattcacggggtgcccctggaggccccaaagcccaacaatggcgaatttcttgggaattttaatatccccttcatcctcaacagga

SEQ ID NO: 24874 - DNA, 552 bp, Zea mays
  Clone ID: cC-zmle189022e12d1
atgatctaaattgaaactcatatataacaataaaggattgtaattgttacattattttagtttacaacaataataatatatggtatatcctagctcacagttgaatctctcaaaaccccactgtctcactcacactagataaaaaaaaatagataaaataatagtagcatatatttaaaatatatatatatatatatatatatatataaaaaataaatcttgactctttaaaacaagaaaagtagtatccctaataagacaatgtgaagttgtgcatgcattaaaattgaaacagaactactagatttctggtcgtcactagctttgtcatcatcattttcttctttggggtgactgaaattggaaggaacaatagtgtctggtgctgaatcatcatctccagcaacaggactagcaggagatggagcatcttctggggatttaagactctttggcaacccttgtccataggtcacatttattttgaagtgttgtccactcttgcattggtcaccatcataatcacctgagaagaagtatgtcatgcctttc

SEQ ID NO: 24875 - DNA, 455 bp, Zea mays
  Clone ID: cC-zmle189022f01d1
attcggctcgagccttgatcggctcctggatgttcagaagcttgataatgttgacatagaaggagccatccatgcttattatgacattacccgtcaacagtgcataatatgtagagaattgagtgaagagcaactgaaaagatatacctctttgcattcagcttcgttggatgaaagcttgagaattgtaaaggactacttaatagcagcaactgcaaagactgcagttttatgatatgttttagacaaaggaaagcaggggattctggatctggatctatttgcagtaacatatatcttgagtcaactaagcaaacctttgacttcaaggtgtatttcattgacttggatttgaagcgaatgagtaaaatggaagaatattatgaattagataagaagatagtgagctgctatgaagaaatgatcaaaatggaccaagggataaattcacaaac

SEQ ID NO: 24876 - DNA, 365 bp, Zea mays
  Clone ID: cC-zmle189022f02d1
ctcacaaaaaaagcccagttttaacattaaaccaaaaatcatgccttggcaatacccatttccccaaatcactttctttccataaaaatggaatttttccccccaaaaaaactaaagaaaaataaaaaaaataaattttatgggggggggaatagtaatagtagtaattaaggattcggttttgcacagctaaatctttaaatttgccttaattggggcccaagcgggggttcccccaaccccccaaacttaaaataaaaaagaaaaactggcttaaaaattcacccccacaatgaaaaaactaacttgggatttcttccctctaatcccccttggctggttcggggtttaactactggaggaca

SEQ ID NO: 24877 - DNA, 452 bp, Zea mays
  Clone ID: cC-zmle189022f03d1
agggcaatattattattataataatataggaaaggagggtgacaaattacagtaatggcccatgccacatttacagaaccagcacccaacaatcccatccgttttacgatacacattcattattattattccttatcaccatatgggagtgattacaatttctcaacagactcaaacctagaagaagaagaagaaatcctcatcaaatctcagactcagagaccatggatctcaatactgcaatatatccgcagaagccataatagggttggttcagataccccatattcaacgggttgaagaagctattattattaattggctcaacgaaggtgctcgatgttgctgctgctccaaaacccgccacagtggtggcattcaacacgtcaacgatctcattcagagactctaacctgtgactaagctcacccacctgagccctaagcaccgag

SEQ ID NO: 24878 - DNA, 508 bp, Zea mays
  Clone ID: cC-zmle189022f04d1
ttttcaatcttagcagctgctcatttttctcatctgcatattaaaaaaatatattgatcctaaaacaaatacagcaacaaaatatatccttgaccaaaatctttaattataagatcaagctaacaagtataactacagaagagaaaatcagagatcccaccaaggaatcatcgtcctcttgaaattgcttcttccatctcaccgtgtgatgaaggaaataactctatgtagcgactgccaagtgtcatcctatcctttatcattgctgcttttgaatcttcagcactttcgaattctgcataagcctccccagaaggtcttccctctgaattcattataatatgaatagaatcctctggcagcccaaaatccttgaagaattccattatgtcatccttacttgcagaaaatggcaatccccttagtcgcaacacccggtgtgctcagctgattcttttccttcatcatatgatttagcccgggaagcacttcgacgaggtgaaccacc

SEQ ID NO: 24879 - DNA, 460 bp, Zea mays
  unsure at all n locations
  Clone ID: cC-zmle189022f05d1
ttttggcacaagaatcataaaataaatttcaaattaagtttccacattcatagttaacaccattcaaagtcaaaattctttagcacaaattttaacaagatctttttttcactcacgaataactcaacagcttaactctttgatgcctgcttttcttttgccttctggatcttcaatacctttttcacaattttttgctcttcaacaaggaaagcgcgaataatcctttctctaacagttccccggattaaaccacttcactggctcgggttacgggcctggcggttctaaggaatctagaccttttgtattcagcaggtcttaaagggtggaatcccttggatcctcttgccagtgacagggcacttaggtccacttgctctcttcttagtggtctggtacaccaacttcccaccaggggtcttaancaacccgtgctggttggatttggtagcatagc

SEQ ID NO: 24880 - DNA, 389 bp, Zea mays
  Clone ID: cC-zmle189022f06d1
cgagccgaaatccgagcaaacggacgcgggcaaggaaagtcaaagcccttcaataggggaaccaaaaaaaaattcacgggccggcgttaaaaaagggggggaggggaaaaacccgggggtaacccaactaaaaagactggcagaaaaaccccaaatcgccagggggagaaaaaaaaaaaaggcccgaacagaacgcccttcccaaaagggggccaacctgaaaggggaacgggacccgccccgaaacggcccaaaaagcgcgggggggggggggggtacccccacagagacccgaacacttgccagggccggagggggggggccttgggaatggttcccttcctttccagaaagttccccggctttccccgaaaagaataaaaacgggg

SEQ ID NO: 24881 - DNA, 387 bp, Zea mays
  Clone ID: cC-zmle189022f07d1
aaaactgaaaatcttgccttccaaggaacccattttaggcctcaaaacaagggctgtattttggctggtttggcctaaaaaacaaaacttagtttcgatttatatgtacaatgttaaacttaaactttttgaacatagtatttacatatgcccaatatttgacaatatgccacccaagaaaggggcaacaaaacgaacaaacattttattgttcaaaaaaaaaaatttggtttggggggtcgggcttttcgggggacccaggtgttgaatgccgtacccaaagggggccatttttcaacttttggggttgaaaagttgaggccctgttgcaacaatttttggccttttgaaataggcaagggggaaataattcccaaaaatgttttt

SEQ ID NO: 24882 - DNA, 385 bp, Zea mays
  Clone ID: cC-zmle189022f08d1
ttttacctattattattattattttcagtgttgttttaagaccacagacaagaacaacacatttctaattttggaaagtttacccttttgtaaatcaaaacataaccaacgcttccgttagcttttttgcggacaaaaccataatgaactgtttgcaccccctaaccaacccaccgaaatgggggaaggggaggtacaaacactcatatcaatcccgtttctggaaaaaatctttaaacacatgcagtttttcgagagagagtgtcccttggatccaaaagatgaaatgcatattccatggggtgcggggggaaaatcgtccgaaactaagctcctaggaaaatgctattggtcaacgctgtttttgaagaatgggaataccatt

SEQ ID NO: 24883 - DNA, 472 bp, Zea mays
  Clone ID: cC-zmle189022f09d1
aagccaaaccaatcaaaactttattacaaacttctttattgtacatccatgtccttctcttcacggaggacagaatcataccataactttatttcaacttaaactagtattaggaattaattgaagtaaaactgtataaaaccgcaatatcaaggttttaatattttacttattaggcaccttaatataccccacatgtgaggaattggcccctctagtaagggtttgaagatcataagctacccaacaccttgaattctccttgtggtagaaataacccacacacttgcaatccttggtgcatttgtttccacaagtactctcactcactctatcccctgtagtgtatttgctcatgtaatgctcaactccttcaattttgtagtagtggaaatcactagccttgcatgatgtcacagccttggcagtgcaattgttgctccaccaagtagtccattttccaatggacaag

SEQ ID NO: 24884 - DNA, 519 bp, Zea mays
  Clone ID: cC-zmle189022f10d1
acaaacaaattaaattaaaccagataaatgttatttacagcacaacattgtttaattacatggcaaagtagaccaaggtgtcaaacttattatatagttaattgcagctattgcatataacccattccttcccctttatttctttttctgcttttggtataatttttcataacgttaaatagaagacctcgtggaagaatcgctccctgccatcttcagagtactggactgtttcaccaaatcaaatgatgtgaacgaacgtggtgggactgtaacattcatgtcctttccaacattctgaagtagactttggattggcaccaccttctttggctgtgagaaggagttctcatccattacatttgcagatgtaagcacagtctttgttgacccagataactgcaatgagtttggttctagtccgtcaagagagaatttgaggttcacggcagtggtaccgaaattcacaacctttattcgtatgtaattttttctatctcagaattttgaaatgtaatt

SEQ ID NO: 24885 - DNA, 537 bp, Zea mays
  Clone ID: cC-zmle189022f11d1
gaacataaaatattagtcaatattatcatttaagtaataaaaacatatttaagccgactacaaatgataacatcacctaatattttgcaagactaatcagactatcatacatccttgcacatggggattggaaattttctactatttcaattcaacatcaacaatggccttcaggcaaaaatttctacaattaagattgatccgtaaactttgtttccgatgcctaatttaatcttaaattcaatcatttttgtgatgacttgaccacaaagagttagcaacactaaacccgtgatgtgcctctcatgtccctccagccaaaatacttgcaggaatcctgaactaagcctttagaactataatcatggatctactatgggaaatattgctgcaatgcttaggagtcactattgtacatttgaagccatgattgtgtttgctgaatgtaccatttgatgatgcctatgccaagccactactacacaatctaacaataaaacataactctcttcacattttctttcaaggctggcaatg

SEQ ID NO: 24886 - DNA, 491 bp, Zea mays
  Clone ID: cC-zmle189022f12d1
ccaaaataaagtgatctccgggttaataaagaacaatatattccatggggcctaaaagaacaaactaaataaacttatccaaaaattagattagataagtataaaaacttgtaaagtttttgtgaatcaagttagcaattcaccctgcaatttcctttacagcgccttcttttgaattaaggctcatcaaaaattaccctacatatattgcctccaatattcacaaagttttatttttttttttatattgagaaaatgttaggacagcactgtttggtaattccggggagagatcccagacaacaatcattctgggaggttccagagaaaatatacctagcagcaaaacttgggatttatatatatatatatatatatatatatatatccaaggagagacacatctccccaatagtcttaagtttccaacaaaaacccaacaaaaagcacataaagcaatattaatagggaagaaaaggaatggaagtccc

SEQ ID NO: 24887 - DNA, 377 bp, Zea mays
  Clone ID: cC-zmle189022g01d1
attcggctcgagcgaagccgaagccgaaaatgactacttgctaataattcccatttttttctccgaaactcaaaactttttcatttcaagagttatcatgggatcggcttgttgtgttgctgcaaaggatcatactattcccagcactagcagaactggaggtgaaagtttaaatagaaatgctgtatgttcgccaacatggagttttcaatgggatagttggggccgtgttgctggcgaaattgaggatccttcctttcacacatctcacagagtcagcagaaatgtcagcatggagttaaaagggtcattaagctctgaaagaggcaatttatctgattggggaagcacccttgataattctgtaacacccatgt

SEQ ID NO: 24888 - DNA, 411 bp, Zea mays
  Clone ID: cC-zmle189022g02d1
tttttgagaaatagaaagatgctatatatttattctttgaaatagcaaatgtcaagaacaacctaggatttcaaagggagaaatcctagattacaacttataagcatcattttgaaacaaaatcctaattaacagcgatatagctcaatgacaaacaaaacaagtagtccacaccacacacaattttccccagagattctgagtctcacatacatgaatctattttgaagcagtgaggctttcatagaagcctttaacaaacacataattcttagaaatactaagtctcacaccacatcatcaaatctattttgaaccaaaaaggctttcatagagacccttgaaaaaggagaaaacaggatctctagggggcagactttctttgacaattggatggttcaaaaattcttg

SEQ ID NO: 24889 - DNA, 302 bp, Zea mays
  unsure at all n locations
  Clone ID: cC-zmle189022g03d1
ctgccaaacacattttttaacataaaacaaggcccaagacatacaaacaaagaggaagtccacaaagggtacatggtcatcattgttgaaattgacctttattacaaaaacccagggaactcattccattcacatgggggcttgaaagcttggggaacccccntanaatntcttctttgcatccaaaacaatcttccttttaaacataacacattattacttaatataatccaaccatttattgtaaccaactttccttgataaaccaacccgcacgatttatttctttttttgagcaccct

SEQ ID NO: 24890 - DNA, 514 bp, Zea mays
  unsure at all n locations
  Clone ID: cC-zmle189022g04d1
ttttagacaacagtaacaccattcacattaaataacatccaaccaaagacatatcatccaatcctctttaagtattagtccatagtcatacatcaattacgatacacacaacacaaacccataaaagtagtaagtagggcacaactcagaacacaaatatctgtttcccacatgcgtcctacactacactgctgtaactatcccggtggaaacttgtgaacgagtgtgcccgagccaaccgcaccaagttacctcgatctctcacagccagtgaaaaaaatttcttcattttctctctaacatgactaggatacaaaaagaggaagcaagtttgggccccatatcagcgtgcactcgtttttgggacccttatctggaataaccaaccacacccttctcattaaaatggttcactcaccatgctatggtgtgagtgctactttctctttagtctaagacacggactaatgaataatgattcatagntcctttattgcgctggatacactgaaca

SEQ ID NO: 24891 - DNA, 484 bp, Zea mays
  Clone ID: cC-zmle189022g05d1
ttttccaacaatccatgcatcaagttcgaattataatttacataattattacaagcggtgaataatagataaaggtacagttaaaaatgcaaaaagccatgaagctcgagacatcaaacggggaacaaagatgaaacttgaagggacaggacacacaagtgaatagaacaagaagtcatatttttcaagttgaagctcaagggtaggtttcagaggctgggacagccgcatatgaaccaatgaagacgtctccataaatcaagccagccaaacctcctccaatcaatgggccaacccaatagatccagttagcagcgaagtctccactgaccacagctgggccgaatgagcgagctgggttcattgaaccgccactgaatgggcctgctgctaagatgttggcacccacaacgaacccaatagcaatgggtgcaatgatacccaatgaccccttcttgggtctgctgcagttgcatacacagtg

SEQ ID NO: 24892 - DNA, 256 bp, Zea mays
  Clone ID: cC-zmle189022g06d1
ggaaaaagaaaagggggaaaccggaccctttttaaaagggccctaagggggggcccgggcctttttaataagaaataaaggggggaatctttttcccccccattaaatttgcccaaacaggattttttttcagggccccccgggcccccaggaaaggggggaactttaattgaaaccaaggggccaaccttaaagggggggccggccatccggggggaaaaagggaaagaaaaaaaacccccttgaaccttcctca

SEQ ID NO: 24893 - DNA, 359 bp, Zea mays
  unsure at all n locations
  Clone ID: cC-zmle189022g07d1
ttttagatccaagctgggtttcaattacaattatatatctaattacaacaaaaacaacggtgtttcaggaggctgatttacctcttggttgacacactaattgttttcactactcttaaaatttcccataatttgttgataatttttctgacaattacaaatttcacacacccccgttgattaaaatacctatctacaagtactattttaattacaatcacaagaaatcagtaaagcaccacgcaacaccctgcattttcttcccctttcttttgtcaaaaacaaaattccacaacatcgggtgtccacgcacagttcccattntaggttctcctcaaatcaaccaccaccacgctcac

SEQ ID NO: 24894 - DNA, 352 bp, Zea mays
  Clone ID: cC-zmle189022g08d1
ggacaaatataataactcctttcaagcttcattgatttcaactgatcatagagatttcagagtacagaattcgtttttacaaccgccaaaaaattcaaaaggaaaaacaagttaaaaccatttttactaatattcagaagctggatttttactcctttacatcctcaaaaatccatgaagcattggttcaatttggtgaaaagaccctgcattatccgagccattttattgggagggcctcatatttacatatgctatttaataataatagggggccatgcatattatgatatgattgatgattccctttgggaaattaaaatctgggttgccgtttgtacaaaaattaaac

SEQ ID NO: 24895 - DNA, 402 bp, Zea mays
  Clone ID: cC-zmle189022g09d1
tttttaaggattaattcaaaccggtaaacacccacatgaattcttttaaataatatttctaacaaaaaataacatttgatgatgcattaatgttagtttgagaaaataaacgaaggagaacatggtttcctttagtattgatggacatggtgaacaagtttggaattccatgcaagaaaatgaagcagctaatgaagaagagagtagtaaaatgggggggtaatagagttaattagaagatgcggagggaagatgaacgggatagttattgatggagtcatcccaggggttgccacgccagtgctttaagaatggcatgtccctaacggacttacagacggcgctgctacacttgaaacccgacccagaggcgatctgccagacccgatcccacttggagac

SEQ ID NO: 24896 - DNA, 501 bp, Zea mays
  Clone ID: cC-zmle189022g10d1
tttttatactaacacaactctctttattaatgacaaatacaaatacattcagccactccaaatacatgacttaagcatacacaactgattaaggaatctggttccttcaatttcacatttatttaaaaccaggaacagtacttaagcaaccatagggtccttagatagagatactgttgggaattcctctgaaagtcaatccctcctcactagaaggatagagcagagtgtaaggcattttagctggcccatagcggcttctcaatgtctcatctttgttcttctctataagcttcttttcaatctcttcaagcttctttccaaacctcttaaatgcctctaatggaccggcatcagaagttcagtagtcaccaccatctctctgcccaaggtagaactcatcagatgcgtgccttgacaagatttctataactgtaaggtcaatgagggtctccttcttgccagtaataggcttcaaaaactccttctgatggttcttag

SEQ ID NO: 24897 - DNA, 423 bp, Zea mays
  Clone ID: cC-zmle189022g11d1
ggttgccaagagtcaacactacggtaatttgaagaaaaaaaaaattttgctaattcaattcaacctcgacaaagaaaaatgaaatagtgattttataaaaatgaaatagcaaactctacaacagatggcgtaaaaaaaccaactgaatgttgaacttgacatatttagccaggagcaggctgtttttagatcaaactaatggacattgatccattcacaaaatctgtcttttaaccagacgcatttttccttgcaggatataccctataagctgccagcccaactacgaccaccggagcttcaactgaaacagccattagagatcgattaataagcctggggtactggttgcgggtttttccagcttcagtttctggaatgcttaaatgaggatgatcagcggccgtttcaattttacgaaaa

SEQ ID NO: 24898 - DNA, 475 bp, Zea mays
  Clone ID: cC-zmle189022g12d1
gcaacttaagcaaaagataagaaaccactatcattatgcaagtaaacgactaaaattttaatgattaaggttcctgtacaaatactgtacatcaaatatcaagcgtgacccttaaaaagtgccctccgtgtctgtacagctgatacaagtcaatcaactaaactatcagcgtgctatgtacacacccccaacaattttttgtagtcagtgaagatagaagcttcatcgccgagtgactcgtgtgaccaccactgcaataaactcatttagaccactgccagcaagccactagcacccttatctacataactatcaattaccctaataattacatcttcataattcttcaattatggaccagttaagagagtgcaattatgaaaggtggaaagatccttgaccctctgttatggcatacaagagcttctctttatcctttctttgatgagtacggaggccgcttgagataatttgc

SEQ ID NO: 24899 - DNA, 346 bp, Zea mays
  Clone ID: cC-zmle189022h01d1
attcggctcgagctgctagaagatgacaatgctgcagaagcacttcttagctttatttcggagtccgggtcccaaatattagtgctgggttctgactcctcaaatttcataacaaggaagctaaaaggacctgggataccaactaccattctaagatgtgctcctgacagttgtgatgtatatattggagctagagatagaattatatccaagttggctgacttttcatcttcacgttctcatgagactagccctaaggacttcttggctacttaaggtaataaagaggaccatggcattggcagagaaatgtctggaattagttcattctcaactgaacctaaaa

SEQ ID NO: 24900 - DNA, 404 bp, Zea mays
  Clone ID: cC-zmle189022h02d1
agcaactgaatcaaggggcgaaacaacttattcttttaaatacaatggctaattaattaccacatgcccgacgacctagatgtttattttatatgttacctgactcagactagaaaaattcattttgatggttgatatacatggccaggggtattactatcactatttctcaacaaacattgggtccaaagtccacaaacccatttgctccatcaaccgaaatctgaagcccttcttgctgaatatttccggtggtggaaagacccgatgaagaaggtgcatgggtgaagcaagaagttcccacgtcatcgagtgggatcaaaaagttcctagctggcgggggcaaaattgggccacccgagaagtaaaacgacacggtgggaacccggaccggcacaaacccg

SEQ ID NO: 24901 - DNA, 452 bp, Zea mays
  Clone ID: cC-zmle189022h03d1
aattaatctacacatcttactaattaatgtcttatgctaccaaagcactcatacaatcactaacaatgacgaacactcaaaatcactagtcttaattaaaacatctatcaaatatgttttctgaaactttgcaatttctaattctctaattgcccaatttctttgccgcgttagcttcaaccctagcctcgtcatttcttttgcttccgttgttaccattcggcattttttgaaccacctcattatgttgtccacctttcccctggctgatgggtgaccttcttttccctccaacgcttccatggctggggcctgaccctcttgttcctccgtgcgttctcactttgagcgaggatgtagcttggcgaggcatggatctaagtgcctgaacaaggatttgaggtgaaggtttcccaataagcgaggcatgatatgggtaatgactaatgagc

SEQ ID NO: 24902 - DNA, 406 bp, Zea mays
  Clone ID: cC-zmle189022h05d1
ttttgaaagataagtaggtatattatacacaataactttggttaaaaattacagatcgttgagaaaacagccaaaaaactgttatttagtgtacaagaagcctagccgagccaaagaatggggaaaggaaatgtgatggacagattcatgacatcaagccagagcaactcttgtatgaatacatagtgatgaacttctagtacatagtacatggtgataaagaattaaaaaccgtcgttgagtgccgtgtgagctatcaactcacattatataatattataattcaaggtgctggaagtgctcaaaattgatcaaacaccacagtatgtaaacgtacgagtacctgaggattccagcatcaggttcgaattcattgtgctgaaactgctttctgaaagaatggatg

SEQ ID NO: 24903 - DNA, 366 bp, Zea mays
  Clone ID: cC-zmle189022h06d1
ttttgaaagataagtaggtatattatacacagtaactttggggaaaaattacagatggaggagaaaacagccaaaaaactgtcatttagtggacaagaagcctagccgagccaaagaatggggaaaggaaatgtgagggacagattcatgacatcaagccagagcaacttttgtctgaatacatagtgatgaacttctagtgcatagtacatggtgataaagaatgaaaaaccggcgttgagtgccgtgtgagctatcaactcacattatagtatattataattcaaggagctggaagtgctcataattgatcagacaccacaggatgccaacgtgcgaggtcctgaagattccaggcatcaggtt

SEQ ID NO: 24904 - DNA, 283 bp, Zea mays
  Clone ID: cC-zmle189022h07d1
tgtggtccaaatgttttctttggtgacttgtaatttaactagcaccaaccatcacgtgtcatttgttaaaataacagcttaataccattgatttcaaaatgaagggcacagttcacgatgcgagaagtttgagcagttattaagctcggcatattagctattctaagttctagcatacatatatatagctgagccttgcacataatatcatatgtcacatacttggcagaatcatgtcagcctaactagtcagacatgcagcgcagcatccatggggggatga

SEQ ID NO: 24905 - DNA, 510 bp, Zea mays
  unsure at all n locations
  Clone ID: cC-zmle189022h09d1
ttttaaagaaaattttaattaacacgttacaaaacctagacacaggtctgccataaaaggaatttccagtatttacaactttcaatttaatgctcaaattacagacaagtttttgaagtaaataaatagtttgataaaaactattattgattggcaacacagaataatgcaagatcccccgctctgctgaacaaccggtttcccttgtggcattagcatgtgcaaaagccgggagaaaagtaacatttctgctaaaatctcactgagttttagcaagggaaactgaaaaatgcaagaataccacgtatagcttggtccaatacgcctctacaatcaaggaaatggaaactacccaatactcaaacaaaatcttagagttgatcatggcttcagctcatagagtggttgcgaaagagnttttgaccaggtgcttgctggtcattcttgtacagggatgcagcagattcagatggtacctgtggaattgcattgtgccccaacgacaaagca

SEQ ID NO: 24906 - DNA, 419 bp, Zea mays
  Clone ID: cC-zmle189022h10d1
gaaatatcgggagttacaccaaatttgttgctaaactttaatcatgtgtttggactaaagtaagaaaatacagataatgatacattttattttatttggttaagaaaagaaagaaaaattgacatttagatgaagaaaaattcgaaattttctttctttctattttctcttctattcaatttttaagtttttctctcttcactcattttctttcctctgatacagagggtaatgctgtaacttgcaactgtggaagtgaaggtcttccaaggaacttgtgcctcagtatcatttgcccctccccttttgagcagactgagtgtttaacaagcaagatggtaggtttggttattcatgatttgctaaaccgagatttcggcttttgttgtttgcagttgtctcttgaccaatgcagtata

SEQ ID NO: 24907 - DNA, 492 bp, Zea mays
  unsure at all n locations
  Clone ID: cC-zmle189022h11d1
ttttcaagaacgttgccaccttatacattgaataatgaaagccagacaaagcactacgaacaataagagcctaatggctaataataatcaacacccaactatacacaaagttattgaacaagcagcaacaaagccttatgcacaattccatgatggaaatggtccctaatccctaaaatgaatctacaacttgcgagacaccaggctccctcccccatttcagatgctgccgagtgcatttttgagattccctccaaaatacaacatgaggtcgccgccgtggaccctgccctccggtagattaaaatcgaggcctttctgagcactgctgcagccagcagccgagctttggcagtttctgtcttggtctggcttcttggcagccaagaagtttgaataagacggtgatttcatcgagagcggaaactaacacctctttngtatcaggtgctgtcnttttgggcaaatgctacctccattaaaaagcagcgt

SEQ ID NO: 24908 - DNA, 467 bp, Zea mays
  Clone ID: cC-zmle189022h12d1
atagcaacttggcaagcacaagccattgatttccatggttacaaaagcaacacagttgggatatatacatttgcaacctaaattttcttctggacgaatatgtttgcctgtgccaaatccccctcattcctttcctttattttccatcgcacatacagcattgtataaacacaggcttttttagataattatacatttttctttagagaacattaaattacacataaggatagggtgtcaggatatgttatatgctatgccataccaagcaaccaaattttaaaattgactctccagctgtgcttatcttgctctggaaagctgtatggcttgttgatcaatgagtagactcatcattgcaaacaaattggtgagtcatgagtgagaattcttgattcctagccttgtcaagttgctgccagtcagaccatctatctgccaagccaactccctgcgaattttcacca

SEQ ID NO: 24909 - DNA, 152 bp, Zea mays
  Clone ID: cC-zmle189033a01a1
caccaaaccccaacccggggtctctctcttttatgctttgaaaaaaaaaaaacctttcaaacaaggaataaataaaaaaactcttgtctctataataaaaaaaccaaaatctgattttttaaaacccggcaaaaagtcctcccccccctttg

SEQ ID NO: 24910 - DNA, 268 bp, Zea mays
  unsure at all n locations
  Clone ID: cC-zmle189033a01d1
gtacctgtacttcactaggatcgtcgngtatgcgctcaaggcagttgccagctacaagtaccggngggtgagcatcttggcagaagagatggccaccctggcgttctatctgttcatgttctacacgttcaggccggccgagaagagccactacttttctctcgatgacgatgaagaagaggccgcagagatggtgctccgagagaagaattcgagctatgaaagagatgcagcgactcacaagagtctccatgccacgtcactccct

SEQ ID NO: 24911 - DNA, 382 bp, Zea mays
  Clone ID: cC-zmle189033a02a1
ctaatcccccaaattttgaaaaaaccttggaaaccttttttgggcccttggtttttcttaagcccaaggggggaaattaaaaagggtccgttccaacccattccaccccttaatttgggggggggctaaaaggggggttaaagttcttttcttttttttggtccccagggaaagccttaccctcttttttcaccccccttgggggggggggcccaaaaaaatttttacggggtattgtaaacctccgaaactttggagggggggggttttttaaactccactggtgactggggggttttttggtaacggggttaaattttaaatatcccccccggtttaatattcccacaggtttctggggctttcccttgggaaaggggtt

SEQ ID NO: 24912 - DNA, 538 bp, Zea mays
  Clone ID: cC-zmle189033a02d1
actcgccacagaagaacctgagcagctcaggccggaggaggcccgtggtgtcctgtatatcaaccttggcatgattgctgcaaggcagggagaagttgaaaaagccaactacatggtgagccgtggcctggcgatgttgcccaacaacccccgggcagtgctagcatcggtttacgtagaccttttgcaagggaagtcccaggaagctgtcgtgaagttgagacggtgtaggaatgtgagatttagacccgctagcatagcagccagcagtcagcagtcgagcttagaaaagcctcccctttcatgatttctgtagtttacaattaccgctataatcttttttggaccctgaccccaatgtggatgatcaaagatggtaatgcttctcctgtgtaacatatataagaaatgaactctaactccccttctagcttcctcccagattcaggggtggaatgtgttggaactgtaccgttttaatttgccctctttggactgaagagagccaagtgatcaaaatagtttcctatgtttattc

SEQ ID NO: 24913 - DNA, 387 bp, Zea mays
  Clone ID: cC-zmle189033a03a1
cccaaccccaaacaggggttggggctttttttgcattggaggaaaaaaaacttttggaaccggggataagcaaaaaaaccgggggtttaaaaaaaaaaaaccaaaatctgaattctaaaaaacgggcaaaatggaccccaactccttggggaccaacaacactttggggcgggggcgggctttggggggtttaacaaaacccccggggggggccgggcttggacacttttgggacgcccttgatattttttaagggtgggaatcccttttgggggggcaccaatttggcggcccttttttctatggtaaagaaagaaaagggggggttttttttcgccggcccttaggttggaaaaaataacccaaaaaacccgggggggggctctt

SEQ ID NO: 24914 - DNA, 465 bp, Zea mays
  Clone ID: cC-zmle189033a03d1
gtacctgtacttcactaggatcgtcgtgtatgcgctcaaggcagttgccagctacaagtaccggtgggtgagcatcttggcagaagagatggccaccctggcgttctatctgttcatgttctacacgttcaggccggccgagaagagccactacttttctctcgatgacgatgaagaagaggccgcagagatggtgctccgagaagaggaattcgagctatgaaagagatgcagcgactcacaagagtctccatgccacgtcactccctgtgatcttgatcatacctcaaatgcccggacacagctcatagtgttgtatgtaccgaagggatgtgagatcattttgtccgtcttctagaattcagattttagtattttactgatgaaacacagattacttaacttataccatgttcaagaagttttcttgcttgcaatgcaatcagagcagcaactcctgctttg

SEQ ID NO: 24915 - DNA, 374 bp, Zea mays
  Clone ID: cC-zmle189033a05a1
ggaaaacttaaaactttaaattggagccgccctaacatttcaaattttcacattacagaacaaagttccatttagggggcatgggaatacattttggggactagcaaggggggaggtggtttcatttagctacaggcatagccgaaaacaaaacaacccctttcttttggaacctagggatcgaccagcattagatttcattttcacaatagcccccccagggggactaccactggccaaggggatcctggggcatttggataagtttgggattctgctctaaaaggggggagagcttttcacgatcactaagtagactctggatgggttctggagatgaaaagaacgggtttaaggtgacccctggggcttgg

SEQ ID NO: 24916 - DNA, 478 bp, Zea mays
  Clone ID: cC-zmle189033a05d1
cccacgcgtccgcaaagccagcaggaatctgggcaaacactgaggcaagttggtgaacaatcacaacttcagaaccagggtatgcaagcagatagtttctctcaacagcagcaagactcagggatcaacttaaaccagttcttttcatctccagaagccattcagagtctacttagtgatcgtgagaagctctgccaacttttagagcagaatccaaaacttatgcaaatgctccaggatcgcattggccagttgtagtcgcactggaggtgctattgtgaaagtgaaatctgatgctggtcgatcgctaggttcctagagtatggtgttgttttgttttcggctatggctgtagctagatgaaagcaactgccagcttgctagtcgccgaaatgtattcctatgtacattatatgtaactttgttctgtaatgtgaaaatttgtaatgttagtgcgtatctaatttatagttttaag

SEQ ID NO: 24917 - DNA, 554 bp, Zea mays
  Clone ID: cC-zmle189033a07a1
catgacatacagcttcccttcgaagctgcacccgaagcagccccaccttggtctgcgcaggccctcgatcagtgtccacttattctgttctgggtcatacacttcgacgctagataaactctcgccgtttggaccaaatccaccagcaacatatatcaccccattgacctctgcacaggcgaagtcgcaccgagctacattcatcttagcaagcacagtccacctgttgaggcaagaatcatactgataaacctcatctgaagcacagtctttcccatggtcagcggcatagcccgcaataacaaagagcttaccaccaataacaaccacaccaaaccccgctttggttagtccaggcatgcgtggaagagggctctgcttttgccccgaacactctaaaatctcccagtgtgaccccttcgccccagcatctggaaccaggacatacacccactcctcaagtttcccaacctcctttctcacagctacgagctccttgctttcgaggaacgacatccacctcttggaaactgcgcccatggcaggaaaatgag

SEQ ID NO: 24918 - DNA, 473 bp, Zea mays
  Clone ID: cC-zmle189033a07d1
ctctcggcgacgactgggcgaccgaccaaccgtcgctgcgctacgccaggtgccaaggtcttcttcgggtccttcgccggcgaccagcagcaccaggcatagacttgtgtaagaaatggatgcaactgccggttaattgcgacacagatttatatggacatagatattggggccatgtgtaagggcggaagctgttcctaccgcgtcaataaggggagtcctgctggttctaccaggaagatccattccacagcctctcaaggtcggatggcatctgacacagcgagggtaacgaaaacagaggcatcaaagctgaagaacctgatctcggcatcattcaaacccttgtctctgaccattcccatcggcgacggattccacgaatcgctccctttcaggcattgtcatttatagtagagaaagacctacgagaacgtccaagtgctttctgcaggatctcattatacttgcac

SEQ ID NO: 24919 - DNA, 399 bp, Zea mays
  Clone ID: cC-zmle189033a08a1
gccaaagggaaagggaagtaactttggagggttttagcccattccatactacaagtttttgggatgaactttttgatgaatttgtttagagcataacttttctagttgcccacatatttttagcatggactaaaaacatttttttagcacattgatcagacgatttttactccagttgtcctttccgttttcatctgccacctggatgcatgagctgcaaaaaaaccctgctcggggtcagcttctccgactccacgctggcgaggttccgtcccatcatgctaaaagtcgtcgtcaacaacccggggggggtcggggccttactgtccgggggcggtttgtcccagtgaagcctggaaacaaaaagcggcaaccacctttttgaggacaacccccttt

SEQ ID NO: 24920 - DNA, 482 bp, Zea mays
  Clone ID: cC-zmle189033a08d1
gacgacaagctggtcgccaaggtttccgacttcgggctgtccaagacgggtcccaacaacgtcgacaacacccacgtgagcacggtcgtgaagggcagcttcgggtacctcgacccggagtacttccggcggcagcagctgacggagaagtcggacgtctactcgttcggggtcgtgctgttggaggtcctgtgcgcgcgccccgccctgagcccctcgctccccaaggagcaggtgagcctggccgactgggcgctgcactgccagaggaagggcgtgctcgggcagatcatcgacccgcacctgcaggggcaggtctccccgcagtgcttcctcaagttcgcggagaccgcggagaagtgcgtggcggaccgcagcgtcgacaggccgtccatggccgacgtgctctggaacctcgagttcgcgctgcagctgcaggggagcgcggaagacagcggcagcgtcttcgtcacggacggaac

SEQ ID NO: 24921 - DNA, 595 bp, Zea mays
  Clone ID: cC-zmle189033a09a1
tgccgtggcgaccgtggcctccccaccccccgctgcctccaggcgtatgctcccctccgccgcaccgtctttcctctggctcccgaggccgaccagccggctccggcgcgccacgcaggtcgccgcggcggggggagaggcggacgtgctgcctggtccggggaccgagggtgaggcggcggttccggggaggctggaggagcagcgggacgagccgctggcgggaagccagctcgacatcggagggctcgccttccagggcgacgtcggcgggggcttcaccggcggcggagcgggctccggggcctccggcggtggcggcgacggcaacaagatgctggaccggggcatcaatacggccatcgttctcgcggccagcacctacgcgctcaccaagctgctcaccgtcgaccaggactactggcacgggtggacgatcttcgagatcctgcgctatatgccggagcacaactggtccgcgtacgaggaggccctcaaagctaacccggttctagccaagatgatgatcagtggtgtcgtctactcccttggtgactggattgcacagtgctacgaaggcaagccatctttgatt

SEQ ID NO: 24922 - DNA, 401 bp, Zea mays
  Clone ID: cC-zmle189033a09d1
tacccgtttggaattcccgggtcgacccacgcgtacgcttttttataatgaagttcgctactttcttcgtaatcttctatggcacatactacacaattgatggttcatgagtatatacatatctaccaaaagaagggttacacctgcagagctgctgcggctatattgtacaatttacataacccctgaagcgatggaagggcgaatcagatctccaaggtctctaaggctgctatctggagtcgcactttgaagcatatggtgtggaggtgctatcagaattccttgcctctgactttttgtttgagtacctcgaccatattgtgacccaaagaagctccacacagtcgagccattaaagtctttgatcaacacggaccacaccatatgtaattaaatgt

SEQ ID NO: 24923 - DNA, 263 bp, Zea mays
  Clone ID: cC-zmle189033a10a1
ggggggaaacaacaaccccctttaaaaagtttaggggttccccctcccgccccggtagcaaaaaaacccaaaaccccgggggttaccccaaaaggggaaaaaaaagggtaaaacccccgggttttctacctgtaaaaaaaccgaaccgggcttaaaatctgggtaccaaagggtttgcttttccccaataatttaaaccccttggaaaaagtgtcccacaaattaaaaggggggggcttcaaaaaaaaaaaaaaaaatggggg

SEQ ID NO: 24924 - DNA, 393 bp, Zea mays
  Clone ID: cC-zmle189033a10d1
cggacgcgtgggcggacgcgtgggcggacgcgtgggttctaggcaagtctggacatgaggttgcttatgacgtgaacttatagagttgtcttggctatgtgttgtcgtctggccctaagattttgtcttgaaacaagtttaaaattaagattatttgtaacaagtgtttaagattactcgtggtgatattctgtgttcgattactgctgttctaaaaaaaaaaaacaataaatatagactaaaaatacaaaaaagaactaatggccgccgtaaatagctgacaacaccgaacttggtggtgcattttagagcaaagccgtttaataggaccaatctgatttaagttactagccatctgttgcaaagttagaccttaaaaccctgggggtcccc

SEQ ID NO: 24925 - DNA, 406 bp, Zea mays
  Clone ID: cC-zmle189033a11a1
tgacgtttcatgcacacgtccctccgcttgtatcctctacagcggcacgccttcatattggtttatttttttacacaacaaccgccagcgcacgctaactggatttttggtggtgaacaaaaccgcacttaatctgtctaccccaaaggctgtgattacccgactggttccgagaccatgtccccatggcacgccccctttattaatggtgctgatagacacaaggacatgtcccgcccattatctcatgggggcaccgagctctactgtacacgggaaaaggtgtttatgcacttttgcgcctggttcgcattatcggcagaggaaggatggcaaccgctgcttatttatggagccagcttcaccgtgcaagaagttgcattgccctaactagttcattaaggag

SEQ ID NO: 24926 - DNA, 496 bp, Zea mays
  Clone ID: cC-zmle189033a11d1
cgggtcgactccacgcgtccggcggcggagcacctggccgtctccgcctggcgctcgctgaacggcctgccggtgttcccgcacgtcgcggagatcgtcgtgcccaccgccgcgcactgggccgacaagtacaacagggcggtcgcagccgccgcggagcacggctacgcgggggccaagtacctccccgccatccccaccgaacgcatcgccaaggtgttttcgtcggcgccagaggccgagccgctggcagagggccagtagtgtgtgtgtgtgtgcgcgcgcgcgcgagctcgtctttgccggtggtgactctggatttggatcaccttccgaactgaactgaaaataaagaagcgtgaatccgggggccagttaaagatggtggtatggtatggtagcggcgttgtactagatgcgtgatgggacgatggttacggaccatgatgatgacgctgtgttccagttagctctctgctgcgtgcttttgtataaa

SEQ ID NO: 24927 - DNA, 428 bp, Zea mays
  Clone ID: cC-zmle189033b01d1
cccacgcgtccgcccacgcgtccgagcgtcggcaccaatggcttactaccaggaggtggactactgctcggaggaggtgaggtcggtggccccggccggcttcggccgccacggaggcggcgtccagcagcacgtcgtcaaggagaagttcgtggaggtcgacacggtctcacgcgccggggccaaccaccaccaccaccaccatggtcaccacggcggccacggcttcgtggtgcgcgagaccagtgtcgaggaggacatcaacacctgcaccggcgaggtccacgagcgcaaggagagcttcctcgccagggctaactgagccgaccggcggccggcatccacgcccgttcgtgcctgactgcgtgccttatgtatgtctgtggatgactggttgtgcaaggtcatcgtacttggctatgtacgtg

SEQ ID NO: 24928 - DNA, 244 bp, Zea mays
  Clone ID: cC-zmle189033b02a1
ttttagtaatccaacaacatgttgcttcagatcttcacgcctaactgcatggtggacattctgcaaacttttctatttacaatcatccttttggcaaatcatatccgaaaatttagattggcttgtaactgttgacgttggatcgcctctaaagtcagaacggtcgacagtcgaatgtccatatgatctgatgacctccgatttgcatcattatattcagggagccctctaagatcagtttcat

SEQ ID NO: 24929 - DNA, 543 bp, Zea mays
  Clone ID: cC-zmle189033b02d1
aggactcctatgtggttcaaaaggatgctatcaccgtcgaagaagactgaaaatagtccagtatttaggttttttatggatctgaatgatgcagtatcctatgtaaagcgactaaatgtgccaagcggcatggtgggggcttgtcgccttgatgtagcatatgaacatttcaaggaaaagcctcacatgttccagtttgttccaaatgaaaagcaggtccaggctgccaataagctattgaagtcacttccacaaaggggcagaaggaaaaaacttgatggggttcctgtttttagtgcgcaaaacttgaatattgcagtggcaacaaatgatggaattagatggtacacaccatacttttttgataaaaacttgttggacaatatccttgaagcttctatggatcaacatttccattcgataatgcaaaatcgccatacacgtcgtaaaagggatattgtcgatgatagtttaacatcagaaataattgaagacagtgctgaaagcttgcttgagcccccagaggttcaagaattatgaatg

SEQ ID NO: 24930 - DNA, 389 bp, Zea mays
  Clone ID: cC-zmle189033b03a1
ggaaacaacacagacacggttttttggtcgaattatttggtcgagttgcaaaaccaacccattacgacaaacaaaattttctggtcataaagactgacggtgtccaagtgtaatgaagtgcaaaacgcaaactagttcaaccggtcacttggatgatatcaaattcagaagtgtgcataacacatggtaatggaacgattgagatccatagctacaaaactctggtttcacatagaactaggacacaacagattgtactaggaaacaacagatgcctaatgcagcacttagatgattccgattttgttggccacattaagagcatcatagtggggagtcagtttcacgttagcctttttctttccattaggcctgatcaaaggtgttga

SEQ ID NO: 24931 - DNA, 486 bp, Zea mays
  Clone ID: cC-zmle189033b03d1
gaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggaatcatctaagtgctgcattaggcatctgttgtttcctagttcaatctgttgtgtcctagttctatgtgaaaccagagttttgtagctatggatctcaatcgttccattaccatgtgttatgcacacttctgaatttgatatcatccaagtgaccggttgaactagtttgcgttctgcacttcattacacttggacaccgtcagtctttatgaccagtaattttgtttgtcgtaatgggttggttttgcaactcgaccaaataattcgaccaaataaccgtgtatgtg

SEQ ID NO: 24932 - DNA, 473 bp, Zea mays
  Clone ID: cC-zmle189033b04a1
gcctgagaaaaacatggaattactttcttttgctcatacaagtgtatactatatcataaataacacagatcgtcgtcgatcttcctccccatcatatatatatatacacggatgtttattggcacctctagtactactacctacgcactcctccatagatagaaacgagcagaaatacattacacattgaaggcaaaatagagagagagagagactaccctgatcttttccccttccgtcagtccgtcctcgtttccccttctcattcgacgagcgcggcgaagcagctccccgtgcgcgccagcgagctccgggacgcccccgcggcgagggcggagacgccggggtcggcggcgtcgcgcgtcgggctgctcggcgtggaccgcgcctttctcgacgccggcggggacccgagcctgcggcgcaacaacaagcgcagcgcaacgaatagccccgtggggctggccgcgggc

SEQ ID NO: 24933 - DNA, 361 bp, Zea mays
  Clone ID: cC-zmle189033b04d1
cgatctgacctattcctagttgcgcgcgtgtcccgtgaggcgggagctctggaggccatggagagggacccggcggtcgaggaggaggaccactacaaggaggaggtggcgtgcgagtgctgcggcttcacggaggagtgcacggcgccgtacatcgcgggcgtgcgcgcgcggttcggcgggcggtggatctgcgggctgtgcggcgactctgtgggcgaggagctggggcgcgcggtgacccctgtcatcttccccgtcgaggcgctggaccggctcgcccgcgcctgccgtggggcgtccgcgccgtcgtcgtccgcgggcagccccgacgggctcatttctgggctgcgcctgctgc

SEQ ID NO: 24934 - DNA, 365 bp, Zea mays
  Clone ID: cC-zmle189033b05a1
aaacgataattgatgatgtattgaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttcttcacaaatgcccaccttcaagttaggcctagctt

SEQ ID NO: 24935 - DNA, 201 bp, Zea mays
  Clone ID: cC-zmle189033b05d1
ccggaattcccgggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagct

SEQ ID NO: 24936 - DNA, 469 bp, Zea mays
  Clone ID: cC-zmle189033b06a1
agcgaacaaaaaccttggtcattgttctctcgtctcgtttcataccgggagcaaacaaagggaacaacaggggtaccaacacctaatccaaaggtagaacggacacttacacggtgacagaagcgaacggtaacacgatactatagatagataagataactcggccgaagccaggatgggcccacacataagtcccttcagccggcgacgccgccgtcgtagacgccaccaccaccctcgcgccgaccgtcgtagccgccaccgcctccgtagacgacgacaccaccctcgcgccgaccgccgtagccgccaccgccgtcataaccgtcgtaacggagcccgccaccatagccgccgccgacgagaccgtcgtcgtagccaccgccggcaccgtcaccgacacgggactgggcctggttaacggtgatgttacggccgtcgagctccttgccgttcatgttctcgatag

SEQ ID NO: 24937 - DNA, 540 bp, Zea mays
  unsure at all n locations
  Clone ID: cC-zmle189033b06d1
caaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctaccgaggcggtggcggctactgcggtcggcgcgagggtggtggtggcggctaccgcggcggcggcggcggctggagggactgatgtgtgggcccatcctggcttcggccgaggtatcttatctatctatagtatcgggttaccgctcgcttctgtcaccgtgttagtgtccgctctacctttggatatgtgttggtacccctgttttccctttgttgctccgcttgatacaganagagaagatgagcaggttttgttcc

SEQ ID NO: 24938 - DNA, 418 bp, Zea mays
  Clone ID: cC-zmle189033b07a1
ttttctgctgcgctaaacttcaagttatgtttatgatacaaacggcaccacctagaaggtggtccaacaaaaaaaaattacatgaaggctatggtccttgacacaaagcttattcaaaacatgcacacgttacaaggtgtagtagagaagggatagaacacagtgctagtatcgttttgatatgcgtggcatggagcacttctgcttcctgtcatggaggatccccaagatgacagcagctgtttcctcgatagcttttccagtgaccgcaatgactggccacgatggattctgagcaaagatttgattcgcatggaccagttcctgcctcacatggtccatctcagcgtaattgctctgacgcccatcaaaacctagagtcttggccctggtctcggacgcgtgggcggacgcgtgg

SEQ ID NO: 24939 - DNA, 407 bp, Zea mays
  Clone ID: cC-zmle189033b07d1
cccacgcgtccgagaccagggccaagactctaggttttgatgggcgtcagagcaattacgctgagatggaccatgtgaggcaggaactggtccatgcgaatcaaatctttgctcagaatccatcgtggccagtcattgcggtcactggaaaagctatcgaggaaacagctgctgtcatcttggggatcctccatgacaggaagcagaagtgctccatgccacgcatatcaaaacgatactagcactgtgttctatcccttctctactacaccttgtaacgtgtgcatgttttgaataagctttgtgtcaaggaccatagccttcatgtaatttttttttgttggaccaccttctaggtggtgccgtttgtatcataaacataacttgaagtttagcgcagcagaaaa

SEQ ID NO: 24940 - DNA, 369 bp, Zea mays
  Clone ID: cC-zmle189033b08d1
aacagaaagggcgcattaagttgaccagtactagggtttccatctgcagatcgaaagtaaggaccaaccaaaagctaggcaacacaacaagctgcgcgtctcgccatacacaaattcatcacccaaaaaccaaaaccttcaccgtctgatctgtctgtctgatccgatgtgtgggagcaagagcggtcggatcggatcggatcacgcggaggccgcggccgtccgggagcggtagagcttgccgaagatgtggagggcggtgacgaagccgatgaagcagagggacatgacgagcaccatggtaggcgagagccggagccccggcgcctcgtcggtgtagaagcggagcatgttgctcccgccgccccc

SEQ ID NO: 24941 - DNA, 440 bp, Zea mays
  Clone ID: cC-zmle189033b09a1
aaaaacaatggggcaacgttccggcagcataaatctgaatcctcagagcccagcacaagaaacacatgccactgatggtcagataggggtatacaaaggaacacctgctttgatgctcacgggcactgcagcgaggaggttcagccacaagtacaaagcacgattagacaattttttttgaccccattgcaacatttcacaaatttgctctcatcaagcaagaggggtattcagtcggccccaaactatggaaatgttataacatcacatctgaaacaacacttggttacaatgccccacttgcatacaggcgagtccactccttcgctggctcaaaagcttcagcttcatttgatttccagggtttcgcaatgttgtctgagagaggatcatctggatttggggcactcaaaagtgcctgaatgctgagcagaactgtt

SEQ ID NO: 24942 - DNA, 526 bp, Zea mays
  Clone ID: cC-zmle189033b09d1
gtctcgtctcgtctcgtccacctccccagcggcgcgtgcgcgtgaagcttgaggcaatccccgctccgtctagcggccctgcgcaatcagtcagggttccatggccaacagcaacctcccgcgccgaatcatcaaggagacgcagcggctcctcagcgaaccagcgccggggattagcgcgtcgccgtcggaagagaacatgcggtacttcaatgtcatgatccttggccccgcacagtcaccctatgaaggtggagttttcaagcttgagctattcttgcctgaggaatatccaatggctgccccgaaagttaggtttctcaccaaaatttaccatccgaacattgacaagcttggtaggatatgcctcgacattcttaaggacaaatggagtcccgctcttcagatacgtacagttctgctcagcattcaggcacttctgagtgccccaaatccagatgatcctctctcagacaacattgcgaaacactggaaatcaaatgaagctgaagcttttgagacagcg

SEQ ID NO: 24943 - DNA, 469 bp, Zea mays
  Clone ID: cC-zmle189033b10a1
ggattgggtttttttttttttttttatttttttttttttttaaacccccccttataacctaagggaaaaatttttttttttttaaattccccccccccccaacaaaaaaaaaagctcagggggttacaaaaaaagagcttgtttttctattggatccagaaaccacccgggaggtacacagggggatggttcctattttttaccggggggttgtaccaaagttcgaccccattgcccgccccccaggcgcaaaagacggggtggttttattttttaccccccccaaaaaacattgtccctttggttaataccgcccctaataaatatattaaaacccggggggggggccgcggcaaaaaaaaaaaaaccggggggagggggggcctgttattatagaaacttcccacacgggaacctgaattagggtctttcccccccggggtaaggaaaaggggggggggggttttaa

SEQ ID NO: 24944 - DNA, 580 bp, Zea mays
  Clone ID: cC-zmle189033b10d1
cccacgcgtccggccgccgctgtaactgtctcggcagcagtgcccgtcccggaggcccccgccccgatcaccgtcgtcgtcccgccgctgccgccagtcgaggtcggccgcgagccggccacgtcatccaccgccgcgtcctccgacggggcggcctcgagcagagtccacaggtgctccgtctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcgtgaaaccgctgcgcgcgcgggcggcggatctcatctcatcacccgtccaagatttggtccgcagctgccgagttcagcggtggaagtggaacacactattcgttcattcatttcgtat

SEQ ID NO: 24945 - DNA, 567 bp, Zea mays
  unsure at all n locations
  Clone ID: cC-zmle189033b11d1
cgggtcgaccacgcgtccgtcgaggctctcttcggcactgcagcagcaaaccgcaagccgaaaccttcagacaaggaatcgggcgaatcgtcggccagcctcgggcgctcaaacacaccggagcaaatattcctgctcgagccgcgcaagtcacacaatatttccatcatcctcaagtccctcacggtggggcgggatgaaataatcgacgctctccgtgacgggcaaacagaactcggcactgacgtcctggagaagctttcgcggctccacatctccaaggaagaagagtccaccatcttgaggttctccggggaccccgacaggctcgcccccacggaggccttcctcctccgcctcctcctcgacgtgcccaatccgatcgcgcgcgtcaatgcgctgcttttcaaggtgaactatggtgcggaggtcgcgcagctcaagcactcgcttcggacgttggaattggcgagccaggagctgaggacaaagggcctgttctttaagctgcttgaggcagtgctcaaagcggtaaacaggatgaatgccngaacggcacgtggcaac

SEQ ID NO: 24946 - DNA, 231 bp, Zea mays
  Clone ID: cC-zmle189033b12a1
ggaatgataattggtgaagtttggaaaaaaaaagtttttaaaccctggagtcatttgaaaaattatcctgaactggggaaaaaaagggcatgggaatgtagcttatataggcccctgcatataggaaggaaaaaaggcgggggtttgaaaaaaaattggtgaacaccaaaacccggtcccggggggagaaccgggaatttcggaacgggtcctggaggggtaaccatatat

SEQ ID NO: 24947 - DNA, 236 bp, Zea mays
  Clone ID: cC-zmle189033b12d1
ccgggtcgactccacgcgtccgggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcggttgaaaaaaaaaaaacaaaaaaaaaaaaaaaaaaaaaaaaaaataa

SEQ ID NO: 24948 - DNA, 412 bp, Zea mays
  Clone ID: cC-zmle189033c01a1
ttttggaacttacaaatcgtaaaactcttcctcttcctggaatttggcaagcttcagatcaaaggttcacgcctagtgctaggcaccaacatatgttagttcagctcctaagaacttagccatcccgtctcgttagaaaagttggtcttacaaacatgagattggtatcatctcatcgatactaaactgaaacagtacattcattgtggttttgctgcacataatcgagccttgccagggttgagcagagattctgacattatccaaccctgttccctagctttcttcttgaatgttccatatgatgaggaaactattttgcaagattcagcgatgtgtgccaggaaatccatgtttctagagtacagatactctgatcgggcagggtttgcctgcttctgcttctgctttc

SEQ ID NO: 24949 - DNA, 324 bp, Zea mays
  Clone ID: cC-zmle189033c01d1
cgacattattaaagctgctttccatgctcatgtgctattgcattttattaatgcatcacatgctcggagactgaagcagaagcagaagcaggcaaaccctgaccgatcagagtatctgtactctagaaacatggatttcctggcacacatcgctgaatcttgcaaaatagtttcctcatcatatggaacattcaagaagaaagctagggaacagggttggataatgtcagaatctctgctcaaccctggcaaggctcgattatgtgcagcaaaaccacaatgaatgtactgtttcagttagtatcgatgagatgataccaatct

SEQ ID NO: 24950 - DNA, 458 bp, Zea mays
  Clone ID: cC-zmle189033c02a1
tttttagcgaatcagacatttagtttaaaccaattattgttattcttgcaaatcacaacagtaccacaccgccaagagtttaattttctggttctcaagccctagcaatacaagcacaatctaagagttcaaaagcccaggcatattaagttcttacaaactagccattgcagtcacactgcggatccatacaagcttatgaagactgtcgaagctctgggcgcacgaaatctgcatcagcggtcactgagatgtcaacggtgggcctcagctgagcacaaacttcgatggcaccgtgcacagggtcagacatgaagttgctgatgaggtcttggttgatcggtgctttctttgtcaacagtcacaaacgcctgttgggtcaagatgtaatcgaagcggggtgcccatttcctagatcccaaacgagcagttgtggagcagttttcgaccatgaaggc

SEQ ID NO: 24951 - DNA, 444 bp, Zea mays
  unsure at all n locations
  Clone ID: cC-zmle189033c02d1
cttggacatttgcaatctctgggttttgatttccctaaaagcatcagtgtgattgctgtatgccccaagggaatgggcccatcagtcagaagactttatgttcagggcaaagagatcaatggtgctggtatcaatgctagctttgctgttcaccaggatgttgatggaagggcaacagatgtagctctagggtggtcagtagctttaggttctcctttcacatttgctactactctagagcaggagtaccggagtgacatttttggcgagcgaggtattttgcttggtgctgtccatggcatggtggaggctcttttcaggagatacacagaacaaggaatggatgaggactcagcatataagaatactgtagagagcatcactggaattatatcgaaaactattttaaagaagggtatgctngaagtgtataactctctgact

SEQ ID NO: 24952 - DNA, 593 bp, Zea mays
  unsure at all n locations
  Clone ID: cC-zmle189033c03a1
ttttgcatgaatggattatatattattgnagagaaaagcagaagcaagatcgaggcgagtacgtagaatcataatgtatcaacactacacataaatatatgattcttctccacactccttacacttgcctacgtcagggatgtaactctggtcgccggaggcagcagcagtggcgcatcatctcttgttagctccggctactgcagttgcttcatctcttgttagctcaggctcagcagcctcagctcgggccacgggttccttcagtactggtcgggccagaggaaggcgcccatggcgaactttcgcttgctgtcgagttcgccgtcgacggggaggccgtactcgcggagcaagcagtcgacgcgccactccggcatgctctcgtagtcagccttcttgtaccgcgggtagtgcaacggcatgtggaaggtgtagctactgcagttcatcgtcctggggccctctactttctgctgatcggcgacagcaacagtgccgttcttataccaacgggggtggctgcctgcttcgccatgttcatgccgttattgtgcttgaccctaggaacccatgcatgccggccacgcttc

SEQ ID NO: 24953 - DNA, 531 bp, Zea mays
  Clone ID: cC-zmle189033c03d1
cggacgcgtgggcggacgcgtgggcggacgcgtgggcaggcatgcatgggttccctaggctcaagcaccattagcagcatgaacatggcgaagcaggcagccaccaccgttggtgctaagaacggcgctgttgctgtcgccgatcagcagaaagtagagggccccaggacgatgaactgcagtagctacaccttccacatgccgctgcactacccgcggtacaagaaggctgactacgagagcatgccggagtggcgcgtcgactgcctgctccgcgagtacggcctccccgtcgacggcgaactcgacagcaagcgaaagttcgccatgggcgccttcctctggcccgaccagtactgaaggaacccgtggcccgagctgaggctgctgagcctgagctaacaagagatgaagcaactgcagtagccggagctaacaagagatgatgcgccactgctgctgcctccggcgaccagagttacatccctgacgtaggcaagtgtgaggagtgtggagaagaatcatatttat

SEQ ID NO: 24954 - DNA, 193 bp, Zea mays
  Clone ID: cC-zmle189033c04a1
aagtctaaaacgcgcctattgttgcagagggacagatgtactatacaactggacatatgggtcgttctatttgaccagcccccctcggatgggatagttgtacaaccccgcgatagaggtgcttgcactaaggcctgctgcagacggatcatacggtgatcctgatgtcgacaccccggaagggactcccggc

SEQ ID NO: 24955 - DNA, 229 bp, Zea mays
  Clone ID: cC-zmle189033c04d1
gagggcgcgtatccctcccgtgtgttcgagcccatggtgaatgtctcctcacgagagtttagtccgttgcgatggagcagacccacgcatcctgacaggagtgcaacatccttctgaaactgcactacccaagatcggccgcgatcgagctgtacaagaaggtgaagcgctgctactcaccctccctgatggataggagcacacggagtccgataacctactgaggcag

SEQ ID NO: 24956 - DNA, 374 bp, Zea mays
  Clone ID: cC-zmle189033c05a1
acgggaacatcatgtattcatcttcagtccattacaacaccggcgtatggcactttgctacaaacattcatagggggacaacacaacaagagcagcaaacgcgccagatcaaaccagtctccagtatacacgcaggcaagcagcacgacgcattaacttttactaggggttagattatcaaggggcacgcattatatacacagtacattgcaggcccaagctttactgttaagcatcaaggagacatcaggatctttctcgactcacgggcacggctgcccttctggatgcaccctgaaccagcaagagagtttatccacacgttatcggttcttaccggctctttgtcgtcgtttctgtgccaggtccagggg

SEQ ID NO: 24957 - DNA, 444 bp, Zea mays
  Clone ID: cC-zmle189033c05d1
ctaaaggctgatcttgccaaggttgatagaaagaggacaccctggctcattgtgttgttgcacgtaccatggtacaatagcaattgggctcatcagggtgaaggcgacagtatgatggcttcaatggagcctttgctgtacgctgctcatgtggatatggtaatagcaggtcatgtccatgcttatgaacgtgcggagcgagtctacaattccagacctgatccttgtggcgctgtccacataactatcggcgacggtgggaaccgtgaaggcttggcccgcaggtaccgtaacccgaagccagcgtggtcggtcttcagggaagcgagctttgggcacggcgagctaaagatcgtgaactccacccatgcccactggacctggcacagaaacgacgacgaagagccggtgagaaccgatgacgtgtggataaactctcttgct

SEQ ID NO: 24958 - DNA, 519 bp, Zea mays
  Clone ID: cC-zmle189033c07a1
gcaaatagaagtcagctatggtgccaacgaccgatgtgtgctgctgttcacgggggtccatgcaaacgtgcacagacaccttggaatgtttatgacagaaagaaattacaactccagcagccccatatgcacaaaaatgagtatcatcaggtactacaattcaatgcaaacgctacaatatatacgatataacataggagcttgcataaaatattttcacagcttaaactgtaaactactgcagttccagcactcaaatacttgcagccagctttaggctatctccagcaatctacccatccccatacctatattcaaactacactcagtgtaaaacaatatacaaaacacagtgttttggaaaatcatatgggtgaactgttagatacggtcttatatcagcaaggacaacacattcatcttgattgtggcatcatcaatcaggaaattaaaatgttgtgtaaacaagatgcagccattatcatcacaccccactccccacttgagaccatgatggat

SEQ ID NO: 24959 - DNA, 544 bp, Zea mays
  Clone ID: cC-zmle189033c07d1
cggacgcgtgggcggacgcgtgggtgcagttcatgctgttaatgttctgccagggtggggttttcagtcctggaatttttatatttgactgttgctatgtctttccttgcttgtaggggtaaggggtttattctttaaccttgtggattagattactgtatccatcatggtctgcagtggggagtggggtgtgatgatgatggctgcatcttgtttacacaacattttaatttcctgattgatgatgccacaatcaagatgaatgtgttgtccttgctgatataagaccgtatctaacagttcacccatatgattttccaaaacactgtgttttgtatattgttttacactgagtgtagtttgaatataagtatggggatgggtagattgctggagatagcctaaagctggctgcaagtatttgagtgctggaactgcagtagtttacaggttaagctgtgaaaatattttatgcaagctcctatgttatatcgcatatattgtagcgcttgcattgaattgtagtacctgatgatactcattt

SEQ ID NO: 24960 - DNA, 454 bp, Zea mays
  Clone ID: cC-zmle189033c08a1
ttttaaaaacgaaattacccacgattatttaaccacttcagatccttttacaagataacccaggctaaaccataccacaacataccagtacacgttacgtaacaataaaggtagccgcaagcagaagcagaagaacacgtcacgtaacaatacaggtagccgtaagcaggaacagatttcttagatcttgtcgatgtcctcgtcctcgaactggatgtagtcgctgccctcctcgccttcctcgggcccatcgacgtcgacgccctcgttgagcctgagcgtgtcaggaagctccccgtaggccttgagcaggcgcgcctcgtcgttcatgtacttgaggataacgtcggccttgtcgtcctggtagtcgcggaggccgacgaggacgatgtccccagccgcgatccaaacctttttgtgcatcttaccccggatatggcagaggcggcgcgtg

SEQ ID NO: 24961 - DNA, 452 bp, Zea mays
  Clone ID: cC-zmle189033c08d1
aactcgatctcgcacctagggtttcgtctcgtcgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagacggtctggatcgcggctggtgacatcgtcctcgtcggcctccgcgactaccaggacgacaaggccgacgttatcctcaagtacatgaacgacgaggcgcgcctgctcaaggcctacggtgagctttctgacacgctcaggctcaacgagggcgtcgacgtcgatgggccccacgaaggcgaagagggcagcgactaca

SEQ ID NO: 24962 - DNA, 550 bp, Zea mays
  Clone ID: cC-zmle189033c09a1
ttttaaccaaaacatccatgccttcacagtgtagcattagatatttctttttgaggagaaattgcacaagatgttctcattaccaagacattacaaactaaacttcaggcatttgctagataatgttttgtacaattctactgtgggaatgctaattattgcggcatagttgtattttcactaagaaaccacagtttgaattatcgcctactatttgtgacgtgtccagaggaccgggaagtcgatgccactaagggcttgttcggttattcccaatacacatggattggatgggattggaaaaaattgtgaaaaagtttgagctgtttgggattcaaacccatccaatcccgctcaatccacatggattgagagctaaccgaacaagccctaaaagttcgcaaacaaaatttgttcttctgtaaaaagaagaatcactctgtgcccttggccgcctggtacgaggtcactagttgcatctgcacatcctgcgatacaacattatgctccaggtacttcatcgtaaaatcacctttcccctgagtcgctg

SEQ ID NO: 24963 - DNA, 507 bp, Zea mays
  Clone ID: cC-zmle189033c09d1
ggcgttatacggaagggtgacttcatatacaatgtcaatacagggaagaaaatcaaagttcctcgcttggtaaggatgcactctaatgagatggaggatattcaagaagcatatgctggccaaattgttgctgtttttggtgttgattgtgcatcaggcgatacatttacggatggaacagtgaaatatactatgacttcaatgaatgtccctgaacctgtgatgtccttggcagtttcacctatatctaaagactctggaggacagttttcaaaagctctgaatcgcttccaaaaggaggatcctactttccgtgtgggtttggatgctgagagtggccagacaattatttccgggatgggtgagctgcatctggatatatacgttgaacgtattaagagagagtacaaggtggatgcaaaggtaggaaaacctcgtgttaacttcagggaaacaattacccagcgtgcttgatttgattatttgcacaaaaagcaatctggcggt

SEQ ID NO: 24964 - DNA, 459 bp, Zea mays
  Clone ID: cC-zmle189033c10a1
gtctccgccctgctgatggcaacgagactgccggagcatacaaagtcgcggtcgtcaacaggaagaggccgtccatcctcgctctctccaggcaaaagctccctcacctgcctggcacctcgatcgagggcgtggagaagggcgggtacaccatctccgacaactcgactggcaacaagcctgacctcattgtgatgggcaccggctccgagctggagatcgcggccaaggccgccgacgagctgaggaaggagggcaagacggtccgcgtcgtctcgttcgtctcctgggaactctttgatgagcagtcggatgagtacaaggagagcgtcctccctgctgccgtcacagcgaggatcagcattgaggctgggtccactcttggctggcagaagtacgtcggagcccaaggcaaggccattggcatcgacaagttcggcgcgagtgctcctgccggga

SEQ ID NO: 24965 - DNA, 426 bp, Zea mays
  Clone ID: cC-zmle189033c11a1
ctgaatattcagttaagaccattccaaggctgcttttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgtccaaaaaatatcatattcgtaaagcagaaacataaatgtactcccattaatgtggaataggccgaactgaattagtcaattcaa

SEQ ID NO: 24966 - DNA, 481 bp, Zea mays
  Clone ID: cC-zmle189033c11d1
aaaaaaaaaaaaaaaaaaaaaaaaaaaaaaaaaaaaaaaaaaaaaaaaaaaaaacaaaaaaaaaaaaaacaaaggaaaaaagggaaaataacaaaaaaaataacttagcttgggggggccctttttaggggagcttccttcccgtccccggcgatccaaaggtaagacttttgcgttgggctagctaaattcaattttctggccgtgcttccccaattcgggggcgggtattcccctggcccggcccaacttattcgctttggcgcccctccccttttctccggtgggccttctgaagatgagcccgctgcagtcctcctttcccactcggggcctacgcggtttctggcaaggccccccccttgtggcggcgattcagccgggcgggggggggggtttccccccatcgggggcgctttgttttccttcccccaaccccccgtaccttggggtttttgcctttccttgccccccccggggg

SEQ ID NO: 24967 - DNA, 516 bp, Zea mays
  Clone ID: cC-zmle189033c12a1
cttgagaacaaatatgctagctattgattatcttctatgtcatacttttctaacatttccttacatgctgttacaaactcatcctcacaatcaaatagacatctcttgaagttgcaatctaaagtttttgaaccatggaaagcttgactcaactgttgtagagcattttgataaatttgccacacacaataacgatgggctgtaacagcttcatttaaggcaacagatctatcaattaacaatgtcttgggatgtgttccattcattgccatcttgaaagtatctaataaccattggaaagcttctttactttcatcatgaataattgcagcaccaaagataattgtctgcttatgatgatgattcacactcaaagccaatggcatatcatagccttgcaatgcatatcctgaatcaaaacatactacatcaccaaaatggaaaaagtccataatagattttgaatgtgcccataaaaaatatgaaagttcccatcatcatcagattttacagcat

SEQ ID NO: 24968 - DNA, 636 bp, Zea mays
  unsure at all n locations
  Clone ID: cC-zmle189033c12d1
tgcatattcagaaaacgtgggttttctttgtccgaaggtcaacgctgtggaagacgtcaaagaatataatcactaggagaacttttgcgtgttcgagaggggtttcggaagaagaagaagggagcaaatgaagcaaagtgtccacatcttgaaacacgaattggatgccccgcaagcttgaccattagactcactgctaatggcaagtgccatttgatagagtttgtgccgaatcataaccatcaactggcaatagcctctacaattcatatgctgaaagcgaagaaaatcaggcacaaagcacgggttgtgagagaaaatctgacagatgataccgtgagtacaccagattttgagaatgaagatgaggcatatgaattttatagtatgtatgcagggaaaattgggtttatcgtgcgtacggctggcatgacagtgaataatgagaatgttataaccacaagaatgcttgtttgttcaaaagaacggttccgtgagaagaaaacaggagcattaagagtaaagaaacctcgaaggaaatgtgaactggttgtctagcatgtatggtcatcangcttggaactaacgggaaatatcgagtcacagaacttgttacctttcacaatcactagcttg

SEQ ID NO: 24969 - DNA, 407 bp, Zea mays
  Clone ID: cC-zmle189033d01a1
aaaagaaaacatgttttagttgtagaaaccatcggggccgctcactaactagtttcattttatgggcccgcaggggtgaatttcttttttccaagcctgcgaggtgaattcctttttacaagactgggctaccctgggactcttggtattcggagcgccattcccttgcacaaagtgaagagcgcccagtttttttgaccatccatgccccacccaagtttaaaccaagcaagggaccaggcctgagcttttgtgacaactggaccgcccaaggggtaagctcagaaatgacatcaacggtgccgacaacaacgtattttcagatcgaaagcattgggtcactagaaaccaatccaagttggcccagcaaaagctgggtaacagggacctgaaaggacaaccctgtg

SEQ ID NO: 24970 - DNA, 328 bp, Zea mays
  unsure at all n locations
  Clone ID: cC-zmle189033d01d1
aatatcgagacatcgtctgtccgccaccggttacctctttctccaggtagcgcaccatcggaacggcgaggagcagacgggaacggggatgggaagcgctggggcgctgctctggcacacgccgcagcagctgcacggccgtggcgtgctcttccgccagagccggactgtcctgcgccagcgcaacctgcctgtaatatcgctagctgctccggcgctcgagcccgagcgccgccgacggcagtgcctccgatgcgctgtcgtcgacggtgacggagccccccgggagtctgggccactgtcacagaaggagtctncgtccagcggc

SEQ ID NO: 24971 - DNA, 348 bp, Zea mays
  Clone ID: cC-zmle189033d02a1
gcgaacaaaaaccttgctcattgttctgtcgtctcgtttcatagcgggagcaaacaaagggaacaactggggttccaacacctaatttcaaggttgaacggtcactaacacggtgacataagcgaacggtaacacgattctatagatagataagataactcggccgaagccaggatgggcccacacattattccctccagccggcgccgccgtcgtcgtagccgacaccaccaccctcgcgccgaccgccgaagccgccaccgtctccgtagccgtcgtcaccacccttgcgccgaccgtcgtaaccgccaccgccgtcataaccgccgttacggtgcccgccaccat

SEQ ID NO: 24972 - DNA, 420 bp, Zea mays
  Clone ID: cC-zmle189033d02d1
caaggtcatcaccgaccgggagacggggaggtctcgcggcttcggcttcgttaccttctcctccgagaactccagtgctggacgctatcgagaacatgaacggcaaggagctcgacggccgtaacatcaccgttaaccaggcccagtcccgtggcggtggcggtggcggcggtggctacagcggcggtcgcggcggcggcggctatggtggcgggcgccgagacggcggttatggcggcggtggcggctactgcggtcggcgcgagggtggtggcggcggctaccgaagcggtggcggctacagcggtccgcgccagggtggtggtggccgctactgctgcggctgcagcggctggagggactgatgtgtgggcccatcctggcttcggccgagttattctaactatctatagaatcggg

SEQ ID NO: 24973 - DNA, 498 bp, Zea mays
  Clone ID: cC-zmle189033d03a1
gtatatatatagcatcaaatcatatcatcggggaccaattaatatatggttacagcagatgcaatcggatcaaccaacatgcaggtagacacacgtacgtacatgagcacaaagactgacgccaaacatgcagagagagatagcaaactgaagaactctgtttctttctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggtctcgccggactccgccgcggtctcgacgaactcgggcgcggccttcttctccggggccacgccgaggacgacggtggcctgcgcggcggtgctcgtttcctccaggtcagggtacttcttggcgcactttgcagttgagccgcagccgcag

SEQ ID NO: 24974 - DNA, 517 bp, Zea mays
  Clone ID: cC-zmle189033d03d1
cccacgcgtccgagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagttggctatctctctctgcatgtttggcgtcagtctttgtgctcatgtacgtacgtgtgtctacctgcatg

SEQ ID NO: 24975 - DNA, 396 bp, Zea mays
  Clone ID: cC-zmle189033d04a1
aggcccctaatccggagctttattacacggtctgttaactctggagtggagcatcataggttcagagtacaagagcacagcaagtctacatctagcgccgcagggctagtcggcggcggcggctactcgaagttgtagtgcttgtcgacggcctcggcgacgtcccaggtgcagctcatgcccttggggaagacgacaaggtctcccgcgccgatcttcacgaactcctccccgtggccttcggggtacaccttcaccttcccctgcagcaggtagcacgtttccttggcggagtaggtccacgggaacttgctcttctcgcacccccacttgggccactggcggacgccgagctcggagagacgggactcgggcgggttgcgctccaccttgatg

SEQ ID NO: 24976 - DNA, 512 bp, Zea mays
  Clone ID: cC-zmle189033d04d1
gacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtaaacttgctgtgctcttgtactctgaacctatgatgctccactccagagttaacag

SEQ ID NO: 24977 - DNA, 334 bp, Zea mays
  Clone ID: cC-zmle189033d05d1
attcccgggtcgacccacgcgtactggagacacagtcgaccggcgggaatgcccgtgcgcaagcactggcggacgtgtcgctggcaagggagagcgaggcgctgctgatggagctggcgctgatgcgagcgtacatgttacggatgcaccagaggagccaggggagccgctactggccatcctatgactatgaggaacaagggcccagcgacggcgactgtgaagaaggaaagctagctatggacgacatgcaggtacttacaccagtttcactgccacgtcgctcgctgtgaccttgaacataccccaaatgcccggacacagctaatagagt

SEQ ID NO: 24978 - DNA, 68 bp, Zea mays
  Clone ID: cC-zmle189033d06a1
tttttgtgaggaacagaggtttgttatttgccgacagattacacacatgattggcacggacgcgtggg

SEQ ID NO: 24979 - DNA, 68 bp, Zea mays
  Clone ID: cC-zmle189033d06d1
cccacgcgtccgtgccaatcatgtgtgtaatctgttggcaaataacaaacctctgttcctcccaaaaa

SEQ ID NO: 24980 - DNA, 371 bp, Zea mays
  Clone ID: cC-zmle189033d07a1
ccacccataaaaagggggcccccgaaaatttattgaagcgcgcacccccggacccggcacggtatttggagcttggcgacgatgtgtagtgtattttagggcccccccgacgacgacgactttaaaaaagagggggcagcaacagggagcttccccaggggcatcctgagcgcgagagcctgcaacgcccggacccccttggggacctggtccttggggtccgggtcaacaaggttgcccccttcttcaaacttgctgggcggttggggcgccctggtgaacacctctggtttgttgacaaagggggggttaaggaaaacccccacctgtcggacgtggtactgggggaggttgcccccccgaccctgcca

SEQ ID NO: 24981 - DNA, 370 bp, Zea mays
  Clone ID: cC-zmle189033d07d1
ttcggaatttccgggtcgacccacgcgttcgtagaactagtcctgacgcgtggggggccgccgacatcctcagcgcgtctggcggttcgggggggcaggcggtcggagtaccacgtccgccaggtcggcgtcttcctcgacctgcacttcgtcaacaagcccgaggtgttcaccagggcgcaccagccggccagcaagttcgacgacgacgggcacctggtggacccggacaccaaggaccaggtcaccaaggtgctgctggcgctgcatgctctcgcgctcatgctgcacctggggaagctcgctgttgctgcacactcttcttgaacgtggtctgtgtcgggggtgcactaaactacactacacattg

SEQ ID NO: 24982 - DNA, 247 bp, Zea mays
  Clone ID: cC-zmle189033d08a1
aaggtgaaaccttaaaattcataagggtctaggcccttttgatgaaaaaaaattttgggtctcaacacaaggatggaactggttctttaaatcacggaattcactccccctatttttgtcacactaaccacaggtggtttttggacaagtcctttcgtataggggctccccaagagggaccaaaaacaccctataccctgtatcctccctggcataaagaaaccagggcttacgtgcccccacgggg

SEQ ID NO: 24983 - DNA, 312 bp, Zea mays
  Clone ID: cC-zmle189033d08d1
ccgtggtggtcagtaagccatggttcatttaagctgctgctgtacctgggtatctgcgtcgtctggtgccctctggtgtacctctatatggatgtcaccgtctaataaacatctgtggtttgtgtgtcatgaatcgcggttgcggcttcactggtttaatggacctgttgcgtcctctgtgttgtacccaaaactcttctgcagcagcatggcttgaatccttatgaagtttgatgtgtgaacttatgcaaaactttggacaagatctctactattacagtgaatagtgaaaaaaagagagagttagctcat

SEQ ID NO: 24984 - DNA, 492 bp, Zea mays
  Clone ID: cC-zmle189033d10a1
ttttgatgaaagtataacgtagcttcttatttatgttcaagtgcgatagctacacatctttactcacgactcggccattcaatcaatcaatcaacgagtgtttttttacgttcatcgagtgaaatagccgtcaagaagattcaagatgaaagaagccggcaatgagcatgagccaattccaatcactagccgatggagtgcctccgatccttggtcctggacggcttggtgcgcactttggcgccacccacggcgtcaggccgcaggaacgggttcagccgcccgagcttcttggacacgttgttaatgaaccccccgctgccgcctgccgacttcttcggcagcgggcggcgccccgatggtggagcgtctctgggctgcgggggcgccgacgggtcccttaggttcatcttcagccgcagcagcttcatcttgagcttctcgttctcccgctgcagctgtgacatttcgtacggcacgctccgggcgtgc

SEQ ID NO: 24985 - DNA, 563 bp, Zea mays
  Clone ID: cC-zmle189033d10d1
atgataaacatgtcatttcaacttggggttcatgtaacagtgttgacattatatcactttcccatacccgctctgctgaagatgtcagggagctcagggcctttttacaagcacacgcccttcccgacacacaaatatacgcgaagattgaaaattcagagggtttggatcattttgatgacattctcaacgcggcagatggtatcattatttctcgaggagacctgggtattgaccttcctccagaaaacgttttcatgttccaaaagacagctattcataaatgcaatttggagggtaaacctgtgatcatcactagagttgtggacagcatgattgacaatctacgccctacccgtgcagaggcaactgatgttgcaaatgctgtcctagatggcactgatggcattttgcttggtgcggagacacttcgagggctttatcctgttgatgcactgagtactgtggggagaatatgtgcagaagctgagactgtgtataatcagccgctttaattcaagaaagtaatgtggcatgtaggtgacccaatgccccacgaggaa

SEQ ID NO: 24986 - DNA, 446 bp, Zea mays
  Clone ID: cC-zmle189033d11a1
ttttacattcacgatattatcattaaacattactacatgtgttactctctgaggggcgaccacgcggttaaccacttatcaagtcgcagcacagtccagtccttagttctagtatcatacataaacaactatttctgctattagcagctcggaaaaatacaagtttgctctcagagttcatcaaccatacaaaaactcaagggaaaaaaaagtgcctcgatcttcccatgtggccatcaccgagtgccttcatcgagtgctctagagcgccttgttctcctgtgcctcttcaacgagcgctcttatcatccttgtcattaccctggcctgtggacgacggggagtagcccggtgcagtgggggagtagcttccgctagggctgtaatttggagaggtcgggctgtattctgggctgggtccttcagaggtgttgaacgggctcgtt

SEQ ID NO: 24987 - DNA, 399 bp, Zea mays
  Clone ID: cC-zmle189033d12a1
aggcccctaatccggagctttattacacggtctgttaactctggagtggagcatcataggttcagagtacaagagcacagcaagtctacattgagcgccgcagggctagtcggcggcggcggctactcgaagttgtagtgcttgtcgacggcctcggcgacgtcccaggtgcagttcatgcccttggggaagacgacaaggtctcccgcgccgatctccacgaactccttcccgtggccttcggggtacaccttcaccttcccctgcagcaggtagcacgtcttcttggcggagtaggtccacgggaacttgctcttttcgcacccccacttgggccactggcggacgccgagcttggagagacgggactcgggcgggttgcgcttcaccttgatgccc

SEQ ID NO: 24988 - DNA, 562 bp, Zea mays
  Clone ID: cC-zmle189033d12d1
cgggtcgactccacgcgtccggacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggtgaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtagacttgctgtgctcttgtactctgaacctatgatgcttcactccagagttaacagaccgtgtaataaagcttccgattagggga

SEQ ID NO: 24989 - DNA, 432 bp, Zea mays
  Clone ID: cC-zmle189033e01a1
tttctttttttttttttttttttcatcaaacaaaaagggtgaggactcttggtgtttaataaaatgattgattctataataatcctccccaaattattcttctaggtttaatttaaaaagacaaaagaatgcctttttttttttctgtggtgcatacccaatttcaggtcttctgtgctacccatgcttaaaaaataataaggggaccgaagatatcagaaaaatgtgtttcccccccatcccccggggataaagtttgtcgctatgttgtccctggcccaactggtccctttggatacgcacggggatttccggggcggtttcctttttcacccactataatggatgggtggtttcaccctcttttccccaatttgactattttgttgaggagacaactagcgtccaaaaaagcggggaggccctggaaat

SEQ ID NO: 24990 - DNA, 378 bp, Zea mays
  Clone ID: cC-zmle189033e01d1
gtacacgcaccccaacctgacgtggacgcagcacgcgttcaacgagaaggtggccgagctccggcgcgtcgcggtggaggcgttcgcgcgcctcaaggcgcgctgggcgtgcctgcagaagcgcaccgaggtcaagctgcaggacctccccgtcgtgctgggcgcctgctgcgtgctccacaacatctgcgagattcggggcgaggaggtggacccagccatccgctgcgaactggtggacgacaagaccacgccggagaaccccgtgcgctccgagacggccagtcgcgccagggacaacatcgcgcacaacctgctccaccgtggcttgggcggcaacacattcttctgatctcatccgtcaccttcttctttttt

SEQ ID NO: 24991 - DNA, 388 bp, Zea mays
  Clone ID: cC-zmle189033e02a1
gcggaggctggaaatgggaactccctccaccccagttcaagatgaaccaacacgaaaatgtttgatacacaatactccaaaacaacacaagcgcgttctactgcccgagcagccttttgacgccggacttttggtccgccgtgagcctcgccgggaacttgatgtcgaacttgatccggaggttgccctttctggacgggtccttgggtattgggatgcccttcccttgcaccaccttcttgtagcccgggtggatcacggagctgatgggcaccgtcaggctgcgcccgtccagcgttgtcacgtgcgcggggtaccccgtcagggcctccgccagcgggatcttctgggtcaccaccaggttgttgccgtcgcgggtgaacaccgg

SEQ ID NO: 24992 - DNA, 207 bp, Zea mays
  Clone ID: cC-zmle189033e02d1
ctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccaatacggcgaggagggtctcaaggggcaggtgccgcccccggccgccgggggggcggccccg

SEQ ID NO: 24993 - DNA, 389 bp, Zea mays
  Clone ID: cC-zmle189033e03a1
ggggacaaaaatcggtgtttttatatgcctggggcccaaatcacacaaagggattgccggaggaaaacaccggactctttaaaataccctttttaccaaattaaaagccctacttattggaattttatcacttatttcgcccaattgggatgggcccaccgcgcaactgttcccaggatcaccggggtcccgccctgggggatatgtccatgccgctgatctttggaaaaactcattcagtttcacttcccctttttgggggtatctggggagaaggggcccatctcaagcttataagcctggcccttttggtgaatcaaggcacatttaatttgcgagggcctttggcaaccttttttagggcccggggaaccccttcaaggcaattt

SEQ ID NO: 24994 - DNA, 370 bp, Zea mays
  Clone ID: cC-zmle189033e04a1
ctttcttttttttttttttctttttttttctttttttgtggttgggttccatctttatttttctttttttaaaacccaaaaaagcccaaaaccttttggatttgagttgaactctccccccggtcaagagggtttatttaaatattttggggccgtccctcttttcctacaattgataaaaaaaaaggggctaacccccacaggggcctttacctttttgtgaaccataaaaaacacttgggggggggggggtctccctaaaaactaaaacccatctaattgattatacccgtttaacgttactccggtctttaaaaaacttcgtttccccagagctgggattaaaccaagttttgggcattgggggctt

SEQ ID NO: 24995 - DNA, 429 bp, Zea mays
  Clone ID: cC-zmle189033e04d1
ggctggaagaaccgagagcgctccggaaatgtcggcgggtgagctgcggttggagctggacgagctgcggcgggtggagagcctcgccaagcacccccgcgtgcagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctgagaa

SEQ ID NO: 24996 - DNA, 547 bp, Zea mays
  Clone ID: cC-zmle189033e05a1
gcagcggaaataaattctttattggaaaatgattacaagttacatcaggattttattatacatcatcggagtgattacaaaagaaaatgattcataaagattacaatttgaatgtataaaacatttataagttttaaaatatatgctagcttaagtgacaatcctcaataaagaagttaaagatgggatatacttatataagaaggccgagcccaccggctcttagcagcatccacaacagaacaaaattataacctgggataaacactatgttagtgttgttaattgacgaccacttggtaagtatcttccattctgacacttgggtgattcattcattttagcttcgtccatcagcatcacttggagatcaatttcacttcgtttttctagcacgtgatcaattaacgtacctaatgatatgcataatgcatatgtttgaacataagaacttgtaccattttttttgaaggttttgggtttaggaattaaacattcttttgcaaagcatttttaggcagccttaagtaattacttgaaacattta

SEQ ID NO: 24997 - DNA, 480 bp, Zea mays
  unsure at all n locations
  Clone ID: cC-zmle189033e05d1
cggacgcgtgggcggacgcgtggggaataaaacaattaaccgctgtgctgctgtctaaaaaaattctgcgggtattaaattgttggcttgaagttactattgtttggctaagtaagtttagctgattcttaattggtgaagtgatgctttgttttagtaattatcatgttctatggttgttgattgagtaaatatcataaatggagattggtcgcttaagttaatcatctggaataaatgttcctcattatccttattagttggaagcaaatagcagcaatacgtttattccagttgtaatccgagagctatatagtgggaagtgcatttaggcgcttaaagtcttttgcttctaggttatagttaaatgagattatgtaatacttgatgatgctctacttgctaagacanatagtgtgatgtgttatttagctcgtgcgctatgctagttaatccgatgaaatggttaaaaagttagtt

SEQ ID NO: 24998 - DNA, 420 bp, Zea mays
  Clone ID: cC-zmle189033e06a1
ttttagctaactctctctttttttcactcttcactgtgatagtatacatcttgtccaaagaatcgcatgctgctacattggaagcagcatccgccttggaccattggaaagaattacatttaaccctctccatacatacatggtactacttcgccagcttacgttcttcagtcgacgtaccccactcacgctaatcagaggtggaggctggtcaggtcttcaggcacagcccctccccgagaaaaatgaagaacacactacacgctctatactccctgtcaatcggatttttgtgcagaggtgctcgttttcgactcagcttggtagtagaccacatcttcggtatcactgacatagtggtcttgcttcaagctctgtgccagcacccggaataagtgccacgggagagcaccccgactt

SEQ ID NO: 24999 - DNA, 231 bp, Zea mays
  Clone ID: cC-zmle189033e06d1
cggaattcccgggtcgacccacgcgtacgcccacgcgttcgggctggatatggtcacatacttgcaccatcatggccacgaagacaagcttccctggtaccgtggaaaggagtggagttatctgcgtggaggactgacgacgctcgaccgggactacggatggatcaacaacattcaataccacatcggcactcatgtgatccatcacctctgtcctcagatgccgcatta

SEQ ID NO: 25000 - DNA, 414 bp, Zea mays
  Clone ID: cC-zmle189033e07a1
ggacaatgaacacaattattccttgtcgattgaacaatagtttacattatggtacaaaccgaaaaccagcgtgcgctcacatgcatccggacacctaaaggtcaccgggggcgcctccctcacttgccggggaccaagttggtggcgtaggcccaagcgttgttgttgacggggtcggcaatgtggtcagggaggtttttgagcgggcccttcccggtgacgatggcctggacgaaaaatccgaacatggagaacatggcgagggggccgatcttgagctccttgaccttgagctcggagaaggcctcggggtcttcggcgaggccgagcgggtcaaaactgccgccggggtagagcgggtccacgaccttgccgagcgggccgccggcgatgcggtatcccttgacggggccc

SEQ ID NO: 25001 - DNA, 500 bp, Zea mays
  unsure at all n locations
  Clone ID: cC-zmle189033e07d1
acggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgttcncgctagtgagggaggcgccgncggtgacctttatgtgtccggatgcatgtgagcgcacgctggttttcggttt

SEQ ID NO: 25002 - DNA, 381 bp, Zea mays
  Clone ID: cC-zmle189033e08a1
ttttcgttaaatgataataaaagggaagaaattcaacatacatatcatcggctacggtgtaaccgtatcaacatacaacctatccatgtcccatgaaccccatttgttagacagcaacaaccaaaaattttaccccaaccggatgatacaacaacagtgagatcagccacgcagtcggaagggggatcagttcccctgggcgcccactgcctccgctgctcctgtgactgcccagcagtacctgtaggcagcgtaaacggaggacacgaccaggacgccgaggatcatgtaggtgacgatcgtggccacgctgatttggccggggaccttcttcaccttgctttgcgcgagcaaggccttcggcttgatcttcgccatgtt

SEQ ID NO: 25003 - DNA, 446 bp, Zea mays
  unsure at all n locations
  Clone ID: cC-zmle189033e08d1
caccttgcctgtatttcaagaaatagtaaaagggatggaagaaaagggtgatatgtttaattaccttgctggttgctgctgctgcctgtaaagccattccattggtagaggagtgccgaagtcaagtcagggtgcaaagttggatgaatgaactcttgaacctttttgtttgtgccattctttattaatatgggctttatcccatgtaataagacaagtaactcttacatgaaacttatgttctgccatggagtttccaagtaggttagttgctcctggtgtcataatctccaaataaccccatgagaatatctntgtttgccctgtccaccaggtatttcaagtttcaactgagaaattatacatcctatagttngcanatgagcatgaattcgtggcgcatgaaaaaaaaagtatattctgcttgtgtatttcatttaatagac

SEQ ID NO: 25004 - DNA, 396 bp, Zea mays
  Clone ID: cC-zmle189033e09a1
gacggcggaggccatggccggcgggtggctgcggtcgggcgacctggcggtgcggcacgccggcgacggctacgtgcggatcctggaccggtccaaggacatcatcatctccggcggggagaacatcagcaccatcgaggtggaggcggcgctgttcgcgcacccggccgtggcggaggccgcagtggtggggcggcccgacgagtactggggcgagacgccgtgcgcattcgtgacgctcagggagggcgcggccggcagcgtgcgcgccgaggaggtggtggcgttctgccaggcgcgcctgccgcggtacatggcgccccggacggtggtgttcgtggccgagctgcccaagacagccacggggaaggtgcagaagttcgcgctccgggagca

SEQ ID NO: 25005 - DNA, 63 bp, Zea mays
  Clone ID: cC-zmle189033e09d1
aaaaaaaaaaaaaaaaaaaaaaaaaaaaaaaaaaaaaaaaaaataaaaaaaacattaaaaaaa

SEQ ID NO: 25006 - DNA, 425 bp, Zea mays
  Clone ID: cC-zmle189033e10a1
gagtacggttttttttatattatttctttgttaactcttccacccattgtcatgctcgaaaaaaacacgccaaaaaatctttatacaaaaaacccccccgttttttacccaaccccaaggggggacaccccggggggccgaaaattaaaacacccccccttttttcacaaacaaaacgcaaaaaacccccgccttgataatcccacccccggaagggcccctgtttttataaaaaaaggggctcccccccccaggatccccagggggggggccccccaaaaaaaaaacccagggttcccccccataaaaacaccgccggggggaaaacccacacccctcgtgaaaaaggggtatttccctcaaaaatctccccctattttgaagaaaaagggggcaccccccggcctttcccttttacccggggg

SEQ ID NO: 25007 - DNA, 608 bp, Zea mays
  Clone ID: cC-zmle189033e10d1
cgggtcgctcacgcgtccggcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagcagcagccgcagggcgagctcgcggcgctgatggcggcccacgtagcgcagcagctgacggcgatgtgcggcctgcagctgcagcagacaggtccctgcccttgcaacgcagctgtcggcggtgtctactac

SEQ ID NO: 25008 - DNA, 235 bp, Zea mays
  Clone ID: cC-zmle189033e11a1
aagggggtggggtttgtttttaaaacaaagaggagattgatcctttttttaaaccccccgtgtcaacttgggcggtggggggagcgaaccatttccccccaaattttttcgccggccgaaaattctttatcatcgcgtccaaagtggtgcccacgggggggggcactggaccctttgggcgccgcccggagtgttcttatctttgtctgaagcctctaggtggtggtgttgccgc

SEQ ID NO: 25009 - DNA, 540 bp, Zea mays
  Clone ID: cC-zmle189033e11d1
cggaacccccgggtcgactccacgcgtccgcggacgcgtgggcggacgcgtggggaataaaacaattaaccgctgtgctgctgtctaaaaaaattctgcaagtattaaatgggtggcttgaagttactattgtttggctaagtaagtttagctgattcttaattggtgaagtgatgctttgttttagtaattatcatgttctatggttgttgattgagtaaatatcataaatggagattggtcgcttaagttaatcatctggaataaatgttcctcattatccttattagttggaagcaaatagcagcaatacgtttattccagttgtcatccgagagctatatagtgggaagtgcatttaggcgcttaaagtcttttgcttgtaggttatagttgaatgagattatgtaatacttgatgatgctctacttgctaggacaaatagtgtgatgtgttatttagctcgtgcgctatgctagttaatccgatgaaatggtttaaaaagttagttaaagtatctctattcaaattccaagctgt

SEQ ID NO: 25010 - DNA, 409 bp, Zea mays
  Clone ID: cC-zmle189033e12a1
gggggggggaaaaacaaaatctttaagggggtcacgccctctggggggaaaaaagtttgggggcccccaaaaggggcccaacggggccttaaaaccacgggacccccccccccttgttggggccccaaacccccagggggtatttcgaccccccccctctttgtgggggcccccaggggggcccaaagaacgcaaattccccgggcccggagctttttaaaggaacccggggttatcgccccccccgggggggggcccccagggggggggggcccccctccggggggggagaaacacgggggggggggcccacccccacgttgttgccaaaaaaaaaaaacacctgggggggggggggggggcccccttgggccgggaaacttgcctaagcgggggggagggggggggg

SEQ ID NO: 25011 - DNA, 569 bp, Zea mays
  Clone ID: cC-zmle189033e12d1
cgggtcgattacgcgtccgctttgctggcaagcagctggaggatggccgtaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcaaagatccaggacaaagagggcatccccccagaccagcagcgtctgatcttcgctggcaagcagctggaggatggccgcaccctagcagactacaacatccagaaggagagcactctccacctggtgctccgcctccgtggtggtcagtaagccatggttcatttaagctgctgctgtacctgggtatctgcgtcgtctggtgccctctggtgtacctctatatggatgtcgtcgtctaataaacatctgtggtgtgtgtgtcatgaatcgtggttgtggcttcgttggtttaatggacctgatgtgtcctctgtgttgtacccaaaactcttctgcagcagtatggcttgaatccttatgaagtttgat

SEQ ID NO: 25012 - DNA, 528 bp, Zea mays
  Clone ID: cC-zmle189033f01a1
cgcgcccgaacgcttggatcctatagagcggacgccctctcctttgacacacattttttttttttcagctgtactcgatacttctgggggctgggtctgcacatgccctcgatcagtgcccacttattctgctctggctcattcacttttacgctagctaaatctctgcctgttggaccaaatctcatcagtatcatatatacaccccatatgacctatgccaggcgaagttgcaccgagctacattcatcttagcatgcacagtccacctgttgaggcaagaatcatactgattaacctcatctggagcacagtctcttccatggtcagcggcatagcccgcaataacaaagagcttaccaccaataacaaccacaccaaactccttgctttgggatagtaccaggcatgcgtggaagagggctttgcttttggcccgaacactctaaaatcttccagtgtgaccccctttgtccccagtcttctggaaaccaggacattcaacccacttccttaaggttttccaac

SEQ ID NO: 25013 - DNA, 626 bp, Zea mays
  unsure at all n locations
  Clone ID: cC-zmle189033f01d1
gtcattgaaaccttgcgatagcaatattttggttcacccctcgtgatcatattctgcatgggtgaagatggttgggccatcagcagccacaaaaaaaaaaacacaagtatatgccctagttggttcttggtgctttgtgatctctcagaagcactgaattgtgaataccgtcaaaagcaattatcggcaggttattttaccagtcacaatggtgcttcttggattcaaaacaattatcttcagaagaaatcatggaaccatcaaacccagaatatcttcacacagaaatcagaattgaatagaagattatgagcaaggacgaactctgctctggccgtctcattatatgaattgtgtcaagggtaataacaatattagtatggatggagcaggaacaagcattgtggcgctgcatcagaaacaatctggaatggcttgggttttaatgtgtctgggcgtgcgtaagtgaaagctaataatgaattctcgtaccatttntaggtaggattaagctcatgtaacacacagcacactattcactaagatgtactatgagctaagtgaaacgtagggacataggtgccgttggtcacatatttgtacgtaatgagtaactaataatctaa

SEQ ID NO: 25014 - DNA, 474 bp, Zea mays
  Clone ID: cC-zmle189033f02a1
tttttggcgctgcaagcagcagcttttctgggtcaatgtacagaaataagtagagagaattacaatccaagacgacctttctgcagccacacgaacgccaacggtgcgagcttctcaggcagcgacgtgcccatcccgcacgtaacccgcatcatgcacggcatgaacgcgccactgagctgccgcgcgcggcaacagagaaaccgactgccccgcgcacgtacgcgaacgccacacgcactaattaacgctactatcagagtattgcctgagcttcacgcggtgagaccgagccgctggaggtgatggtcagtgtcctccgggtggtcgtcgagcaccctctgccgcggcgggagtacccaccggccgttcttcgtgctcaccatgcccttgatcttcgcctggtaccacacgggcggcaccatgtggtcctcccggaagaagtcggtggacttgttcaccagcgcgggggtc

SEQ ID NO: 25015 - DNA, 520 bp, Zea mays
  Clone ID: cC-zmle189033f02d1
cccacgcgtccgtgctaccacaacctggaggcgcacctgcacctgctggacggcttccgcggctccggcgcggggttcgagccccgcgggagggaccccgcgctggtgaacaagtccaccgacttcctccgggaggaccacatggtgccgcccgtgtggtaccaggcggagaacaagggcatggtgaggacggaggacggccggtgggtgctgccgccgcggcagagggtgctcgacgaccacccggaggacactgaccatcacctccagcggctcggtctcaccgcgtgaagctcagcaatactctgatagtagcgttaattagtgcgtgtggcgttcgcgtacgtgcgcggtgcagtcggttactctgttgccgcgcgcggcagctcattggcgcgttcatgccgtgcatgatgcgggtgacgtgcgggatgggcacgtcgctgcctgagaagctcgcaccgctggcgttcgtgtggctgcagaaaggtcgtcttggattgtaattctctctacttat

SEQ ID NO: 25016 - DNA, 472 bp, Zea mays
  Clone ID: cC-zmle189033f03a1
ccacaccgctctcacttattatggaacacaattatacacgcatgcagagaaaacgaagcgagtacaggaacacgcctttctggacgtagccccacgcccaccaccttttctccctcagtctcacactctcactcaccacaagcaagcagttaccaaggtccggagagggactcattattgggaaccatcaaattacacacgcatgcagtacagaattaaacaggtgtgtggttgtgtgcgccggagctagctagcttggtcgcgcgccggccggtactacggtcagccgaagaggggggggggcttcttctcgccgctagcctcctcggcgtccttgtggtcctttttcttctcgtggtgctcgtggaatacgtagccgccggcgccgacggccgccgaggcagcgacctcctccgtgatcttgtgcctgtgcgcgtgctcgggggccttcttcgccttgggcttttcgtaa

SEQ ID NO: 25017 - DNA, 467 bp, Zea mays
  Clone ID: cC-zmle189033f03d1
ggaatttttggttcgacccacgcgtacgcggacgcatgaggaggagctccccaacggttactacttctacttgctacaccaatgtggtcaccaccaccgacgaaggcgagtacgaaaggtacaagaaggaagataaggatccctagcacaagcagtatctcggcgaggccggctccatgagaagcgggacctttactctctacgagaagcactaggcgaagaactatccccagcacgcgcactggaacaatatctccgcagaggtcactggcgcctcggccgttggggccctgagctacctattgaacgagctcctcgagaagaacattgaccaccacgtcgccggggaggcttgcccccagaagtagctccaccacctcttcagctgaccgtagtacctggcggagcgcgaccgatataggtagctcctgtgcacacaagcactcacctgtttaattctgtactgc

SEQ ID NO: 25018 - DNA, 423 bp, Zea mays
  Clone ID: cC-zmle189033f04a1
gggttggggaaaaaaagcgaccgcccgaatttgctttaacaagttcattacatacccgattccctcttttggtttccaaaggtttccatgggatacatcccccttcccaagatccatgagggggggcggcccccttgcaggtagacccttgaatcactcgggctgggcgtaccaaaccccctggatcttgacatccttgggcgccttggccccgaggtcggtgtcggacgggtgcactcttttaaagaccccgatgaccttgccggtcttcgggttgcttttggggaccctcaacgtgatgtttccgggggagggggcggggtttttgaaggccttctttgggagctccttcttgtaacctttgccctcgggggggagcgcgacggctttttcttatccggtggagcccccccggcccttggg

SEQ ID NO: 25019 - DNA, 480 bp, Zea mays
  Clone ID: cC-zmle189033f04d1
cccacgcgtccgcgcacccaccagaggaaaagggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcagggccggcagtaccagatgaagaagctgtgcctggagccgacg

SEQ ID NO: 25020 - DNA, 389 bp, Zea mays
  Clone ID: cC-zmle189033f05a1
tttttgataaaatacattacatttccaaatctgtactattattccgtggagaaagcagcaaaattaagacaaatagtataaagaaaagcaggcaccatgatggactagatgagtgagaaggtttccaattaactaatcaagcacaacaacacaagtcggttcgatcgctacatcgtcactcctgttccttgggcgctccggcgccgaccggtatgaactgcgccaccttgttggccgccgggcgcgcggcgaggccctgccaccaggcgctgacgtgcgggagcgcatggacgagagcggcgtactcggtggccatgaggcatagcatgatggtgaaggagctgaggtccgcgaggctgaagaagcccccggcgaggaacgtgcacgtg

SEQ ID NO: 25021 - DNA, 331 bp, Zea mays
  Clone ID: cC-zmle189033f05d1
gatcgccatcgtggtgggctcagctggtgggcctccaccttcagctgagcccgccggcgatcgccatcgtggtggagtgcgtgttcgcgccgatcctgggccgcgagcgcaaccaggcggtggtggacgagaacgtggagaagctcaagaaggtgctggaggtgtacgaggcgcggctggccacgtgcacgtacctcgccggcgacttactcagcctcggcgacctcaggcccttcaccatcatgcactgcctcatggccaccgagtacgccgttcttgttcatgcgctcccgcacgttagcgcctggtggaggggctctgcgcgcgcccg

SEQ ID NO: 25022 - DNA, 90 bp, Zea mays
  Clone ID: cC-zmle189033f06a1
aaatggagataatctcggtttgctgggatggtgacaaggttaaatacgaacgaaaacttgtatggctaggcacgcacatgcgtgcgctaa

SEQ ID NO: 25023 - DNA, 157 bp, Zea mays
  Clone ID: cC-zmle189033f06d1
cggacgcctgtacatacgcttgatcgccttccaagcttgcatggacgagcattttccctcagactgccgggtggtatgacctcaactacaccctgtaccctggccacaacgccatggatgctgtcgtgaagggcgaccatgatgaacatcaccatgt

SEQ ID NO: 25024 - DNA, 422 bp, Zea mays
  Clone ID: cC-zmle189033f07a1
cggccctcacaggggagcagtagatatttctttttgaggagaaattgcacaagatgttctcattaccaagacattacaaactaaacttcaggcatttgctaaataatgttttgtacaattctactgggggaatgctaattattgcggcatagttgtattttcactaaaaaaccacagtttgaattatcgcctactatttgggacgtgtccaaaggaccgggaagtcgatgccactaagggcttgttcggttattcccaatacacatggattggatgggattggaaaaaattgtgaaaaagtttgagctgtttgggattcaaacccatccaattccgctcaattcacatggattgagagctaaccgaacaagccctaaaagttcgcaaacaaaatttgttcttctgtaaaaaagaagaatcac

SEQ ID NO: 25025 - DNA, 519 bp, Zea mays
  Clone ID: cC-zmle189033f07d1
ttcaaaagctctgaatcgcttccaaaaggaggatcctactttccgtgtgggtttggatgctgagagtggccagacaattatttccgggatgggtgagctgcatctggatatatacgttgaacgtattaagagagagtacaaggtggatgcaaaggtaggaaaacctcgtgttaacttcagggaaacaattacccagcgtgctgaatttgattatttgcacaaaaagcaatctggcggtcaaggtcagtatggacgagtttgtgggtacattgagcctctaccttcaggttctgatggtaaattcgaatttgataacatgattattggacaagcaattccttcaaactttataccagcaatagagaagggttttaaggaagcttgcaattcaggctcgttgattggtcatcctgttgaaaatttaagaattgtattgactgatggggcttcacatcaggtggattccagtgaacttgcttttagctagctgctatctattgcttttcgacagtgctacac

SEQ ID NO: 25026 - DNA, 75 bp, Zea mays
  Clone ID: cC-zmle189033f08a1
agggccctaacccgggggtatgagacacggcctgttaacgctggagtggaccataatttgttcataccacaacat

SEQ ID NO: 25027 - DNA, 320 bp, Zea mays
  Clone ID: cC-zmle189033f08d1
gacaagcccaatggatggctccccagtggaggatcccacttcccgccggctcatgtattgttcctttggctttaccatcacatcagggaggggggaactcgctgtggatatgtcctccgcacggactatgagaacggacaaggtgggcgtcaaggtgggacgcccccctgccgacttccgggtatccaagctccacgttcgtcaatgtgcctattggggctgcaagaagagcaactgtccaggtacctactgcggcattgagacgtgcatcctgcctctagcgacagggtctgtgggcccctacggccacggtgacgaga

SEQ ID NO: 25028 - DNA, 420 bp, Zea mays
  Clone ID: cC-zmle189033f09a1
ggcacaatgcacacatccatacagttctcaagttcgtaatatacgaagtacacaagttctgatagatgcaaatacagcgcatatcttataaccacctaagacgacacacctcgcagatcaagctgagcgctccctggacacagacctggagtacgaactgcggctatgagagtggctttcccttgaatgacgactcttgccagagtatctgctacgcgagggttcccttttactccctttcttaggagaatagcttgttgatctctcggattctggggaatggctgcgcgagtagcttctctgtggtgataaactgcacgaatagcttcgtcctctggcccttggagatgaactggatgacttggagacagatctgtacctgtgccggcggttgtatggcgaaacagaaggtgacctgcg

SEQ ID NO: 25029 - DNA, 569 bp, Zea mays
  unsure at all n locations
  Clone ID: cC-zmle189033f09d1
cgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaaggcaaagagaagacgaggtagaaccccaacacctgggaagtatcttggcacaaaatcatcccgtggacggaggtactncacaagctactcaccttgatcgagggggccgtacagttcccgctactcacctgatncgagggactgtcatggtagagacccgtcatactctcatatgac

SEQ ID NO: 25030 - DNA, 459 bp, Zea mays
  Clone ID: cC-zmle189033f10a1
gaatatagcaaacttggatattggattagcttagtttgtagtatactattacacgactctagctatagctagctcatatacaaaccatcacatgatatatagatacacacacgcatgcatcatacatgcatctataatacttaattacacgcacgcgcgctatctctcgatcgtgaagaagagagattgctagctttattccggtccgatgatgatatggacgcacacatatatttatacatagatccttggttctacaatacgttgacagtaatctgtatatatgcttcgcgtagtggttttggttggttcttattgtctacaccgccgtcgtcgtcctcgtggatgacgacgagtcgccgccgtcgccgacgccatgatcagaacaggaacgccgtcggcgccaacgctggcagggacgacgcgctctaaagtgccggtactgctgccaccggcgcg

SEQ ID NO: 25031 - DNA, 596 bp, Zea mays
  Clone ID: cC-zmle189033f10d1
aattcccgggtcgactccacgcgtccgaaagaggtgtccatggtgctcaagctcagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgct

SEQ ID NO: 25032 - DNA, 444 bp, Zea mays
  Clone ID: cC-zmle189033f11a1
caggtggttcagatttattctatttcgttggagcagtagcatttgaagtgaacgatactctttcccgtagcgtagccccttgttcaacagataacagaagcatggcacagttgccccttgttcaacagataacagaagcatggcacagttgcccctgttctacaggtaacagaagcatggcagagaggtaaagcaaagagaatcttcttagcaccgcacagacgagccaaccttgatgcaacttgcatccatcaaatttgatagaaggaactttattctcatgacaacaaataagctacaccgcagaacacacatacagaacgcatggatacagtacaacatgcacctcatgaatgaccccccttgcaaaaggctcacactacttatgacggccacagagacagttctcaaagcctacgactctggcaatgcaggggggttgac

SEQ ID NO: 25033 - DNA, 253 bp, Zea mays
  Clone ID: cC-zmle189033f11d1
accccggtcaccacgcgtccgcccacgcgtccgaaaaaaaaaaaaaaaaaaaaaaaaaaaaaaaaaaaaaaaaaaaaaaaaaaaaaaaaaggggggtcttgggggaaagtaaaaccttattttcgtttgcatgcaacgcacttcctctcttttattttgggttcaccttcaatatgctaggtcttcgtttgctttcctaagaaatgccaaaacactttctttacctacacctttctatttgatccccataccc

SEQ ID NO: 25034 - DNA, 519 bp, Zea mays
  Clone ID: cC-zmle189033f12a1
tttttgttgccaacaatcctatatttgcataatcaaatcataattccagtataaatctgtgacatcataatttattgcgtcaaatcaaaagacaatctgaaaagagggcaaaattccctaacaagatatcttgtgctcttgctgtactctacttggaacttggttaaataagtgagatggaactggaggtaatctcccatgcgatacatgaaactacagcatgggttgtaggtatcaatcatctaatgcctaaccttcacactcaatgatcttgacaacagaagaatcaccaatcttttcaaagattatcaacctgtcgaaaggcttcactatgccaaccgaccgaccatagctcatcgcaagttttatcccatactcttcctttggtagcccaccagtttcggcctcataagtactccccatcaaagggtacacgcctctcactgcgaaacattgtcttgcctgtgttgtgccataagacgccactttgatggtcggatccttcacgtgggaagatac

SEQ ID NO: 25035 - DNA, 593 bp, Zea mays
  unsure at all n locations
  Clone ID: cC-zmle189033f12d1
atgataaacatgtcatttcaacttggggttcatgtaacagtgttgacattatatcactttcccatacccgctctgctgaagatgtcagggagctcagggcctttttacaagcacacgcccttcccgacacacaaatatacgcgaagattgaaaattcagagggtttggatcattttgatgacattctcaacgcggcagatggtatcattatttctcgaggagacctgggtattgaccttcctccagaaaacgttttcatgttccaaaagacagctattcataaatgcaatttggagggtaaacctgtgatcatcactagagttgtggacagcatgattgacaatctacgccctacccgtgcagaggcaactgatgttgcaaatgctgtcctagatggcactgatggcattttgcttggtgcggagacacttcgagggctttatcctgttgatgcagtgagtactgtggngagaatatgtgcagaagctgagactgtgtataatcagccgcttcaattcaagaaagtaatgtggcatgtaggtgacccaatgccccacgaggaatctgtggcatcagcagcggttggttctgca

SEQ ID NO: 25036 - DNA, 407 bp, Zea mays
  Clone ID: cC-zmle189033g01a1
ttttaattcgaacaaaacaaatcctaatcataaacggggtgggtacacagatatttctccatacgttcatgctcatagaggatgacgcagctgaccacctaaagccgcatacttacttattcatactgacccagcatgaggcgacaccggaaggtcacatgccaacagacgacatatttccataacaatagcggtggctaggctgcttgacagaataaccaatccacaaccacaaaattgcgacgatttaaaataaacaactcagaagcaaattgaccccagaagcccggcttactcatgaagcactcccgtcttctcctgcatggcattcggtctcttcttgcagcatataagtacacttgggcttgaaggccttcttcataggaggaggagcactctccacgttc

SEQ ID NO: 25037 - DNA, 453 bp, Zea mays
  Clone ID: cC-zmle189033g01d1
atggagcctaagggtggcacaacgtctagcaacacgccatctatgacgcatgaagctgcccttgtctacagcattgaggacattcgacccgtcaggggcctgaagaagatccagcctgctacttactccaactgcacgaagaatccatgctgatgtcgcttgtggcgtcctcattctagtagtacaggatttcttttctgacactcagattctgaccaatcactctggcctgctgcttcctgatgatagaccagcatacccattcttgctcattgcactacttcctccatctacagcattgggttctgatccacctgctccaatggctgctcttactgctgctgatgcttccccgggctcagatatcgatggtgagggctatgagaatcgccttgagatcacattttgtgatgcacctgtctttgctgaccctcatgggcgtgggttgcgtgc

SEQ ID NO: 25038 - DNA, 526 bp, Zea mays
  Clone ID: cC-zmle189033g02a1
ttttcacagatatttctccatacgttcatgctcattggggtagacgcagctgaccacctagagctgcatacttacttattcagactgatccagcatgtggcaacatcggaagttcacatgcttacagacgacaaattttcataacaatagcctggcttggctgcttcacagaataaccaaacgacaaccacgaaattgcgacgatataaaataaacaactcagaagcaaatcgaccccagaagcccgtcttactcatcaagcactcccgccttctcctccatggcatccgcttcctcctcccagcagagaagattagccagcttgtagtccttcttcataggaggaggagcactcttcacgttctcgccgtcaaagcagtggaaaacagatttgggcgaggtagcaacagcggttttcagcagcacagaagctttggtacacgaggagcccgcctccaggcagctactgcttcaccatgtttgttgcagtcatagacctctgcaccaagtgcctttccccatgtcc

SEQ ID NO: 25039 - DNA, 416 bp, Zea mays
  Clone ID: cC-zmle189033g02d1
ctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctcccttgcccaaatctgttttccactgctttgacg

SEQ ID NO: 25040 - DNA, 324 bp, Zea mays
  Clone ID: cC-zmle189033g03a1
ttcttttttatttcttcttattctctcttattttttgggttagggtttttcttttttttttaattttctctcttttttcaattttttcgttccctcttacctcctatccacatcccaactaccaaacataatccccaacgacaccggggggcgaccccggaaacacaccccccggccccgggggggcccccacaacctcccataaggggaagaaaaaaaacccggcccaaaagggggggcaaccccccccaccgaaaaaaataatatccccccacacacccccccaaaaaacccccgccaaaaaaaaaaggggcaccccggggc

SEQ ID NO: 25041 - DNA, 353 bp, Zea mays
  Clone ID: cC-zmle189033g03d1
aaaaaaaatataataatatattaaaacaaaaaagaaaaaataaatttgaccaaaactaaaaaatacatctgcaagtgggagaggaaagaccaaccaaaaactatgcaacacaacaagctgctgcgtatcgccatacacaaattaattaggggggggcccttaccttgaccccctgatctgtccgcctgatcccatgtgttggagcatttatcgggcggatcggatctgatcacgcgggggccgttttcttacgggagccgttgggaatgcccctagatttcccggcttgtgtcctagccgattaatccccttttcatgacgagcaccattgtaggcgagagccggaaccccgg

SEQ ID NO: 25042 - DNA, 455 bp, Zea mays
  Clone ID: cC-zmle189033g04a1
tttttcattggtgatcgattcttttattcacatagcagtcctttctagctgactgaaagcaccaagttcacttctcctggccactcagtgttttgtgttttgatatcatcgtgcatatgccagttggtcttccgtgatttcccgccgattctcaagaaatatgtgtcgataacatgtatacggtaagggtatttgtgtccgttcaatatgtagagcctacagtatagaccagtatagttacaagcgcatcccctgcgcacatgttatacagaaatttgctggtatatcgctgggtgtctccaagtctatgcttgtttacgtccagcgtcaaggtgtcgtggaaaagttcatgatcgcaggaagggtcgtttgtttagaagagcttcgagacgtattctacgagatgaggtgagaaataaagcacaacagcgctggctgctgtccacttgatatcg

SEQ ID NO: 25043 - DNA, 551 bp, Zea mays
  unsure at all n locations
  Clone ID: cC-zmle189033g04d1
cccacgcgtccgcaccactacaacccttcttgtgattcaccgcacagatcatacaagacataacgaaaatgtttggagcaccaccccaaccatccaagcaggagcttgctgcggccgaagcacagactatgaccgatatcaagtggacagcagccagcgctgttgtgctttatttctcacctcatctcgtcgaatacgtctcgaagctcttctaagcaacgacccttcctgcgatcatgaacttttccacgacaccttgacgctggacgtaaacaagcatagacttggagacacccagcgatataccagcaaatttctgtataacatgtgcgcaggggatgcgcttgtaactatactggtctatactgtaggctctacatattgaacggacacaaatacccttaccgtatacatgttatcgacacatatttcttgagaatcggcgggaaatcacggaagaccaactggcatatgcacgatgatatcaaaacacaaaacactgagtggccaggagaagtgaactnggtgccttcagtcagctagaaaggact

SEQ ID NO: 25044 - DNA, 428 bp, Zea mays
  Clone ID: cC-zmle189033g05a1
ccaacaaaacccctgtctcctttttttttttgacaaaaaaaaggggttttcaataaaaccccgacccccccttttcgcccccccccccgggggggggccccccccaaataaaagggcattgcctttcccccccctcccttttttcccttagttcccacaaatgtcaagccccccctggctccccccccgaacatttttcttctatgctcccctgggggggccgcccccccctggtccccccccccaaaaaaaaaaaaaagttcctttgggccacaaaaccaaacaagggggggttgggggggaccccccctccaccggccaagataaaaaaacctctctttttgggggaaaacgccctcaaaaaagggggcccccccccgttccccccaggggtccaaaaaggttctttgtgggcccccccccctttt

SEQ ID NO: 25045 - DNA, 339 bp, Zea mays
  Clone ID: cC-zmle189033g06a1
cggaacgcttggggtgacccacaaatttcctaccggttcctgcgggctaacaatggtgttccacatggagactaacaaaagctgggcgaaaacaggatcctagctgaatccggggagaaattggaaccggttcccaaaaccacaaaaaaagggggcccgaagaaaaaagggaaaacccaggggtgcccaaaaagtgaatcaactcacataaactgggtagcccctactgcccgcttaaaaaagtggaaaacctcgcgcgccaggtgaattaaaaaaccccccaaccgccggggagaggcttcttgccacctgggaccaagggaagtttttatttccccc

SEQ ID NO: 25046 - DNA, 63 bp, Zea mays
  Clone ID: cC-zmle189033g06d1
gataaaaaagtctgtacaacaacaaatacctaaaatatccaattagcgcaccattggtacggc

SEQ ID NO: 25047 - DNA, 445 bp, Zea mays
  Clone ID: cC-zmle189033g07a1
tttttagacgaacgttgcaattacttaacagggaggtggatattagcagcaaataaagctccatcataataggttcacaaaacgactgactgatttgtcttagcacaaaactctggatatagctagaaaccacgatagatggcctactgaagtgcaggtttccaagacgagccattggacccatggcaaacggtgacgacgaactaggatgtgacatctctccatgaactcacgcatcgaagaaacgtaacacaactatgccgacaccaccatccacaatccccatcagcctacttggatctctgcctcatctttcggcgcttcctcttcagcctcctcatgcgcttcttcttccacttggccctcatagtcgcctccttgcgggcactccttggcgcgtcttctgctgctgcgtcggcggcgggttcacgcggacgcgtgggtt

SEQ ID NO: 25048 - DNA, 431 bp, Zea mays
  Clone ID: cC-zmle189033g07d1
cgtgaacccgccgccgacgcagcagcaggagacgcgccaaggagtgcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctgttaagtaattgcaacgttcgtctaaaaa

SEQ ID NO: 25049 - DNA, 351 bp, Zea mays
  Clone ID: cC-zmle189033g08a1
aaaaaagggggggtcccgttttaaaatttgaaacctgggccctaacctttaatttacccaaaattttttctttaaaaaaaaaaccggggaaccccctgcctaaaccttggcccgggcggagccacccccccccccgttttgccccggcccccccaaagggagggggggggggccaccaggggaaattttaaaccccctgatcaacccccccccactttttcccctttggggggggggggggcccccccccccccccccggggcgtcgccccttttgcccaaataacaactttttttaacctttttttttgggcggccccgggggccccccccgtaattccggcccggtccc

SEQ ID NO: 25050 - DNA, 424 bp, Zea mays
  Clone ID: cC-zmle189033g08d1
cacgaaatgaaaggttagagatagttgttagttgtgcaaaaggttcgattgccttggttgttgttgttgggccaccgcttccgcctatggtgcaagagttgggggcgcttgatcaggtcgtctgacattctccttgttgacccaaccccattccgattggggcgacctggtcaaacgcgggggcgtgctagctacgctcagtacaagtattcagcatggaatctccagtattttattctagagaacatatcttgtgtatattgaagtttagtgcacatgttacatatattaaatcagtatcactcattttaaaaaaaaaaaaacttataaaacaataaaaaataaaattaatacgataattattattattatctaatactttttatagactaaacaaaaacatgggggggccgctttaaaggat

SEQ ID NO: 25051 - DNA, 483 bp, Zea mays
  Clone ID: cC-zmle189033g10a1
atcctcttgtttggggttttttttttttttttattattttttttttcttttggggcgacattaatcaactccaaccttccaactaaaacatttcactgggggggcagggccccaggtttttttttttaaaaaaagggcaaaagaaaacggggaaaaattctgaccctatacgggataaaaaaaaaaaaagtaaaggccaaaaagggcttttttacttgccccccgaaacggggaaaaaaacaccctttggtggaaaaaaaaggggataagtttgttttttttggacaaccaaaaccttttgtggccccccgccaaggggattgggttttttggggggaaaaaaacaaaaaaaccccgggggaaaaaggtttaaaccgcacccttgggagttttttaccaaactttccccctttcttaaaatttagccccccaagggccccccttttggaaaattatcccccccaaaaaagatattcttagggt

SEQ ID NO: 25052 - DNA, 536 bp, Zea mays
  Clone ID: cC-zmle189033g10d1
cgggtcgactccacgcgtccgcaccttgcctgtatttcaagaaatagtaaaagggatggaagaaaagggtgatatgtctaattaccttgctgggtgctgctgctgcctgtaaagccattccattggtagaggagtgccgaagtcaagtcagggtgcacaggtggatgaatgaactgttgaacctttttgtttgtgccattctctattaatatgggctgtatcccatgtaataagacaagtaactcttacatgaaacttatgttctgccatggagtctccaagtaggttagttgctcctggtgtcataatctacaaataaccccatgagaatatctttgtttgccctgttcaccacgtatttcaagattcaactgaaaaatcatacatcctatagtgtgcaaaagagcatgaatacagggcgcatgacaaaaaaagtatattctgcttgtgaatttcattaaatagactgtgaaccaggtattatcagcctgcaaagaacagacacatgagcaacatgtttgagttctgacaacctg

SEQ ID NO: 25053 - DNA, 296 bp, Zea mays
  Clone ID: cC-zmle189033g11a1
aactcaaacataatttactgggtttgtttatattttaacgatgaatactactcaacttcataaaagggattacatttctggaactgtatgaagttcacattattaactgaatttttcacccataacagcatacggacgcaccctttttatcttgttcctctaccctaaaacgctccttgctgcaataaaaaaaagagttattcgaacatagttcatgccagaagatccggcaggagttgcctttttccagcacctggcttaacacaaagaggatggaagagatgcttgtatggaac

SEQ ID NO: 25054 - DNA, 552 bp, Zea mays
  unsure at all n locations
  Clone ID: cC-zmle189033g11d1
agggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgttgagaggccaatcagagatgcgatggagcctggagtttatcctgatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgcttcacgtggcttcgacaacgcactggagtttctatcaacatgcaagattgcaaatctgactattagagcagaactcggatgctgcttgctgcatcgaggcggtagaatgaccatnncagagtgtctgctgcagtgcgagcaaaacccttt

SEQ ID NO: 25055 - DNA, 424 bp, Zea mays
  Clone ID: cC-zmle189033g12a1
ggattgctatagatttaaactccttcaattctctccgatcaatgggaattaagataaaacaaaccggcccttgaatggttgcgattgcatttttggttacaagcggccaaaacatatttgggggccacggttcagaccggtgcaagacaaaatcaactatatcccatgctgaatacaacacctttctagaacaaaccacactgaaaaaatagtggggggctgggcagtattcatctggtagttgccgtagcctacatggttgcatccaaaaagtagggccacctgcatcaaatcatttttgcacggccaaggaagccgatagtcggcagaaaagatgaacaaaaaaatggacactgcgccaaacaaaatattgcgggagaaatactaaacaaactgaactggtaaacggaagaaagaaaagagc

SEQ ID NO: 25056 - DNA, 596 bp, Zea mays
  Clone ID: cC-zmle189033g12d1
agctgtgtcagcaagcaggccctcatctgctactcacttcatgggcatgcaccaaagccttggtattcagctggcgcagcttgggaaggatgcatctgcagcagcagctgcacgtagagttagtggtcaacgaaaggcggtcgaggttgagtctgttgcaactgctggtaaacaagagactcgagaagtagtgaagaagttattccgtgctgaggtgatacactttctagccaatttgacacagcaattaatcacattgttggttgtgcaaatcgcttctttgactcgaactgttttactgctgtttatatttatgaatctagaaagaattcttggaactgttttcttctcaaaatgcagtttgtcgagaggcaacatcaaggtttagatgaggataccgatttgagagctttggagaatggatttgtgagctctcatttctctctctctctctgtccctcctttcaaatggctaagtattcaccccactctacaacctacaggtatcggtcacccctctgaatgttcatgggcaagtggagcctgaaatccaagcctcagcttcagattggctctcagcagctgtatcactagag

SEQ ID NO: 25057 - DNA, 429 bp, Zea mays
  Clone ID: cC-zmle189033h01a1
gggttcgggttctttttttaaaacaacaaaggctggtgcaacaaatttttggcggcggaccatttttggttttcttccgcgcccatgtttcaatatatcacggctaagggtacgggtccgggcagtaaataagctacactaaggggggcttgcccctttctcccctgccttataaaacaaaagggggggaaaactttgccgtattttggcccaaatgcattcattcggaggggttttcaaacccccaaaaaatcttttctttgtttcggaacgggtttcggccccctgggtatccccggaaattccgggccgggccctgcaggggtaccactttttccttatgggagccttattaaaaacttggggaaatcaggggtacagctggtagcggtgtaaaaattgttatccctgtacaatttccccacaaaa

SEQ ID NO: 25058 - DNA, 304 bp, Zea mays
  Clone ID: cC-zmle189033h01d1
aaactcgttccgatacatagtaaagttctcttggtgattcgaaactcattcggatgtatgcatgtggtacagaatacggcatagttctccctccgttttgtgtcatatggcaggggagataggcgcatgcttccattagttttgctaatttactgcctagatccttatccttaaccgtgatattctgatacatgtgcatgtaagaaacacgagattgtccggcagcaagaaactgttgcagcagcatttgttgtttaaaaaaaaaaaaaagaatatgaaataaataaataaaaaacaaaaataa

SEQ ID NO: 25059 - DNA, 424 bp, Zea mays
  Clone ID: cC-zmle189033h02d1
cggacgcgtgggaaaaaaaaaaaaaaaaaaaaaaaaaaaaaaaaaaaaaaaaaaaaaaaaaaaaaaaaaaaaaagggagaaagaaaaaaaaaaaaaaaaaaaaaaaaaaaaaataaaaaaaaaaaaaaaaaaaaaaaaaaaaaaaaaggggggggccgttttaagggaccaaagtttacttcccctgccttggaagaaataacttttttttttggggccccaaaattaaattaccgggcccctttttaaaaacgtaggaatgggaaaaaccttgggtgtaccaaatttaatccctttagagaaaatcccctttttccaagtggggtaaataaaaaaaaggccccccccaatctcctttccaaaaatatgcccaccctaattggtaattggaccccccctttaagggggattttaagccgggggg

SEQ ID NO: 25060 - DNA, 477 bp, Zea mays
  Clone ID: cC-zmle189033h03a1
ttttataccaaagaatgacaacgttattttttctgcgcgttacatcttgtgtgcaaaaattcaacacatactgctcaagtgcaaatctcagcaggaggaagacaatgaaaaaaatggtatttctaacatctaccatgtattgtatgaatggaagaagaaactgctaatacgtgctattgtacaattatgagatgggtctcggtattgagaagcggtgtcacaagatgctgcccatcaaccataggtgcacagccagccagtacaacataagccctagccttgctcgtggccggttcatcagaatttggctccccgagacccagaaggcatcgaccctatcagcgatgtgctttccctgagctggaatgaagccagatgtatggagcgattttatacgccccttgtcatctgaatcttgtgcagcaatcaatcgttctgactctgaaccaattgttgacaaccaagatgatcccgctg

SEQ ID NO: 25061 - DNA, 487 bp, Zea mays
  Clone ID: cC-zmle189033h03d1
gaagatttacagttaaatattgaatcctatacccgtgaaattgaacagctaagagaggtctccagaaatagtgagtctaactaatagggagttggaatccaaaggaagtgagcttcttgaggtagctgttagtatggagcgaatgattcagcgggtaggatatcttggaggaaaagatgtgctagaagataacaaacctgctagcacacaagctctcttatcgaagctggaaaagctaataatagcttcaagtactgaatctgggaattctaaatccataatacaggagctgggagcaaagctgcagtcaagggaaaaggcagttgatgagctatcaacaaaagtaaagatgctcgaggatttgtgccatgcacaactttctgagccagaacctagtcaagacagatcatttgaagcatcttcctcaacaattgggacagatatgtctgatattgaagatgcgggaccagcgggcaagacaacatca

SEQ ID NO: 25062 - DNA, 365 bp, Zea mays
  unsure at all n locations
  Clone ID: cC-zmle189033h04d1
ggcaattgtgccgtaggtcccagactaccactacggcacatgtagacacaagaagaagttggtggtctatgttctaagtaaccagtgtttacttgctgatgctgaatttctgtgtgatggcgtgtgcttgttgccacttgccagtgttgtgtcaattatgtatgaaaaggttctagataaatttgaagtgcaaactgtgtgtgccaaccaaggtgttcttgtaaccaagttcagacagttcagcaaaacaaatactgatgattgctgctgttcattgntnaaaaaaaaaaaaaaaaaaaaaaaaaaaaaaaaaaaaaaaaaaaaaaaaaggaaaacaatataaaagaatacaatttgggcggccg

SEQ ID NO: 25063 - DNA, 481 bp, Zea mays
  Clone ID: cC-zmle189033h05a1
acatcaaacatcacacgtggggactagtatccttcatttagatttacatcaaaattctagatctcaacacacgatgcgacaactttataattatacaaacaaccttatcactatctgcgggtagacatttcacagtatctaatatgacacctaatataactatactcatcacgaatgaaattgaggaagaatatgtttcccagtacattgccataagaagcacacaaacacatccggagacagctaccacagtgcacctatgctaatcacaaaaaatcatcgaccacataactatttagcccaccattcatagacgtacattttcacacacatattcacgccatcgaccacacgtaattagagaaaactacaatcacataaagcgaacaacctggtgaaatcagtttggatcgcgcatgcatgtctaccacggttctggcttttcgtcgaggagcaatgcacgaagcgcaacattgacgga

SEQ ID NO: 25064 - DNA, 344 bp, Zea mays
  Clone ID: cC-zmle189033h05d1
gctcaccctcagccatggagggtgccgcctccacctcccccttggtgctcgccgagctcgccctcagccttgccgcgcccctgcttcctgttcccagtgccgacgcccctgcctttttccccatctccttcccttgacgtgctcgcccaggtcgcgcgcgtccagctcgccggccgaactccctcagcttcgtcttcaaccaccggcgaccccatggtgagctcgcacaaactccatctccctgtgcgccctttgttctgctccaaccgttctccacgccgtgttccccccccatggctccccttgcctctccggtcagcactagcccgaacggataacagcat

SEQ ID NO: 25065 - DNA, 425 bp, Zea mays
  Clone ID: cC-zmle189033h06a1
acatcaaacatcacacttgctgactagtatccttcatttagatttacatcaaaattctagatctcaacacacgatgcgacaactttataattatacaaacaaccttatcactatctgcgggtagacatttcacagtatctaatatgacacctaatataactatactcatcacgaatgaaattgaggaagaatatgtttcccagtacattgccataagaagcacacaaacacatccggagacagctaccacagtgcacctatgctaatcacaaaaaatcatcgaccacataactatttagcccaccattcatagacgtacattttcacacacatattcacgccatcgaccacacgttattagagaaaactacaatcacataaagcgaacaacctggtgaaatcagtttggatcgcgcatgcatgtc

SEQ ID NO: 25066 - DNA, 466 bp, Zea mays
  Clone ID: cC-zmle189033h06d1
gctcaccctcaggcatggagggtgccgcctccacctcccccttggtgctcgccgagctcgccctcaggcttgccgcgcccctgcttcctgttcccagtgccgacgcccctgcctttttccccatctccttgccttgacgtgctcgcccaggtcgggcgcgtccagctcgccggccgaactccctcagcttcgtgttgaaccaccgccgaccccatggtgagctcgcacaaactccatctccctgtgcgccctttgttctgctgcaaccgttctgcacgccgtgttccccccccatggctccccttgcctctccggtcagcactagcccgaacggtatagcagcataccggtgcccaacccgtgttcgcgacgctcgccaagtgctcgatgaaataccgcagtgagctccacctcgagttgtgcagccccaacccgcgacgttgcaacacccttgccctccgtcgat

SEQ ID NO: 25067 - DNA, 68 bp, Zea mays
  Clone ID: cC-zmle189033h08a1
tttttgggaggaacagaggtttgttatttgccaacagattacacacatgattggcacggacgcgtggg

SEQ ID NO: 25068 - DNA, 68 bp, Zea mays; identical to SEQ ID NO: 24979
  Clone ID: cC-zmle189033h08d1

SEQ ID NO: 25069 - DNA, 431 bp, Zea mays
  Clone ID: cC-zmle189033h09a1
cggccccaaaggaattttgggctctttacccccctcttttttttaaaaaaatgccttagtggttaaaaaaaaaaatggggcccccacttttatgaccgcctttttttaaaaaaatttttcccccctttttccaagaaaaaagggtttttttttggacaggggccccaatattattcccttgcgggggggcccctttttttttttctccgcataaatggggagggggccccccccctgttggtttttccccgccggaggaaaaaaacttttttttgggccttgttctggaaaaacttttcccaaagaatttctttgggataaaaaaaatttttaatcttttaaaagaaaaaattccggaacctcggtggggggtccctacacctcacaaagggggttttttttgggcagggccccacctcttttttaaaatt

SEQ ID NO: 25070 - DNA, 483 bp, Zea mays
  Clone ID: cC-zmle189033h10d1
gtcgacttacgcgtccgcccacgcgtccggaccaactgctttggcctttggttgggagtatagtcggtctcggtcggcgtcagcccctcccttgcttgccgatccctaccgctccaaacacccgccagggctgagagctcgactccgactcgagatatggccgactggggccccgtggtggtggcggtggtgctgttcgtgctgctctctccgggcctgctgctgcagctgccggccaagggcgccggccgcttcgtcgagttcggcaacttccagaccagcggcgcctccatcttcgtccacgccatcatcttcttcgccctcgccgccgtcttcctcatcgccatcggcgtgcacatcactacgtactagccttggaatcttacttcatcagtctgcctgcacacccttgtgcagatctctagcaagtggtttatatggctgtgggctagctgcctgtactcgtgtgtcgatgcatcaact

SEQ ID NO: 25071 - DNA, 323 bp, Zea mays
  Clone ID: cC-zmle189033h11a1
gtacgaagctgatccttagagcggcgcctttttttttttttttgcgaaaaaacatggattcttctttgctcaggcaagtgtttctatatataaataacacagatcgttgtcgtcttctcccataatatatataccacgggtgttattggcccttagtactctacccacgcactcctccatagatagaaacgagcggaaatacttacacattgaaggcaaatgagagagagagagactaccctgatcttttttccttccgaaagtctgtccttgtttacccttcttatttcaccagcgcggtgaagcattttctcgtgcgcgcc

SEQ ID NO: 25072 - DNA, 73 bp, Zea mays
  Clone ID: cC-zmle189033h11d1
gcgtacgcgatctgacctattcctaaatgcgcgcgtgtcccgtgaggcgttaactctttatctcatggatagg

SEQ ID NO: 25073 - DNA, 296 bp, Zea mays
  Clone ID: cC-zmle189033h12a1
ctagggaacgttattgatcacgtaaactgcatgcacacgtcttaaattccgcgttttctctctggctctctctctaaaaaaaagaggacattgaacatgcttagttattacattgggggggaaaagttccttctttcctgatatatcatatcatatcaggggcgaaagataattttttattctgatacgacgggaatttattacaagcggccggccggcaggggcaaaccctggggtgggggggtctacaggaccaactgtttgcggtaaatgtcaaaccctttccaagaggacag

SEQ ID NO: 25074 - DNA, 458 bp, Zea mays
  Clone ID: cC-zmle189033h12d1
ggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggaactattacccctcaatgtaataactaagcatgttcaatgtcctctttttattagagagagagacagagagaaaacgcggaatttgagacgtgtgcatgcagtttacgtgatcaataaagttacatagaatt

SEQ ID NO: 25075 - DNA, 216 bp, Zea mays
  Clone ID: cC-zmle189034a01a1
aaggggggggattctaagcgaccaaatttgggagaagaataggttgacaaaaagatttttattgggccatagattgttgtgacccaagcctgggcagacaaactaaaacctggttttccaacaaacgaacagccaaacattagattccctcccccccccccagcttaagcatttgttagaggtgtttccctcaagagtccatcgggcgcgtgggtt

SEQ ID NO: 25076 - DNA, 284 bp, Zea mays
  Clone ID: cC-zmle189034a01d1
tgggtcgactccacgcgtccgatggactcttgagggatactgctctagctaatgctttagctgggggggggggagtgattctgatgtttggctgttcgtttggtggatgaccaggttttagtttgtctggccatgcttgggtcgcagcaatctgtggcacgatgaatatcattttgtcaacctattcttctcacatatttggtcgcttagtatttactatttaaaaaaaaaaaaaacaaaaaaaaaaaaaaaaaaaaaaaaaaaaaaaagggcgggccatttat

SEQ ID NO: 25077 - DNA, 471 bp, Zea mays
  Clone ID: cC-zmle189034a02a1
ggtcttggttttttttttttttttttcttttctttttaaaaaaaaaaaaatggatttgggaacccccggaaaacctggataaagtaagttccgggcctcttttccggcaaaattttttggggtccccccttgcaccgggtgggcaaaaaaaaaaactttttgggggaaaatttccctttggcccgaaacaataaaaaatttttttgggcccttaaggcccttggggccaaacttttgttccagagggaaccctgtgtaggggggggacccacccccccgtgggggaaaattaaaaaaacgggggggggggggccgcctttggatataccaacaaaattcccttttggcggggggggcctcttttttgccaaaaaaaaaccccaggcttggttttcgcccccatgggaatcttaaaacacccccccccacactcgggagggggacccggttaaaaacccgggggggggccat

SEQ ID NO: 25078 - DNA, 563 bp, Zea mays
  unsure at all n locations
  Clone ID: cC-zmle189034a02d1
cccccgggtcgactccacgcgtccgagaaaaagtaacagaatcatctctggcttttacgcatcctagtacccagcaacagatgcttatgtggaaatcacctccaaagactgtcttacttttgaagaaattaggagatgagctcatggaagaagctaaagaggttgcttcatttctgcatcatcaagaaaagatgaatgttcttgtggaacctgatgttcatgatacatttgctagaattccaggttatggttttgtgcaaaccttctatactcaagataccagtgaccttcatgagcgaattgattttgttacatgcttgggtggtgatggactcattttgcatgcatcaaacttatttagaacttctgtaccacctgttgtctccttcaatctcggatctcttgggttcttaacttcacataatttcgaaggtttcagacaagatttgagagatttaatccatgggaacaacacactnggaatttatataactcttagaatgcgtctaagatgtgagatctttcgcaaaggaaaatcaatgcctggtaaagtgttngatgtg

SEQ ID NO: 25079 - DNA, 384 bp, Zea mays
  Clone ID: cC-zmle189034a03a1
cggggtcaaacatcagtggggtattataattataaagagatcacaacagacacgaggcagccgtccgagttcaccaaacgcacgctagggtgataccaacactgacatacaagaacgaacacgggtttttttgctagtgtacaggcgcttctactttctctcctacttcgaaccaaaagaaaacagagctgcgggaatagatggcccgcacatggcgcagcgcgagggtgccgttcgtcctgacggcccttgcgcctccttcgatcctggggcggacgaccggtactccgtgcccttgcttcttgagggatgagaatggatcgtactctatcgctgtgctgattattgggaaggacaggtggcccaaagggttttgcttgcact

SEQ ID NO: 25080 - DNA, 511 bp, Zea mays
  Clone ID: cC-zmle189034a03d1
gactagttctcggacgcgtgggcggacgcgtgggcggacgcgtgggcggacgcgtgggctgaccgacacagcagctccgctcgtcgatcagctctcggctgaccactcaccgccagtgggtgcctgccgaccaggtctcgccaccgccgccgccgccgcggtagagaggggagggagagggagagggagaaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgtcgtccgtggaccacgctgccgccgccgccgcgaggaggcgccggaagaggagggccaacagagccgcccagctgctgggggctgctgcgggtgcgccgcagcagtggcgcccctcgctcggcgacatctgcgaggagtacagcagc

SEQ ID NO: 25081 - DNA, 372 bp, Zea mays
  Clone ID: cC-zmle189034a04a1
aaaaagaagtccggttttagggtatatatagtatcaaatcatatcatcggggaccaattaatatatggttacagcagatgcaatcggatcaaccaacatgcaggtagacacacgtacgtacatgagcacaaagactgacgccaaacatgcagagagagatagcaaactgaagaactctgtttctttttttctcacacacaccacacaatacctatgtatggcagccagctcggcctcgcttattattggtcaaccaccaccacaagctagatagataataatcatatccatggtcgtcgatcgatgtgaacagcagttgcaggggtcgcacttgcagttgccaccgcagctgcagccgtgggcggtcttgtc

SEQ ID NO: 25082 - DNA, 504 bp, Zea mays
  Clone ID: cC-zmle189034a04d1
catgccatgtggtgtccagataacaagattggagcacataaatgccctgtctagcaacgtggagtatctggcgtcaagggatgcaacaatcatgggaagcaggaacggccatgctcccatcttcctctggtacaccctcaacaggaagggctacagaggctttcagaaagaagtccagaagtgcttgagaaacgcacactacctaaaagatcgcctcaaggaagcaggaatcggagcgatgcttaacgagctcagtagcacagttgtgtttgaaaggccaaaggatgaagtatttgtccgaaggtggcagctcgcttgtgaagggaatatatgccacgttgtggtgatgcccagtgtcaacattgacaagctagactatttcctgaacgaattagtggagaaacgggcgacttggtaccaggatggaataagtcaacccccctgcattgccagagtcgtaggctttgagaactgtctctgtggccgtcataagtagtgtgagcc

SEQ ID NO: 25083 - DNA, 225 bp, Zea mays
  Clone ID: cC-zmle189034a05a1
attcaatactttatacaccaggcagggtgtatatttttgagatactgcccccccaaaccaagggtttaataaaaaacacccccgactttgcagttatacatgtatctaagtggttatccatcgacaacatacttaatctaggagactaggcaaaccttaaaccgtacttgcctacccgcaggcaacacgactaggttcgcaatgagtgtccttcaacaatacggc

SEQ ID NO: 25084 - DNA, 545 bp, Zea mays
  Clone ID: cC-zmle189034a05d1
agcgccagtgcctcgcacgggaaatcgtcaacatcttagcttgtgaaggccctgaccgtgtggaaaggtatgaagtggctgggaaatggagagctaggatggcaatggcgggctttgtgccgtccccatttaacagcggcgcggttgatggcataagatctctactgaaatcgtactgcgataagtacaggttcgagaaggtccaggacggcctccactttggctggggcgacaagacgctcgtcttctcttcggcgtggcaatagaagcttgcttgtagtattgccgatctgagcactttccagcgttttaggagcatctggtgcaagggctgtaaagagatttctgtcgccgtattgttgaagtacactcgtagctaaccttagcgtgttgcctgcctgtaggcttgtgaggtctacggtttacctagtttcttagatgaagtatgttgtgcattgtacacctactgaactacatgtagactgtagagtcgcgggtgtatctaattctgcccttcttttggaggggcagaatcacaatatgtc

SEQ ID NO: 25085 - DNA, 213 bp, Zea mays
  Clone ID: cC-zmle189034a06a1
ttttttttttttttttttatttttttttttttggattgggttattttattttattcttttttacattttttttactgaaaaatataaaacacatcagtaattgatcatttaaaaaaaaacaacaaattcttacatcttttctccacacagaaaaaaacaccacaattaataaacttcaccgaaaaaaaaaaaacacaaaataaatagaagaat

SEQ ID NO: 25086 - DNA, 467 bp, Zea mays
  Clone ID: cC-zmle189034a06d1
gaggaagctaaggtagctgcagagcaaaggacttggagaaaacaagccatcaagtactggccgaaacggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagact

SEQ ID NO: 25087 - DNA, 466 bp, Zea mays
  Clone ID: cC-zmle189034a07a1
cagggccaagttgccttgattcggtatggggtataatggaaagaaaggcactgctgattgtttcaacatgaacagaaggtaatattattccttggtcacgattacagttcgttcgtgttaagtttgtactacggttctctggatgagctgttgagaaaatggtgtatcatccacaaccacaatcaagcaggtggagatcacttccttaggctttcgatgacgtatgagccatacaggtccatcgagtacttgattgcgttgatggcatctttcgctggcaggaactcattcactgcgacctccttgttttcgttctttttataatcttcaaaaaagcggtggatctcttgaaggcgatgcggtgggaggccccttatgtccgtgttgagacggaattcagggtcatcagcccagactgctataatcttatcatctttctcgccctgatcgatcataggcttgagcc

SEQ ID NO: 25088 - DNA, 525 bp, Zea mays
  Clone ID: cC-zmle189034a08a1
tttttgcatgtgcgtggtttaatttgaagaaagagaaacaccgggtacaatttcctcgcaaacgtagacacctacgatacagagaacaaacagcagcctccatgcacaagactgatgcaagaggcttcatagttgctgcttcccacagggttttctatgtcaagtcggctggttcctccctttctgcattcctcgcccacctcctgacacccatctcatggttccgccaccaccttggacgccgatgtgtctggttcctcacgcttatccactggaggtaactgcttatcttggagacgcattatcgtcgatattagcactctatcaccaactacatgcctcagcttcttcactagttcacctcggcttattttcttgctcttaaactcttcatagcaaccaataatcacgttcatattctcaggagacactttggtagagatcgctgcaaacagcatggagaaaggcatccaaggtgagcttggggccttttccatcgaatctcctagcatgggggctgcacat

SEQ ID NO: 25089 - DNA, 288 bp, Zea mays
  Clone ID: cC-zmle189034a09a1
ctaatgaaaaggggcggggacaatttgaattgcagacttttgacacctactataccaagatcaaacctgcaggtctgctttctaattcactgatgacatgatgtttcataagtctgctgctatccacagggttattctatgacaagtctcgctgggaacttccttaaagtatttcttgaccaactcctgatacccatttgatggttccggccccccttcctaacgccgatgtgtgatggcaactcttgcatattcaccggaggtaactgcttatattggatacgcctt

SEQ ID NO: 25090 - DNA, 328 bp, Zea mays
  Clone ID: cC-zmle189034a10a1
aaaacacaaaaattttcccttgcctaaagaccccggggccggaaaaaaatttccctttggggccaaaccggaccccgggcccccccccctcttccccaaccccaaaaaatcccctaggggggccccggggggggggccccccccccccctaatttgccgggcaaaaaattgggggcaaaccccccccccttttttttgcccgggcccacaagggggcccggaagttttttgagggggccccttccgggaaccaaggccctgaaaaaaacccccaacatggaaaacctggggggggggcccttttttaaccccccccccctgagccccc

SEQ ID NO: 25091 - DNA, 440 bp, Zea mays
  Clone ID: cC-zmle189034a11a1
gtgttggaaaaaattcttggacatggatcatttcatgccacacaatacaatcgaatttttaggataagcaacagcccccagtttgtttaaagagacccaacccccccatacgaatgaccctgaagggaaaatatccgggggaaaagcaaaaaaatgctggctaggaaactggttgggaagttgcagcactcgttcaactccccatatgtttttccttcaaagcatttcctgagatttggggacacattgccttacctttttcttgaactcatcccgtttttctctccaatccttggcagcttcgatattcgctggagactcgtcttttggactagagagcatcgaaatgatgctcaaaactatactttcaaccgggtgcactggggtccatcgttcgcttgcaagctcataaccattgggatcttcaccagggggatgaa

SEQ ID NO: 25092 - DNA, 377 bp, Zea mays
  Clone ID: cC-zmle189034b01a1
cgagctaacgaaaatccggttcggccttattggatatcggcgcttggaggaattacacataataattgacatttaaacataacaataggctacggtctaccatacttgacgggatcgaagcaacgggaaagagaagggagatcggaaacaagaacgaacacaggccgatccggccgcgggagtcaaagtgttccatctcatcacgccggcgagaaccttggcccggtcgctaactgcgattcagcgctcaatgacgtctagcttcacccgtgccggcgagctcgagggagggtgcgccatgccaggggacgtacgtgtgccttgatcggcgttcagaagccccaaccaccccttcctgatcacggagcggcggcggc

SEQ ID NO: 25093 - DNA, 518 bp, Zea mays
  Clone ID: cC-zmle189034b01d1
cgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttgcacgcgcacttctacgagtcctgcccctacctgaagttcgcccacttcaccgcgaaccaggccatcctcgaggccttcgccggctgccgccgcgtccacgtcgtcgacttcggcatcaagcaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacaccatccgcgtggacttccagtacccgggcctcgtcgcggccacgctcgccgacctggaggccgttcatgctgcaaccggaggggcgatgaca

SEQ ID NO: 25094 - DNA, 276 bp, Zea mays
  Clone ID: cC-zmle189034b02a1
ctcggggccccaaagaggtaaatttaatattttgggttttttggccccccccttaaatactgggacccaggtggtggattcccacccctgttcggggggtttggccacaaccatattaaccactttttaaaaaattttcccagggggggcccgcccaccgttgaaataaaaatcccagggtttttcctttttgtgttcccccccattggcaaaaaaaaaaacggggggagggcaaaaaaaattttggggggaaaaaaaaaggggccccctttgttt

SEQ ID NO: 25095 - DNA, 478 bp, Zea mays
  Clone ID: cC-zmle189034b03d1
cgccgcacgaaccgacgcactagaccgacccgcgaatcccccgcgcgcgcgccgtgcggtcaccgtccgaggccacggcaccgccggcccccgcccccgccccggccgccaagagcaaaggcaaggccgacgcttcctcctcgtcgtcctcctcctccactccaccgaggtcgcgccgcgcgcttgccgtcgtgatggccgcgtcgctgctcgtgctcgccgtggcgttcttggttggctctggctccggggggatcgatgggggcgcagcggctcccgtcgaggtggagggcaccgaggtggcctacggtagtgtgatcaagctgatgcacgagaagacgaagcaccgtctgcactcgcacgatgtgccctacggctcaggcagcggtcagcagtctgtcaccgggtttcctgaaggcgatgactcaaatagctactgggatcataagggcccactccagattccatcgtctaagca

SEQ ID NO: 25096 - DNA, 442 bp, Zea mays
  Clone ID: cC-zmle189034b04a1
ttttcgtcaaatgataataaaagggaagaaattcaacgtacatatcatcggctacggggtgaccgtatcaacatacaacctatccatgtcccatgaaccccatttgctagacagcaacaaccaaaaattttaccccaaccggatgatacaacaacagcgagatcagccacgcagtcggaagggggatcagttcccctgggcgcccactgcctccgatgctcctgtgactgcccagcagtacctgtaggcagcgtaaacggaggacacgaccaggaccccggggatcatgtaggtgacgatcgtggccacgctgatttggccggggaccttttttaccttgctttgcgcgagcaaggccttcggcttgatcttcgccatgttgcgccgcggtctctgctagtcacaagaacatgatcaaaagaagacgactagaattattttc

SEQ ID NO: 25097 - DNA, 502 bp, Zea mays
  Clone ID: cC-zmle189034b04d1
caccgtccaaaagtgctacatctacctctctggacaagtgaaggagaagctgggcacgattgacccctacttggtcaagctcggtgacgccatggtcacctggatcgaggcctgggatgagctgaacccgtcgacccctgccgccgcaaatggcaaggccaagtagatgtgccatcacttcggcactggagtgaaaaagaaagtatgattgggtcctgcctaggccccatagatatagctcttttttgagaaggaagagagattaattcagcagcagcttttataaattctgtgttgtcatgaagcaggtggttcttttgtagttgatgaaagggatttgtcgtcgctatcgtttacataattcagacaataatttgatattgtgtaactctgagaatcaaagcactgcttgtgttatagcatatctaagaatgagcgaacctcttcgttggaatagagaagctggtaagatatcctgctgaaaaggagcacctgaagacct

SEQ ID NO: 25098 - DNA, 367 bp, Zea mays
  Clone ID: cC-zmle189034b05a1
aatacaacataggccttatttaatcatataaaaaacacactgctacaattaacgttctcggttattacagggacttgaacagcaaataaaggcgaggggaacattattttgaagctaattacgtactcgtatatacgttggccagacaatatttacttgaggaagccctgggccatcttaaacagcccaccggcggcggggcttttcttcccgccgccctgtttattccctcccaccagctgctcggcgcccttcatgacgtcgccgaggccgaacccctccgacgacttgttgccttcctccgcggccggcgcaggcaccgccggcggcttcttggggccctccggcgccggtgacttgggcgccg

SEQ ID NO: 25099 - DNA, 494 bp, Zea mays
  Clone ID: cC-zmle189034b05d1
cccacgcgtccggcgagaaagagatcgatcgtattcgtatccgcggaacaagcagcgaaggatcggagcctatccaatggccgagggcaagagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacctgaaggagttcagcgcgggacacgccaccgagcaggagcagcctgcggcggcagcaggcgacgacgcggcgcccaagtcatcggcgccggaggcgcccaaggagcacgcggcggtgcctgcgccggccgcggaggaaggcagcaagtcgtcggaggggttcggcctcggcgacgtcatgaagggcgccgagcagctggtgg

SEQ ID NO: 25100 - DNA, 442 bp, Zea mays
  Clone ID: cC-zmle189034b06a1
cacttaaatttatgtgaactttcattctttaaaataagagtcatgtacgaacaaaaattgtttgtgacaactcgaaataattgacatgaccttgaaacaatctcatggtctctgcataattttagcattttgaactgtaattgttacaaaatcactcatttacattaaaatgaaatccgtgcttagtgcttacaactcgttgcgactgagagaaatccatagcacagcaggacgagcttcaccaccttatttttagcgaagttccaaaacagtatagcgagatcaatcatgaaaattcagtcaagggggcctgggttcgaccaatccttgctaatatcatcaagggtggtcatcgaaataaacaattttctcccatttctttggtgtaacatgatcagctaggacaacatttggtagaagggttttttaaaatcaagtgact

SEQ ID NO: 25101 - DNA, 520 bp, Zea mays
  Clone ID: cC-zmle189034b06d1
gtcggagaccacatcttccgatacttcccccgctccgcggtgttgttggtcgataacaagaagcttgaggaggccgtcaaggggaagttttctgatgcggtgattcagttacacaccagggattcatcaaaaagttggcgtcaggctggatcagatggaagcagtcagctgattctaaaagaaccttctaccaatgttgtcctagctgatcatgttacaacaaagaaatgggagaaaattgttgatttcgatgaccaccttgatgatattagcaaggattggtcgaacccaggcctccttgactgaattttcatgattgatctcgctatactgttttggaacttcgctagaaatgaggtggtgaagctcgtcctgctgtgctatggatttctctcagtcgcaacgagttgtaagcactaagcacggatttcattttaatgtaaatgagtgattttgtaacaattacagttcaaaatgctaaaattatgcagagaccatgagaatgtttcagggtcatgac

SEQ ID NO: 25102 - DNA, 556 bp, Zea mays
  Clone ID: cC-zmle189034b11a1
attttttatttttatttcttcaaatttcattatgggccaggttaaaataacacaacccaactatccataattcaactcaaattacttatttttttcctagaaaccaaaaaaaaacaccccacctttggcaatttctttttaaaaaaaaaaccatacttcaccaacagccgggaaaaaaaatacaccccccccgggcaacccccaaaaaaaccaaacccccaccccagaggcaacccccccccccaaaaaaaaaacaaaaaaaaaccgggaaaaaaaaaagaaaaaccctacccctgaaaaaaaaatgatcccccccaaaatcccccaaaaaaaaaagcccgaaaaaaaaaaaagaaaaccccgggccccccaaaaaggccccccaccccaaaaaattggtgggcccccccaccccctatacaaaaaaaaaaccccctccccccccccaaaaaaaaaacccccccccccccgaaaaaaagcaatccataaaaaccccccaacttttttcttttctcacaccaaaaaacccaaacacttattcccccccccccccccc

SEQ ID NO: 25103 - DNA, 459 bp, Zea mays
  Clone ID: cC-zmle189034b12a1
aaaggaaaaaaaaatccccggaaaaaaaacccttttcgccctttttaatcccccccccgggggaaaccccccctacccccatggaactgaattaacccggcccccccccttaaaaaaaaaaaacccccctttgaaaaaaagttttaaaaaaaaaaagggggggggcgggcccccttttttaaaaaagggaaggggggtggtttttttctccccccccccctggaaaaaccccccccccctggggttccccccaaaaattttaaaaaaaaaggggggaaaaaaaccccctggaccccctttccccttaaaaaaaaacccccccccccttttttaaacccttggggggaaaggaaaaaccctgggggagaaacacaaggagatcgcccccccaggggggaggggcccccccccccagggggaaaaaaggggggggcgcccccccacccctggtcccccccg

SEQ ID NO: 25104 - DNA, 371 bp, Zea mays
  Clone ID: cC-zmle189034c01a1
aggaccggggggccgccgggggggaccaccgggtaaacccgggaattccggagcgggcccaccaggcttaccaaaaaggccttaaatgaaacctcgaaaaaaccggggaaaaaatggacaacggggaaaaatggggaaaaaatatcaacccccaaaaaatcaccaaccaaaaaaaaagggggaaaaaggggggacgcctgagggggcaaacaaaaaaaaaaaattgggtggggcgtgtgggcctatctgaccggaaaaaaatggggaaacccggtggaataaataaacaaaaaactcgccaaaaaggggggggaaaagtaattggcccaaggggcccctttttttcaacaatgtaaaccgaaaaaaaggga

SEQ ID NO: 25105 - DNA, 326 bp, Zea mays
  Clone ID: cC-zmle189034c01d1
ccggaatctccgggtcgactccacgcgtccgcccacgcgtccgaaaaaaaaaaaaaaaaaaaaaaaaaaaaaaaaaaaaaaaaaaaaaaaaaaaaaaaaaaaaagggggcggagggggtggaggatctaatgtttccaacgtttggttgcgaggtatgagatcttttatgttgtctctagagttcactaaattggctcgactgtcccacggtttacaatggaaaaactgggaaatccccgatcttacccactttgaagaccttgccctttattccccgtttgggtatttgggaagaaggaaaaaggcccgtcctaccaacttttcc

SEQ ID NO: 25106 - DNA, 383 bp, Zea mays
  Clone ID: cC-zmle189034c02a1
ttatttttttttttttttttttttacatctatcttttggttttgggttggggacatctaaccactttttttatacaaaagccccccccaaaaagctaaatgggacaccagggtattatttatgggtcggaaccatcgtcccatcacccattttggacaacggcggtaccttaccatacccccctttttaacgggcccccggagtacccctttcttttatttagtttaggtgggagggggtaccaaatccgaggtcccccccggaaaaaaaaagttttggggcggggccaaaaaaacaaaaaaaatgggccctttgcaagggttcgggctcttggggccaacaaaaacaaacttggaaatccttcggggggggtgggggggggg

SEQ ID NO: 25107 - DNA, 425 bp, Zea mays
  Clone ID: cC-zmle189034c02d1
ggagccaagtcttcagctagctgctgctgtccttgcacaagcaaaactcccaatgtcagagattcaggaaaccatcaacgagttccggaatcgtcatctgtcagagcttacagagttgtgtgctacgtcaggaagttctcttggctatggattttccagagctacgtccaaatcaaagtctttcacctccgacgacgaaaaccaaacagtggatggcacactagcaatctgatgctgatgagataaaatgggacccccttgctagcgctagattggttgcactgttcagtagataatcctgtttcatgtggaaggagggtggaataattattcatataagagctgtcataaaagttggcgtccaattttgtatgttagacacttagtgcttgtttgagagtaatggaggggactgagaggcccaa

SEQ ID NO: 25108 - DNA, 297 bp, Zea mays
  Clone ID: cC-zmle189034c04a1
aaaaaaaaaaaattttttttttggcgaatgaaccctggggggggaaggtattttaattgggggaaaaaagggaaccgggggggccttacgggcttcccaaaacttaaatttcccctgggggggccggggggggggggccccccccccccctttattggggggaaaaaagtggggggaataagccccttccttttttttaaccgggtccggaagggggtgtctaagttttttaggcggcccctttctggggaaattggccttgaaaaaaaaccccaaattggaaaaacgggggggggg

SEQ ID NO: 25109 - DNA, 537 bp, Zea mays
  unsure at all n locations
  Clone ID: cC-zmle189034c04d1
gtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatnctcgccatctgggc

SEQ ID NO: 25110 - DNA, 242 bp, Zea mays
  Clone ID: cC-zmle189034c05a1
agggctcgccgcgtgtcagtttcggccgcagccttctccttgatggacgtggacgagggcgacgccgacgcccgcacggccgtcgtcgttattctcgccgccctcggctgcaggggccggagcgacgacacgccgagcggctttctgagcccgggcaccgacagcggcgccccgacggctgatagagacgcggtggcggtcatggcgacacggtaacgcccacgcgttcgcccacgcgtccg

SEQ ID NO: 25111 - DNA, 308 bp, Zea mays
  Clone ID: cC-zmle189034c06d1
cccacctgtacatgcagtggatagttagaggtttgtaatctttagcgagaatatacatgaacgggactggatggacgaattgggaagtgcagtgtctctgggatatgtacacgaagaagcatcctgatatgaacgaggaacagggaaacgctgcgggctatgaggccgactgacgtaggttatcgctcgctacgtgtgcaacgacgctatagggtaacttggaggcaaagtacactacgaaggttgctctacatcaggagcagcgaactctacgaacggacgcaacggggcaggactactgagaaaaa

SEQ ID NO: 25112 - DNA, 65 bp, Zea mays
  Clone ID: cC-zmle189034c10a1
ccaaattacaaggggaggggacaatttaaacttcaaaacttttgacactaaccatacacaacaca

SEQ ID NO: 25113 - DNA, 491 bp, Zea mays
  Clone ID: cC-zmle189034c11a1
aaaaaaataagggcgaaatcataattgaaagtccctaaaaaactttggcgaaaactacattaatattgctcgacaatacaaacaatataacttttagagctctaacacatagcatagtactatcaatttatatcgacaccaacacagcttattcacagtgacgaagaagttgccgcagagacgctgaaacctttgaccttacaaaggtacgaacaaaagtagttatcacatactatactgacatagtcacgtacacacacgatgacagacaaaacgccgttcatgttgggctacaattacaatgacagctatatagtatgcttgcattcccatccaagacaacttacagaacatcaatcagcttcctgacggccgccatcaccccgcgcgcgtgtacgtcgcaatggaccgccaccgggagcctcccgatccgctgcgccagctcaatggcctgcgccggcatggactgccgacgagtcgtcgtcgtcagc

SEQ ID NO: 25114 - DNA, 481 bp, Zea mays
  Clone ID: cC-zmle189034c12a1
ctgcgctgggcaccgtcgcgtgggcggccaccgcgctcgcgctcggcctggcgtgcaaggagatgcgggccgccgccgccgcggcgcgcgggtggcagatgcgcacgctggaggcggtcaccgcggtgctggccgtcacgcagctggcgtacgtgctgatgctgcaccgcgccgccgccgccgcgtacgctgatgatgaagccgatgctaccgcctacgccgacgctggtggcgaccagtgcgagcctggctgttccatcggcaccgaggacgacgccgacgccgactgccagcgcgcgcagcagcagcagcatggccgccaccaccaccaacccaggcagggcggcgggccctcgtgcagtgtcatgtgaactagcatacccatgcatgcatgtttggtggtgtcgctctcttgtcttgccattttccgtgctcgtgtttcgtctcgtggaaaataagcaatttatacttagtttaaaaa

SEQ ID NO: 25115 - DNA, 295 bp, Zea mays
  Clone ID: cC-zmle189034d01a1
ggtatgggttttaatattattcccttacttttttcaccactattaaaactcatactaaaaaactacaaaactccacacaccataaaacaacaccaaatatatataaatctggaaaaaaaaaccaaacaaaaaacattaatttctaaataaaaaaaaatcttagcaccaaaataaaacccaccaaaaaaaaaaaaaatcaccaaaaaaaaaaaaaaactttttaacacaaaaaaacccactttttataaaaaaattaggaaagagagaaaaaaacacacacaatccccataaataa
